United States Patent 10,221,454 (METHODS AND COMPOSITIONS FOR SCREENING AND TREATING DEVELOPMENTAL DISORDERS) - sequence listing, part 7

SEQ ID NO: 90 - DNA, 365555 bp, Homo sapiens
ccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcagcgggcgactgcgagggaggaccgtgtcccatccgttaagcgaagttagcactggttctccagcgcaaaccagcccaaccaggtcttaccactgcggcgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctaggcacgttccgctctcgcggttgcgtgtgggccgggagtaagcgaagggcgcggggctaggccggcaggggccagcgcgtctggattcgtcccgcggcctctttgcccccggggtgtaagggtttcgggccgtggagaggaggcgctctgacccgcacgtctccacccgcgcagcccattgcacttcaagtcgcccttcttatccaacccatttctctcgcccttagttttaaggcccaagttgagccaccttttgctttgcaaatggctcttctacccccagcctcactaggttacccttactcctttctcacctctccgagctggccaaatcggggctctactaggggtgccttgtcaggattcgatccacatttgtgtagggtggtgggtggagattcgtgttatatcgaatagcccaacaattttaggaacaactgaatggtactctgcttagcatggagaagtgggttgagtagaaaggaagagaagccacgcagaattctgttttagcacttgtcatttcatgctattcagaacagtttaaagtttaagcacgaacatgtcttactcaacaaaaagggaatgcacttgggtgggtgggggtgaggggggagcgtagcaattgaatttcaggtccttgaaaaaatatacatccttatgagggatgaacaaaaagtttccagaaaatagtttactgggtgctgacttgtaaaattctatcattgaaacagtttgaatacagatttcaaacatgatgttgtagagtcaaaggtgatatagagcttacttctatgaagagcattcaaaccgcagcaaagcctggttttacttgaagtgattggaaccagggcaagtttagatcttgacctgaaatgccagaaaaggagatcgtgactcctgaaggaaaagtgctgcagaaatctgaacaaaaatgtcagggcctgaatactatttccattcttgcccctgttagtagttttcactttacaatcacagcggggttccctgagctgcaaatgaagaattaagttttaatacaaacagaattgttggaaggtaaatgcctatgaatgcaagtctttgaagtgcagttgttttgatggcactaatttttttctgtgccttaggaagtttcgccaccatgctacctaaggacagtgttctgaatttttataaaatttcttcctgaatagcatgagaaaattgggcatttaacctcctgaagggaactttttttttggggggggtgcctaacaattatagtaaaatagcagaatacctgtgaaattaatatacaatccttacagaaacaaaaatggaaaggactctcccatacacaaaacaaacgaaaacttttttgtgataatgtaaccacttcattttcttgtcatatgccagcaagaatgaaccttgtaaatgtgttgagtcatgttaaaaatatccttttaaaggttatcctcttctccttcctacatactttgtatactactttagtaattgaattaacttttagttctgatttactctaaactttacttgaagcaggtaaacatagaaataaaatggaactttcactttctggtttttctcttagggatttaaatggaaataacatcacaagaattacgaagacagattttgctggtcttagacatctaagagttctgtaagtgcatcctctgtatttttaaataattttttaaggttgcatattttgaatcattactggcctcagtttttatgactattctgatgacagtaacataaaacatttaaaaggtcatgctttccttttttctgtgtttatcattgtactacaacatttaataaaaattggggcttttattttaaggttggaagcatgccatagaaccaataatccagaaatgacctcagatctttgttataccataccctaagcgctttatgcatataaaaatgttgaataattgttttcacaaaatgaataagtaataagaaacatttgatacttttaggatttgaaattaactaaaatatttaagtggatctgtattttattattgataacaaaaggattcttatttttttgcgaaaatctaatatcaagcattaaaatcaaccattcaaattttcagcagagtttataatgatacattagtcatattttgagtttttatattttgtgtctttgtagcttctataaaattgttgcaatatgattacttctttaattagtgggttaaattagctgtgagtaaaccaccacttgcgagtcaatgtaatgttaaattgttctcacccacaggattgtaaatattgacatcccagtagccatacagttttgaccattgtgcattcagtgttctaagttttaagagacacattttggtcattacaaattattccagttgctgatgtgtatccatgtcagaattgaagtatgtatatgatgaattactgtattttgattctttggttaagttgaaaaccagtgtatcaaagaaagctatcaaagcttcagtgtcaaggattactcttcagatatactattagtttaagggtcagagttttgaccagtaaatctcatgagaaactgcatttgtattaagttttgtgatgcagacactgctatttcccttccatgagttcactcagatatattattattaaatttgatattggatctcaaatcagagcacaatttaactttataaagggaaagagtttacaagttttcagttgctgaattgaaatttattcagatggtgagtggtaacattaagaagcatgttatattttgcatttcagtcagcttatggagaataagattagcaccattgaaagaggagcattccaggatcttaaagaactagagagactgtaagtattttcaattccaaagttatgacaacataactgtgttttttaaaaatacttaaatttcaagcatcatgtcttcaatttcatgtcttagggtttgaaattttgcagaaaaaggaggatgaatgagtggttttcaggttaatttatgacaaatagagttcctgaataaaaagttctaacttgtaattaagctcaaaaatacagttactttcctgagacatgtatttccttgataatcattgctttggtacttaaagatgtacaagcatttcttattcttcatttgatttgttttatttgctcatgtaggaagaaaggtggtacttttatttgcgttaatggtgcattagggaagagagaagttttgctaattgttattttcattttcatggtggtgctttgtgtgttatcagtgacatttgatgaaatattttatattttactaataaagatttacttttttatatttagcgtggtgaacattgttattgttaataattacttttcagttttattttatttggccctagctttaaaaatatttattctggaaaaataatctaaacattatgaaagtaagaactgtgttatcaaattgtggtcattcaaagttggttttcttcccaagaagattaaatgtagacttcagattttaagatacgttttttacatattacttgaggactttaaaaatgtttacagtatatatctgcaaaagacaaaacctctgtctgaaataattaagataaattacagaccttgtaattgaagtacgaattgtatgtcttacatgccttgattattcaggtttgatatgtttgcattttgaaggcaaagaaaagctctagtaaaagaaacaacaattattttaataagttttcatgcctgccttaatagtcactttaagtaaaaataatttttttcaaaaaataataaaatctaatgttcattttaagcttaacacatattcaggttcactgggcaaaagggcagaagttaattccctgtaattgtccataagtagaaaaatggtttgtccccttccaagatatttataaatatatagactatatttttatcacctcaagtaaaacacagaaatgtctactttattttactattggtctttctctatgttaaatattacaatacaaggactataattgtggaattcaaaataaatttaaaatcactactttcaactaattttagagggaaattaaaattggtaaacatttggttgcattcataacaaagcttataagttcatagcctatctctaaatatataaaaaatactctgaaagtatttattctttgatctccttgatagactatgtgattagctaattcctagtaagtaacttgcaaagatattttaatctttaagaaagcatcaatataattcaaatgtttggtaaaatgaatagataatttaaattatcatttaaactttatgttttcaagaataacttttagtcaccacaggaaagtatcttgagtttagttgttaacttccaaaccattgaaggagttttgatggctttttatgcagtctctattttggttatattgttgttttaaatattttcagggacactagaactaaacaaactttctcattctttttcaagtcacttcagagtgttgtctgaactttcatcttgaataaattaacttttcctaaaacttattaaccagatgctatatgctctgaaatttgattagagttgtaagtaggtactattttttgacttttacttcctctgggaatgtcacttcatctcagaacaattttctattctactaagactaagtcagatgtttcagagtgggaggaggatttgtaattctgaatgaaaactaatatatatgcaggacttctttaaatcaccccagctgttggccaagagcaaatatttcatatttgtgaggaaaagctgagaaaattccttttgtttacaactgccaaatccatctgatggaagcacattgttatctgacagccaattcatttccttggactctggaattcaaaaccatttcttaggaacattgtggatacacttttcaaatatttattttttaaaaatacattaaatggcaaggcaggtttgctaaggaatgcattcaagttattgtgaaacaaactattttaaattttgttcattgtattgatttaaaaaataaaaactacaaaaaccccaaaactacccagagagttccataatcaaactgctatggcctgtggtatatatctttattttagtcagtgtcattaacaccaaaaaattgcttgctttttcaaaagctgcaagagacaatgtgagagacaagaagaaatcaataaattagctttttattatgtattgtgtaaatttatatggtttttaagaatttagttgtgaaatttaaaattggaactcaattatgaaaaaagtataaaattaggtttatgttgtaaatcccatttatatactgaatagtgatttaatttttattccttgtatgaagaacaaaataaaataaaaacattaattttattcttgtgtaatttatggttttaagttattttcattttaaaatgataaaataattctaaattacattttgtgaatatttcatagttatacatttttctttttcttttattttatgttgatggacttttaacttgatctatagaaaaatctgaaaacagaagataaagatctgtaccttttaaaaattcagctttttaatctgcaagaaacagtcatgttgttgatttgaatttaattgtagcatggaatggcaaagtcattatttgcaaatcaaaacattatagctataaaagatagttttccctttcaaagagtggatgaaatacaacattttcagataaactgtcaaggagttaatagtaaaatacctcctcctttctttcctcctcctctccctcacctccttctttttttcttccattttcttttctttcttccttacctctctaactagctccttccctcccctctcctccattctcttacaacatgagataacacatcattgtcagaatgtggttgtgcatcactgtaaaaggaggaagttgtaatcacgtctgcataccacgagcacacattattttctgttttgacagtttgtttctgcactctcagacctaacatgtgcagagtcacatttcctaggatgctctgtattgctagtggtacctgtttatctgggatgaaaatgaagccttcagtatgtgccttatatagactgtattagcaggtctcctgttgtttaatcaaaaaaattttcaaatgaaatgtactctacctagatgaccagttaattcaatggaaattcggataaaaaagtcacaaataagctgcagtaagaatcaggacacttaggaagtatatttcttttatatacctcaaggaagatacctgtgtatatctgcaataaattctccatgcaaaattattaatttgagttttttttggatgctgcataatgtcctagagggttaaaaaaataacactgggacccagcaatgctgtgggcttgtgtaaaattctcttgttcacacactgtttatgggattagatactacagtcattcacttctattttatggtcttttagggggacccagatcatgtcagggttccactagtgaaaacaatcttcttttgaaatttccttgataatacaaatgcaaaagtatgagaaagtttttgaaattttttagggttgttataggatgttttattatttactccaagactgaaaagtgaaatgcatatatgcctaggttatgttggtaagaatcagtagcatactgtgaaaagtcttggatattaggctttgtgtgaacaccgcaaccatcttgtaaccttaaaataagaaaattgtggaaataacaaaggcaggcatgtggagtgttcatcttttcccaccaatacttggtaaatgtgtgcttttaagacaaatattgctttaacttctcctagtgttagtataattgggtttgaaatgacatttttcccactagctttgtcatttgatactcatttatgcttgaaaatgagctctgaaaatattattatgataaagccatgtaaggaatcttgaacagtcaagctgttaacttagacatttaaagtttccagcaagttgatataaagaacatattctttttaaattagaaaagtctaagtccctttacagtggagcctacatttgactaaacactacattctaatgagatggtatgtaaaagacaaatttattttttttaaggtgatgctgaattagttctccctgcatacacatatcactcctaagcatgggacagacagtgtgagtgaggctgaggaagtatgatgttggtagggtttttgttgtaggtctttacacatgagttcaagtagagaatatgttgtggaacaggtctgaaagaaagcatcatttatcctgtgttcatcaaggatctggatatattctctgtttatcaaggattagtctcttctgactaatccgacaagtttataggcaacacataacacataccttttcttaacagaatgacagtctaacggtgctaatcttcttggaaaagaattcaagcccatctcaaaagaattgttttctggtatctttccacacaagtttaaaatcatggcagtcattttcttggaaagtctctttaaaggacacatcaaactctaacagaggctgagtatgcacatagcataaaatataagtgttccaaaagatataatagccattatatgccaatgatgttcacctattcgtaagcaatgtggtcaattttaaattaggtttactgacgctggtcatagaaagctttaatccctgtgcgctgttacaagtttagcagaacattgaatccatctgagagaatttctcatgcaacagtttttatgggccttgaagtttaatggtggtgagaaggcccgtttgctctttgtcgaccattttataaattctgaagcagtgagggtgtttatttttcccacatctgttttgggtcctcttttgtgacagtgtttgctggatgccgtgtcctttatacctcccctgaaatgagtagtttagtttgcactgttacaatgtatttgtggaagcagccagtgtcaaatattttacatttaattccctctctcatttcttttggatacctttctgcttgaattgtgtcttctagactgaatttcacaacttgacatggaaagagagacatttctgcatggacttcatatatattgccattatgttttttcaaaccaagtgttatctgctggactggaaagcatattgatgaaaatgctttcagaacgaaagcttgataatagggctgtgatttgatctcatcaatattgctttacgataatatttacagaaaattatttgtgtgtcctctctgcaatgtccatacactctgaatacagatggacagttctggagcattggctctttgctgcagtttgaggttctagagtaaaagcacagagtgtggattatctagaaatccctgttcttcgacatcttattttatctactgatgcttggtgtctcatggaataccaggcaaatacacatcaattgtactgttgattgtggtttctaaccagatacaagctcccctttctccttttaaaatcagaaacgctagaaaagagtgatatcagaaaatctttggttttaattccactgagggatcttgatcaccttgcttcatctttcaaaacttcaatttcctcatctttaaaacagggataatcattatatctcatagtggcaataagtaagataatgtgcatagcttcacaaaatgctgggcacacagcacttaaataactattattctgcatttcaacatacctctcatatttctcaatagctgagtttaggaattattttatcttagctgctaaagtgtatatatgatccatttgactttttacgaccatatttacatttttaaaaaatgttcttcctaacgtagtatatggtcaactgaagagatgtgaagaaaagcttaacaacccttcaatggttatttcagagtgtttctcatagtctctctgagtctatagagaaataccgggaagtaaggggataaaagagggagcaatattttgctaataagtattgacatccctagcaaggaatacaagggattaagttatcattgatatcactgctgaagatgtaaactttattttatttacataatacaaaataaattttaaaatctgtgctttaaaagtgttaaaataaaaacatttttataagagaagtcaaaatttacctgagaaggtggcaaaagaggaggctaaatagttttatgcttgatcattcatgtaggagaaataggaggttagaaatggtaggctttgaggcagcatttatcaaacatttattacagacctagcacgctgctaaaaacaccttatatttacatgtaaatatgacatgtaaatatggagcacaaaattttactggctttggtaaaactgttttcatattacgttttgaattagatggaaggttgtgaacattaattgaattgaggtgaaagtcgcaaaaagtaagagactatgacctctgctaaaggacaagagtcatagacacagctggcagataataattcaaaacaatgtttgtcaatacgttcaggctgcccttcaaattgaggttgttaagaatcagtgtttcagaggccagtggtgttttgtgcaatgcagaaagatcattctctcttctgaaagtcaaactcaaaaatagctggtagcacagagcaaacagttactggaatcctttctcatctttgccctgggagaaagtatctcagagacatacattacacacctttctgaaactgtgaattgccatctagagaattatcaagcatttctgggatgttgtgggcagattccattgaggggtgatgacacatgacttatatatcactatatctctgtcattcctttgataccattgagtgtctgtgctctcaacaatgataattgactcacctggtctgtttaacaaagctaatttatgttggctcccataaataatcctctgtgatatctttaattcactacatgctgtttcctgttctggaaccatcagatttaacttcaactcatttacgttagagatcttattctgacacgatcatcttcaagctgttaagcaaatttctgtcacaattagaagctaggctactttttctctagctctgtttagtaattgttatataccttaatagtctttaaaataagtttaaattttaaataaatgctctttattttaaggatttaatttctggtgattgcacaggcggctatcctttaaaatttttctttaatattttgaaagttttgctttttctgttaatgtttgtataaccatttaaccttagtatggatggaagagagaatagaaaaagtggagccaaatgtgtattgatactgctttaaagacaataaaagggaaacgtatactgttttgttgtatccatattaccacattacttacgttatctgtcctttttgtgcaataccaccttgtcttatcctaaaaacagaaacgtatctggtgggtttagacatataaagatcactcataataactttcatgaaataattataaagtactgcaattcagagaagaattcttcgtatatattttcagttttttttttctgaaatttaaaatacctagttttcaacaggtgtttaaaaccatgagctgaacgtagagctagcttttttaaaaaataaaactttgttgtatttacaattgcttagttcatagatatttaagaaatggatcaaataaatctatgttttgcctcagggaatacaggtgaaaaggaaagcttccgcattatattattctgaattattgtttaggaatgtttagactatattttttccagaggagtgattcagagggtatgttttagtgtcataccacctttattcaggccctagctttatgtctttgaactctgcacttctctccagaacagcagtgagaattgtacttactcatggggatgtggtgaggagtgaatgagataacttgtataaacctctcaatagtgaccatcacctagtaagcttattacttacacagtgaattagaacacatgttagctattagttacacagtgaattaggaaccactgggaataagaaagggataataattaagaaaaaaaaaaaccacttcttgtatccagtctgaaaaatctgctttctcacaatatatgaaactatactgatgtagactcgttaacaagaaagctggtagcagctgttactcacttatatctctgaatttgtttaaacacattgaattctttccagcttctaggtgatgccgagaatcacatcatcaaggatgttgatggaatggaaaggaggaaactattgtctggggcatgtgaaagcaggtttgacagccagagaatggcatcaaacccaaggcaggtgcctcagggaggatgccagaggaatgttggcttaatataaaatgtaaatgctagggccttgctgaaatatatcaaaatactaagagaacaatctgttctcattcagcatttcctaagaacctactaagggccagagattagggaatgttgactgagagcaggctgctctctttggcttttcatatggttcagaacttactaagtgccagggaagaagggagggaatacaaagatttagtctttatgcttgaagagctcacagtctagtgggaaagagaccagtacatgaataaatattacacagtgtaagggactcttgcttatcaaatgctgtggggacacagccaagagaagcactaactttttgtaggagaatcaggggaaggttcacagaggatgtaagaaagcaccatttggagaaaaggagaagcacttcataaagagaactgcctctgcagggcccaggggcttgccgagaatgcttgctctggctagagaataacaaatgaggctggtaaatctcgtggtttggattacatcatgagagctcatttctgatgttttagaaattggaattggctctttggacaatggaggtccttccaagagtggttgcattcctagaaaaaaatctcattaccactgttgcaaatatgtgtaatatatttttagagggaaatacaacaaagtaacaatctgcatttcattgaaattgtataatgctagactctggaagtacactgtcttcagaatcatacctaacagagaacaaataaatgaaagcttttgatttgactttaaattttaccttgttatgtgcttcatttaaaaaattagcgtgtaagtgggaagtaaattcactcctttaccactaattttactatttgcctctacttgtcttggcatacttttttttattagtatgcattttattaaggcctgagaatgtttctgtagatgatcaacttctttctgagttcacataaagttatggtgccatcattgcttcatggcattttttagaatggaaagaagttctgaagtttacctggtctcgcttctcacttacaggattttaaaaaattatatcattttccaaaaaaaattcatagcctctgcttgaatacattttgagataagcagttgagagtttccatttcttaatagctaattcttagaaaggtcttctgtataatcaaatttcttaggagttacaatcaaggggcccatttctgccctctggagactaaataagtataattctgcatctacccgatgacccttgcaatatgtcaagattgatatgccctcttttcctgtcccttttactatttatctttaaaacttaagaaatacctctggtttcctcagtgtgacattaccttctggaactatatccagaaactatactatataatatgcctctactcctctcgagctaggcagcttgtaagtcatttgagtgcaaaatgttacatcagctctttatcgttttatttagatttgggaaaagcagagaaatagacagttattttaaattaaatgttaaattgtacactgaaaacagatgggattgggatatgactacatcacagatagtatttacccactctttctttaataggtgtgcataccaagcatcagggcttaaattgagttacagttgcaatcacactcttttctaaaacatttaaaacattccaatttacttagacattttaaaacattactgaaactgatttgacacaactgttagttataatgctgagccttaaattcagttaagggttggaagctgtgggttgaggtttgaactctgggttggtattctcctgattttgcctatgggacaaatcatgctgacaatttctcacaccttttttttttttcctcccaactaaatgaaaagctaagaaagttgaaatttccatctccccacaattccttggctgaacttttaggccaattgggactgtgtatggattattttagacaccattcactgtggtatttctgctggatattgaagtcacctaccttaggcgcctaagactgaatcacaaaaatcctttatcattgtgtgtattctggttgactgatgttgcacaggatttcagtttaaagtttagaccccagtaatcatcatcttagtaagcacaatggaaaactgctgtaaagagtcatgtaacaaaaggtgtaaccaacttttgatttgcaatgcttgaattctcctgaatgtcatttcattcttttctgaaatacaggatgaggcatgacactaccaaatcacagtctcattgttgggtattttctatgtaacataagctttgtttttgttttctcaaaaggcgtttaaacagaaatcaccttcagctgtttcctgagttgctgtttcttgggactgcgaagctatacaggctgtaagtagacacaaatagttattgttgctttgggtagtaccttgtgttttattaaatgtattttggatctgtttgtgtgtgctttcctggaatctgttcatcaatagattaatggattaaaagtttgtgttttttctttaggaaatttatgatttgttttctagtggttccagttgttttatttggttaggatttagcggtttatgtatgtgttatggaaattggattattattatttttttggtaacgtgatgatggcgagatttacctaccttttaatggaaatgtttgattaagttctgaagggagaaaattgctactgtttcctcttaagaggaagttggcagtgtgttcttataaagttgagatttttaatgtcagcttttttggtattgtttctgggctcaagtagtcgtgtttattagtccgaaatattattataaggtatttaaagagggctgtaaatttcctcttaaatgtttcctttaaagccacaatttcagcctctgcaatatgaatgactgtatggcaaggttttcatatcaaatacgtcatagactattaaaggaagtaattccttaaaggagcataatgtgagtattagggggaatcactttttcctccctggaatgcttttgcactgacctaatgtgtaatagtgaaaacacattttgaaagcatttaaaatgagattttcagccatatgaaatgactttgtgcagatgggagataagctacaaagttttggaaaaataaatagcaatgattattgaggtatatgcatgttgtgaaaaaaactgctggaatgtatagagtaaattgctccattagcccccacctggatggtgggtgtcccatatggtactgtttgtagagaaagtgagcatagttcctttttctgaacttgtctttgtagcctactagttcaatgtggttatcaattccagaagtaggaggactgtcctctcacacccttcacccccaagaatagccaggatctttgttacatcctcctgaaaccttaacaaccttaacttactatagggagatattccccagctgacataccagatctctccagagtctttcctgactttgttcctctaaggatagctaaaatcacctgacatttttctcttcttttttgtgttccctgctgctcaattggaccaatttaagtaaattttaaaaataaaatgaagaaaccttggaattgcatttttaacaaaaattatctaataactatttttacttaggaaatagggtgtaggtttgctataaagattataggtatgcatatcagtagataattatatctaaatatttgtgcttagtttctaaaaagggccatagaattggttttgatagtatttcactttcacctttagttattggtgactgaggagatttttaaggaatcgacttggattaatttcccccagtttaaggtggtataatccattgcagaatccctcatcagcaaattatattctccttgacattttgccatctttgacaatatctcatagcagaccaagagattttcttttatgttttgttatgattttataactgtatgcagctgctgtatgaaaaaagacttgaaatctttaagtgaattaaagaaacagaatccataaaacctatgacagcatttcctaattaattaaatgcgtgttggaaaatggggaaacaggcagctagaaaatgtgttcagatttttttatgtgtctttctggctcaaaggatttgtcctggggagtaataacagctaaagcagtgtttgttaggtggagctagttacaagagggatgtgaatatttttatgtttcaggagttatataacttgatggcctagcactcaatattgacaaagtgtatccctttacatgagatttgacatcagatttaggcactggatgtacatagaaaactagaggtggaatttttatttgcatcctcacgtcaggaatcttaatttgagttaaggaactgttgcttcatctgaattagacttaggtgaattgttgagtgctttttctctcgagagaataagttataagctgcatgtgaccacttgtttatgatggtgataattaattaaattaaacaactgccattggaagtctttaataaacaaaggaacacgtgcttgtgaagctcactactggctagtgtaattatgaaaagcaagggtacaagttcacattttctcacatgatacagatgccaagtagctcacctgaaacaaatattctagcagatgggaaaatgtgcacaaacctatatgcacaacatcctttataatgctcatttaaaaacatatttttttcacaagaagaacaagtgacagaacaaaggatatggaatttttgacaaataatggggaaaaatgataggacaaggaaagtatttgatagttgatatatatatgatcgttttataaatatgtgtaaaacaatatataagtattctataaatatatatttatagaatatatgttttgacatttatataatatataattattatacatagtatatatttatatgtaatataatatataattaatttatatataatatttatatataatttatatttatatattatatatatatatatagcaagccatagttgcccctactgtctaatgcagtagaggcatactatatgcagaactcataaaaaaacaaatttaggatttacttcctctgtataggttgttccgagatacgaattaatgtttcaatttcttttcttagttattgtatactttattcatacttaacactatgttttcccaggtatatcactaataaaaaagtttactggtttaatacatagtttatacactgaagtttgatttttcgcattgtttgcttagattaaagctagttggatatactggacattgtgttgcttttctttgagctttggaataaataatcgccctttgactagtggttgaaaataagatgccaggggaagaagcacacatgcttttcatggactctaaatgcaatataaaagaaaaggagggtatactgtatatgaattatgattcgacacacttggttgctgctagcggccaaatatgcttttcctttgctgtctgctccaatttctctttggacgggttgagagagcactacatgttcaggtcaagatgtttgctcagaaatagtagtacagttgcagctgtgtttgttggagtaggagactagtttaaatagcattaccatttatccagtccattaacagaactctgtaaaataataccaactctgcataaactacaggacagtgtaataaaattacaagcacttgttgacagatggaaagtgcaagtccagggaaactaaaataagggacgataggttggaggttaaaaaaaaaaaaaataagccagcatgaagttttcttaacttatagactctatcttcccctttgctcctcctccaaaatcaaggttgcatttttattatgaacctaagagtagaggaaattatttttaaagaaatctggagctggttaactgaagaagagattgcagggaattttgaaacagttgattatgattgattgaaatttatgagtactaatacaaatcttcctgataagtgtaaccttaaaagaggcttaagagtaagtgattcacactttttgatgagtttgcgactactaatctggactcattaaagaggaatttcattggtagtactgcggttaggcatttggttataaatatttgttttgtggttttcggtttatttctttgagtatattatatttactgagacttctaacgtaagcttaagtatccaaagcactttttagaaactcatttttcacttttatctgccaaaccaaaccaaaactaaacaaacaaacaaaaagaactgcatctgtcccagggactcattttctctacttctttgaatgaaaactttttacttctggttctcaagtgccattcatgattccccagtgagttttggagcgactaaattatctaacattaggaatggtatttttaaggccaaagactctctttatggcctagtgaatacttacctgagacaaataggttttgactgcttaatttcattggccaggtcataattcattatctctcagataggatttcagattctcaaaattgcttttgataactataataattgggactttcttaagaggaaaacttaattttttttattaaggtaatcaattaatttgttcagcataacaaatatatataattaagctgtctttattttcctttccatcactgccatagaaggagacttatttttttttaatagttataagagtaacacatgctcattgtaaaaaagatctaggaaattcagaaaaaaatagaaaataggaagtaaaaattatctattatctcactacgcagatatagccattattatacttatcaattattatcttagaattatttttatgattatacatataagtgctacttagacgtgtattatgaaaacttttttttaatgtccccagggtctagtataaggcttgacctttagaagctctcatcaagtgtttgatgtattgaattaaatctctgttgggttcagggtttgtaacttgaatgagcaaatagtaactctgggacggcattataaataatggagaaccaaattaaatttaaaggataacttggtcaattaaatgtttgattcccctaggtttctcaaacattgaagtgtttcagtagacataacacaatcaaaatgatccatttttcacctaagcaaaatataccttaatttaataaaatgttttataaaacgaactccctagttcttggatgtcagtttagtctcataggtttcttggagtcaaccatgaaagcaggatacaacagaggagcccatgtacaaatttctcttgaattaatttctgccagctctgattaaagtgtggactactagagatgtcaggtgccatcgtttcctgcttcattttactcttggcctgtttggcccctgccacaataaatccgactgtgattgtgcaggaattgcaggttacagttgctacggttactgttgttcagccagaccgacatcattactcatctagcgcgctgccatgatagctaccgctgatttctgttgctgagactgccaaagagcttcatgtgctaagggtgaaagttccgtcgaaggtggcgtctgtgttctaatttggtgtaaggaaacactatctgaattatatactgatactttgctaaggggaacagattgactctgtatcgagagagaaaacttagaaaagtgttcactttcagtgattaaaacaccaagtccttcattactaaggtaactttttaattacttattgggcccaagggactatgtttttgccacttaaaaaatagaggcatacaaggagtattgcatttaaaaaaattaccactatttaaccaaaactttattttcaaatagataggcaacagacttgatatatggacatctgaacacaactcaaaatagccattaccacttgtcatgaaagaaagaaaagtgcaaagccctgagcaggacctacttctacttttattttttaaatcaacgtgtaatcctgtgatttaaacgtcctaaatccaatgaagattaagatcatatttgagattttgccagatctagtgttgatggtttttacttcaaaggaattactaatagacttgttgctaaagaaagctaacagttgtccggtttctgctgttaccaacacacagagtggaccttctgagtgtgaaatccacagcatagctcatagcataagaaaatcaaatgcaagaatgcaagaaagtttctgtgtttttttttttttcactcagctgtacttatttaaacgactgctttcacaagtgcaaatgtttctaactccaccaacaagtacttatggactgccaacttgaatttgtagaatactatgatcaatgctcagaagggaaactaacaaaatatgtggctctatataatatgtggtatttgtgggcctcagctgttgctaacgtctgacctatactgcgtgaattaatgcctagagagttcattgagagtgatcaaatatgtgaatttcagtctatcatattcatgtaaaaaatatatcgtatacacataatcaggtaatattttaaagtttttaaataatgaaattgccactacaatctcaaggttacaattttggggactgaaatttacataaacattatttctaggaataagggttggtagggttttagttatatttaggtaattttaatgtatttgctttatgttttaagacactgaaatcaatttactttctatcttaagggaggttgtgtaaaatgatagtgtttaaatgcctactcagatacttgcagttctgttaactttggaagtcagtagacaaccgtattgttgaggtttcttatctgtaaaatgggaaggatcatacaatttactttctggggatagcacagtaaaatttagattccatattcaaaggaacattgtaaattttcaagtatgatagaaactataattatattattgtcatcctttcattgcaagcaagatggaaatgatagtcactcagatgtccttgcaacttgccctcagtcagcaaagttcctgatactattgcacagccctcttgcatttatccttactgtagtaacacgtaaatatgtgtagtcacattaattatcttaccacagcaaattgacataaaatgtgcatttgtaccatgttatttctctttacttggctgcagaaggtacattagggccaggatattcttaatgagatctcttcatgctctcccagttgatgattcatatagttttaaaattcatctataaaataaattacagatagaaacaaaaagactgtgactcaggaactatttgttagtgcatatatttagattgctgttttaatgatgtgtttttctgaatgacaaatgaaggaaaaatacaaatgttagaaaatgctgagtaaactccttaaactataggtaaagtattctgaaagttgttcagaagatttacatatgttgctaaggaacactttcactactaataaaaattttattttttaaaataatataagattactctgttagctttgtaatatgtacatatgatttgatctatggaacattgtcatctttatataaattgcataggtgattttaagtgtatttttagactactaattatgtcaaaatccagtaaaaattgcaaatcttttagcactttaaatctaaataatgttacattatgagacaagtttgaaccagaagtcgttttgttttgttcttttttccacaattccagtacttctcaaagtagcatagatctatatggtgtatatccactcattacatgttacctataactgagttgattataatcactgaattttttctggagggttaaccttaaaatattttataaattttgatataagaaacctttggatggaagttttaaaagaaactaaatcttagagaaggaagcagtgaagagtaaaaagaccagtccttgacaacacctatggcctagggtacagcatagaggtgtgaaatgttattaagagaacatctgtgtctcttgaaacatcccccaaatgaaagtttatagcaaagtatggcaacttgatttaagtgttaaaaacaaaacaaacaaacaaacaaaaacttaaaagagaaataagtaaatctggaaacagaattggaaaaaatagctttgccccatcatgataggtttcttctgctagtgaaagattaaagctcgaagtatgtgaatagctgagaacagcacagagaaaggttgattgcttcccctccgacagttccaattgattgaaaaaagcctaatttaaagttctgtttgttctatgtcttaaaccatcagaattctcttttgggacctgaggaatgctctggaggaaaaagaatccaaggataaaaagtcattgcaagccaacaattgttcctaatcctcacaaaatgctggagaaattaaatttattctttattgctcaaagtgttacctaggtcactgggcgatgggaaaattggactggaagtcgagtaggcgcaagctttgttttgtgtctagatgcttaaccttagacacgacaaggcatcttagagtgttgtgggaacttggttcagagcattaacaccaagacttttattaccccggatttataataggctgtgctgtcaggagatgaaaatgttgtgtttacatttcagtgttaaatgatcatttaattaacacctaaggggaaaaaaaacttgtgaaattcttagcagcttttattgttggtttcctgggaggttttaatatccaagtttcattgagaatttttttgtaagtaaagacacaaaagacattataaactttttaaggaagacaaacagtttaaccttgaccctttaaaaaaatattaatttaaattaaattttaaatctggtgttcttctcataagtttctagactaatatattaaaatacattttgattggacactacttttgtgtaaacagtatataaatatgattgaatttacattatacattttctagggtaaaacatttgaaattactgattagtttatcttaagaagtttaaaatgtttagaacactgacttaaacattttgcatctgttaaactaccactgtagttacattgtttagaatctgcctcaatgtaggtattcatatgcaagcatattctattggtaagttatgtcattattctattatttttaatcattaatttggatatagctacatcatgatgaaagattttcatcatgatgtagctatatccaaattaatatatatatatatacacacacaaacacaatagggaagaataatgccattaatatgaaaactcagattcacttaattagaaataactaaaagattagacgtcataaaatgcttttatttactcttgctcttttatgagacagttaaccaaaaaggaatggtcttgaggcagagtgataacatttggaagatgtaatgtgtactgtcaagagtagctgcatagttagtaacactttaagggtacctctctaaaactatctttaaagtttacatcttttttattcccattttatctgaatatgaagctttatgttcaaatatatgaaacttaaaaaaaatttaccagtttacatgctgttaaagtaaaatctttcttaatttttccagaaatgaacatgtcattatgatgtagtctttttctaaatacactgtttatgttcacactgaaacagaaatgcttatctgtttttttttttgttgttgttgtttaaattcaaatgcctcaggataaaacccactctctgtcttattcatgataaagaagtgcatggaaaatggaatgttgttaaaatctctcaataaaaagccctgcttttaactaaggattataccctcacttacaaaacactactgagcaattatgtaggcactttttatgatgttatatgctctacttacttctatcaagtttcaacctttctgcaaactttcctcattttttttaacacactttgatctttttcttcccaaagcgacttttctacccagcctcttgtcacaaaaacccagaaataggaatatcgctttaaacattttatcttctttacgtaaggaccaaccttctggttgagttagttgcaagacaaaacaaacaaaaacaaaaacaaaaaaaacacaaaacattgtccagaagtataaaagagtgaaagacaagagaaagagaggagtaacaaaacctggttatttaatataatagccagggtattctaaatggtatagtttgtcataccaactgatattccaagccaattgggtgatgccagtggtggggggcggtggggggagggcgtgtggagggggaagcgagaggtgggcatactgagtgcttaagaaacgtacagaagaagaataagtatttagggaaattataggaaattccatttaacatagatacatgtatttcttttatactaaggaagtcaatgctgtgcttttatacggagaaagtcagtgttaaaatttcatacattccttttttgaaatctctgctcagaaactaaaaagaaatatttcagtatttattttagataaactctccaggcttgcctcttaaaaaaaataggaataacttctaaatacaatctgtgctaacaaatatatttgacagttactctaagtcatttcatgtattgaggttgggaaataaaatatcgagaaatactctgtattgtacttggcagtgattagttaaaattaacctcccatttatatcacactctttcacttggctttgatgacccaccataatgtagttctgcattacctcttcaacgttatcatgctatcatagcagatctaccgtatctcaagcaagcagattttcccattgctgcctggaaattcccagcattatttctggacttctttctttcctccttcctcctcatatgggcctcagctcctctactaaagctttctcaatggttttagttacctccacatgatcattcattataatatggtacagactattgattctatggtacattataatgtggtacagatggttgattcagaccacctgggtttgagtcactgaatgtgtcatcttgggaatatcactcaattacctgccaagcgcctcagtttttccttgtgtaaaatgaggatactaggagtatgtttcttatggaagtgatgtgtggagtaaattatttcctaaatgaactgagcttactatggtacttggcatataataagtggcatgtacttactttttttgcttccttttatcattaaaactgtatcactgtttcctgtcccatataatgggttgtcacatataattctttaatcgtaacctgtgtattaactttgccaagattcctgtcttatatttgtccttgtttcatatgtagcatccagcctagtacaggtcggctaataaatatctttttgatgaaatagttggaaattaagcctgagaaagacactaccaatagattgaatttgggatgatatatgttgaggtgtgaaaaaagcactggatcagaagccaaaaggcttttacagctgggcatggtggctcatgcctgtaatcccagcactttgggaggcggaggtgggcggatcacgaggtcaggagatccagaccatcctggctaacacagtgaaaccctgtctctactaaaaatacaaaaaattagctgggcgtggtggcgggcgcctgtagtcccagctacttgggaggctgaggcaggagaatggcgtgaacctgggaggcggaggttgcagtgagccgagaccgcatcactgcactccagcctgggtgacagagcgagactctgtctcaaaaaaaaaaaaaaaaaaagaacaacaacaaaaaaaaaccaaaaagctttcactagttacattcctagctctgctgatcactagctgcagttgctgagcaaagatactggcttttttttgaggatcagtttctgtgtttatatatgagtatgtagtaagtcagataagagagggaccttgcccaatgtgttcaccatcctattaccagaatttagcagaaggcctccaagcctctagggaatgtgtgaagataattgagggaaaggaaggagatcaaaatacatctaagatgtgttctctctgtttttcaaaaatttacagggaactctacacaggccctggaataattacagtggtggagttattcatggtaataaatcaggaattagataattaggttgtggataagtgatttgagattattctctctattattagcttacattttgaatggctttgctattaaatgtgaattgtttgaaggcttatattaaaaaaatgttttttttttttttttgagacggagtttttctcttgttgcccaggttggagtgcaatggcgtgatctcagctcactgcaacctccgcctcctgggttcaagcgattctcctacctaaacttcctgagtagttgggattacaggcatgcgccaccacgcccggctgatttttgtgtttttagtagagatggggtttctccatgttggtcaggctggcgtcaaacttcacacctcaggtgatccgcccgcctcggcctcccaaagtgctgggattacaggcgtgagccactgcacccagctggttaaaaaaatgattaaaggagatttgatgcttatgccttattaagtggtgatcttgatacttgataatctctcaatatgaggtaagtggtgtacaactgaggtagttttaataatcacctgtctctcaaacatcgctagtggtagcatgaagaaataagttaaaaattaaacagggcaaatcaagataatataatggatttggttaataaaggtttatatgttcatatttgcgttataattttttttgtaataggttggaagcagggaccatcattttctgtaattctccctaggaaatgcattgtgcacccgggacaattcattttcctgactttttgaggagaacagaatgtgtggaacctgaataccctgaaggcaaaggaatctggagtctgtttctaagaggagagcttctctctgacttggtgtgggttttctttccctctgttgaaggggaatgaattccacacctaatgaatagtttcaaggaaagttgttaatcaggtactccaagtgaccaccctggattcttcttttattacacaggaacgtgagggaatgagaaagcagcatagttacatttgataaaaggaaatactctttctcctctcccctcccaccacaccatcccttggaatttagttgatgtgggaaattactgcagcaaataatgtgtttgaaaaagcaaagttgtatgaatgagaataacgcttgtagctacaataattatgttaaaaattcacaaggtatatccatcatcatatttcagagcaagagttttcgtctaacgaggttggaaaagaatttttccttagttcttgtcaatctcccagggaagcatggcatgcaggaataactgttgttaccaacattatattttgtgcttttctgattcatcagaacctttctgttgccgtaaaatgggaaacttcatcaaaatcagatgaagaacttcaagtaaatgtgacagaggggtaataatgaactataaatataattgatttttattcagatggacaaatgttattctttaatcctttcccatttagaagccatactctaatttaaaaagagaaaagtggtctctaatttaaaaagagaaaagtggtttaaaacaacaacattacagtccagatatttctctgtcttctaaattaagccacctgggttgaagaacactattcaagtgtgggtaaacatgttttgataaaaagttttgttatttccaaataactattatacccccaatcataagtgtgatatctattaccagatactcatttgggttgttttttaaaaataatatgattcagttttaggtttttaaaagtatagttcttatcttcaattctcaagaatatgtaataccttttatttattactatactaattttatattatatttcaaagaagtgatacctccagtgtgcactccagtggttcaagagaaaagtgttctgtggtcaaatgtgttgggaaataatgaaagtcatatcacctgtggtggctacagtgtacacttgtgtgttaatcttaaaggcatactacaataaataaatctgtttaaccttttaaaatttgtttttcaaagttatttaactatagaggcctctcttctttcttaactattcctgtttgttcttgttaatccagagagcaaaaccagtttttagcttttccaatgaatagttactttttattacttctgattgagattttattaaagaccatttaggacatatagggttgacatatattattttttttgtgccagcgttgtcacgtgtaagacttttaatagtgcattggcttataaatctgttcttttcaatccatctttgaaggtgaactcggcattctgttgtagccttgagaaatagaagaacttagaatattttctaacaatttcattaacttagcaccactatttgctttaggtatttgtttatatgtgtgtgttgcctgtgtgcctgtgtgcgcgcgcgcacacacacacacacacacacacaaagtcattcaactactattttaaggactttaacattttatagcttaactgtctctctcttccctgcctcagccaattgaagcaccagaagtcctttgtggaacacctgctgtgcacagcattctttagcaacacaatgaggggtgcatcatctaagctggtgtgaacttgcaggagtctttctcactctatagagagggtgttggagccaaaagcttttattttatgtacaatttggagatgattggtggactttgaagtcattgcaaaactaatttgttcagtatttttgccaagaccaatctttccagtattagaagacaaaataacttagatatgagggtttagacacaggaaaaaaaacaaatggaagaaatgattataaatctccaaaggcaacttttaaaaatacacctgaatgatgcttctcaccaggacacttaatattaatcattactgaaaattaccatctcatctcttagttcccccagtaagttgctttggggtcaccaatttttatttattgttaatattgagagaaaagacacaaatgaaaacagaatcataaaattagagtatgactcagtcaaaactatttcaaagcttgatattaaataaacaatataaataatttacttcaaattatacccaatatttgcacacacatttaatcttcagcttttactgtgcctaaagatctattcttaatcagttttggctccctcttcttaaagaagcagaatacccaaaccctcccattccccttccctgatctattcttctcctttggtttccataccatgtatatatcgcagtgtgtattttgcttatgttgtctttcaattccaattaatgtggaagcgttgtgaacatagacagtaacagtagatgtacaagaaatacaggttgagtgagtgaatgagggccttccaacaacctgccagaattggaatcctagctccagtgtttactaggtgggcaacttgctgccattcagagaatgccaccaccctgcctggagaatggggcccctttccttgtgttgctgtgcagtaccaaatgatggacaccttcccatatgcagatgttttcacttactttttaacataatgaatccacaaacctctagcctggggacttaaaaatgtgctgctttagttaactctagtgtattatagaaactgctaattcttatattgtcattattagcttactaaccaaatcccttccataggttatacattctgtgagggtttggacatacatatgcctctcccttcaccacagagcagtattcacatgcactgagtgctcaaatattcataggttgaaggaaaagggtagggagaacaaaggaaccatggaatcatccttcatggtaaataagcgaaagacagcatgtgaagcatcatctttttaatatctttgcgtatgttctttcttgatagtgtttgagtttaaaaagaatagccatcagtacacttgttcagtcaatatatctaagcacttatgcataggtgactttttgtaccaatgctttgactgtaatatattaattctgtttacaaaatcctgaagaaagggctgtcctacaacactttttatattatttgtcagttctctcccaatgtttttacccatttatgtgtgtgagagattttgttttgcttaatttgcaaataaaacaatattactacaaaattactacaaagttgaaattgctaatgtagtaggaaacaaatgaggcagatggtttagtctcatcattttgtgtctttacataggtttctaagggatagcttacatcatttagtgtgcttccaccattctttgccattctagggcatgtacttctgacatttttattaggcttttgtgtttggtcactgtattacatccagcaatttattcctttccacttaaattgtcttccctgtacaaggggtggagaagaattcagtgtctgcacataaaaggccattatcttatcttagcaactccagccatacactcctctgtgaatcatgacagctcagctgggaaatgcagaactgtatcataagagggcgagatcatgggagtgagacaatgatgaggcctatgacattggaaggtggtgagttcatcatctgcaacaaagattaacaaccctttgctgagcctgacctgataggccatttagtggaaagaccaaagcttgcatccaggaagtgtgctctgcctatgatcttgatttacctgtagcttgtaaagactactcaggtgatctcattgttatttttcttgccccaaatcagaacacctcctttatcagaaaactgagataagcacactgacactgatacttcatatgtattgcagcaggcaggctgtagggcaaatacatagaaacttttgcactttactcttttatttttattttttctgagacgatgtcttgctctgttatgcagggagtgcagtggtgtgatctcagctcactgcaacctatgcctcctgattcaagtgatcctccctcctaaacctcccaagtaattggaactacaggcacacatcaccacgcccagctaatttttgtatttcttgtaaagatggtgtttcaccatattgcccaggcaggtctcaaactcctgggctcaagcaatctacctgcttcaacctcccaaagtgctgggattacaagcatgagccaccatgcccaacctgcgttactcctaatacagtcttcattctacaaagagaactattttctgactggaggaagtggtgatgctgaggatggagtcagttgtgtagctctcataaaatgagaacatgatccagaggctcttccaagtgccttatttatattaatagtgcttcattcgtttttcaataatatggaggaggaccaaattacggatgagaaaactgacacccaaagagatgatgtaatgcccacatggcaggctagcatttgaatacagtgcagtgttctttaccatgtatattaactgttctggggataagagggtcttttaattaaataaaaacactatacaatgtgtaatcctcatggtaatctcttttaaatcctcacctcactttatgcatcgttaattgtgcataggtgcttacagggagcttgttatcctctctcccccaccctcatcccatcattttccaaacttgaagtttaatgtcactcttggctccttttcccttccttagctccactttcaacttctgtcagttctacctccacagttggttcatccgtcttctcctttccctctcagtaatttgcttcctaactgtacttcctgctcctgtatttctttatctatacagtcctctgcctaatggccagaagtatcctcctaaagtacagctaggaggccaggtgcagtgactcatgcccgtaatcccagcactttgggaggccgaggtggatgaacacctgaagtcaggagttcgagaccagcctgaccaacatggtgaaactctgtctctactaaaaatacaaaaaattagatgggcgtggtagcgtgtgcctgcagtcccagctactcgggaggctgaggtgggagaatcgcttgaacctgggaggcaaaggttgcagtgagctgagatcgtgccattgcactccagcatgggcaacagagcaagacttcatctctaagtaaataaatatagctaagatcacgtcccttgcccaaagatcattttgtatacaggcacagcagtttagatttaataaaacatttttccacgcattacactcaaaggtactctgataaatatgtatcaccatctcagttttatagatgaaataactgaagcctaaagtggttatcccacttactagcccacctttctagggctagtaaataataaaaccattattttcctgtaaacttacccagctgctgttgtctaaactcctacactggccttcaagttgtctaagtggtctcaagctattgttcttatttcctggtgttttctcactgtaccatggacttcaggagtgactcaaggaagctagctactcttgagcctatggacatgcctctgatatttcttctgccttcttcaccagtaaacgtgtattcactgcccaagaactagatcccgctttctctgctctactgacctacctgattgaacccaagaagctgtgaccccatttatgaaatcaatgccacaggcaagcaatgcgccccattaggaagcctctcacagtggagagtctagcagagaatatctctcttccctggagtgtttcttcctgctccttcactgcctgacaacacctcccatccccttttttgttaacaggatgtcttatacatctcaaaggaatgttctaacagggttcatatttatttatctcattatcaccttaggtcttggtccttagttggaacttttttgttgatggaaagactgtacctgataaactcaaatgtgtttttctcctgtgaggcttgtttggagggtttaatctgagcctattcactcttcagttgtgcctagaagcatctctccattgtctccatagttttatgtaaaaatgatcatatagtgagtatatccctatctctctccttctagaattcaagctactggtggcaaattctaagtatttttcatctttatgcttcccacagcacttaatatagggctaataagcacataggagaggctggataaatacttgctaaataaattcaataaggtcttttcttaaaaacaattttctttaaaaaaaaagctatgtattgatgtttaagttttataaagacttctcattcttttcctccaagtcaaatttcttttattgaaacagaaaacttgcttttgaaatgaaacaaaatttcagtaacatggtatctgatttttaaacagcctatatagttgcacataacagagtgtgtttatgtgtgcaaattagtaagtcgatagaatttccaggtaaacaatcatggctgttattgtatgccatcacgtttattatggaaacatattattgtaatttatctgggaatttaaaaaaacagtgtgtgagtcagcacgctgtggtacagagccaagtttttgtgggcaaacagggtgggattccgatcttggcttcagcagtgtggtgtgtaggcctgggttcctcacctgtggatggacgctccttacctcattggcttgttgtgaagatcgaatgagtctgtgaggtcagtgaagcacttacacttagtaaattctcaataaatattcactgtgatgttttttattagaaacactgacacattactgagtgcatgtgctctgcacgtgtgcatgacaatgaggaaatttccctttaattcctgaagtgctgggtgatgatctatacccaggataatttttctagtaaatcagcttattggggatgcctatggataaagcccttcacttttaaggtattccctttaatttaacaataagacataaaacattgaagtatacaaaatgaacggctatggttaatggattacctgcaaataaatgacacctgtccaaatctggcttcaataataagggaattcatcactttacaaaaacaagaagttcagaggtaggtcaagccatagcttttagttactttctccctcttcatttctccagcctcactgtcagtgtccaaaggctttgctcctggtgtcaaaacagccatcagtgtgccttgtgcttcctggttcatagtcagtgagagagagaagggaagaagggagggcaaaagagagcataggagatatctcccctcaagatggacttcaagtctctgttttcaattgaattgaaccaacttaggtgaagttgccaaagaaagggcatgtgttgattgatttaaactagttgagatacgtctctagacttttgcatggttgtgtaagtgaatcaggtcaggactctaataggacagagaaaggtggggcagggggtgctgatgcatgtggggaagtaaccaacaatgtccgtactctccaattaagaacttaaattttaatatttcatctgatttttgccacaggaatttgaatcagttttctgttacagcatttttaatttttgtgaataaaatggaacctcttagaatttggtttctttgtgactcatttcctcatagagggataataaaactcacatttccagttttgagatgactattaaaaaaaatctgtgtatgacccagtgccagcaagcccagcttgctttttgagtagttactattgttgttgccattgctattttcttggtcaggatgtctttattttattttgtctcatctagactccagttttctatttccaaatttttacattatgaatccacatgggtgccttatcacctcatccaagaaaaaaacccatgaaggtgtgttttctttttaacattttataaattatatgctcatacaatctcatagagttctcacagaaaccctatggtgcagatgctatttgtgcaattttagagatctctttatctgcctcctttaaactatgagcttcatgaggacagagactttgttttgttcactgttgtatccttagtattcaaaatagtatatcacacaaggtagactggcagatgctcaatcagtgttttctgaagaaagggagagaggggaggagggaggagccctttgtgacctacagaggttggagggctttcccagtttgtgacattctagttaagatataaaccctcattcgtagtgggcctctgaggcctgtataccctgcctctctacagcttcatcttgctttcttcactctgctgtctctgtctgtgctccagctgcacaggcatatgcagttcctacgatatgcctccctctacaccgccacagggtctttgcacatgcagattctttagcctgtggaactgcttgctctacctgctcatctcccagttgcctccctacacctggccattctcccatatccctgctttactctgttgagaaccttcatattccagcttgaacacagttttctgggaagccttacctaatcccccaggttaaaccatgttccctttataaatccccacagcatcaggattctttcctcaactgtttttaaatacagtcagcccttcgtgtctgtgggttccccatctgtggattcaaccaacagcagatcaaaaatatttgaaaaaatgaaaaagaaatgaaaaataaccattaaaaaatacaaaccaaaaactatacagtataacaacaatttgcatagcatttacattacattagttactgtaagtagtttagagataatttaaagtctatgagaggatgtgttaggttctattcaaatactaggccatgtaagggacttttgcattcttagagtttggaatccctattagcctagagcacggggtcctggaaccagtgtcccatggataccaagggacgactatatgtgtgtatttgtgtgattacttatgaataccctttcttcactagagcttgaaaacaggggtgggttttcactcatcattgttttgccagtgtctggcatatggtggttgcttggtaaatatgcgttgaataaatgctaaaaaatactgttttgtcagcctgttttcatggttttttttttttttctgattacactcatgatttacagaagaaaggttagcatttgtattaatatcttatttttttctgtatcatttttcgtaataacctatatatcagaaaatcataaagtctgcagggacagcttctgtgtccctagcttaaattattatgcccatttccttcttttagggctaagcttaaaatttatcttcactggcctttactcagtcaaggctggattgggtgtccctcccaatccaggggtggcccagcatcctgttaatgtggtcagcacccaactatttttttttcatctggctctccactgaacttaaaagtagagactgaatttagttcgatatgtttgcccattgcccagcacaatgcctggcatattagacaccagagatacttttccaaatgaatgaattaataaatgcatgtcttgcacttgtgtgatgttcctcagatatctaagtcgttcctggaaaagcattcagtaaatagttgtaattcagtgcgttcagtgtggtatgcacattcttcaaggattgtccaagttaatctactttttagtgatcttatcactggattgcagattgcacactacatacgagtatttggctgaggaggaggagaatggggcctgaaatccagcatgcactctgaccattatggtatgtctgctcctaagaaacctcatatatatatatatatatatatatatatatatatatatatatatatttttttttttttttttttttttttttttttacagcaatgctatgtgtaattgcatggtcctaaatgtaggaacaaaaatgttaaaaattttctgtttaagttctattcacattttctctcaactttgaaatgtctctattttaaaaaatgtatcgtatattggtacaataatactaatctatacaaatagaagtaatttataaatggtgaaggcgtatgttcaaaaaattttgctgatgcagtaatatgtaatcaaaacaattatagagaactttgatttaatctctaagccgagtgccatggtagtttccaaaaataatttgcagctttcttttgatctcattttgagatggctgaagaagggactaaatgatcttagggtagaaacatcctagagctcctgcacacctctgtgtgtgtgtgtgtgtgtgtgtgtgtgtgtgtgtgcatgtgtgtgcatcctgtgtgtatcaggtgttcctgcgtatgtgctgaagaggagaatggatagactatggctggactatggctgagatttgtcttcaggtttggtgcaaatccatcccaatgcagtccattttagggaaagcagatacactaatttcaagatttgttagccaattctcctttcagatgagtagtttatgatgaattctcttttccccattcattggctttctctaaattgtagatctaaaacaacctcttcatgtctgctctgcctctgggatagaaataatgaattgtaggtttctaataaaagagacacgttttgtgtctgaacatcttgattagaatcgttgcagccatttactcaacgtgtgactatttaggaaaaataatcattctgagcttcagtattttcttttgtaaaatgaaagtaatattaattaattcatagatttgttacagctacttgggaggctgaggtgagaggatcgcttgaggacaggagtttgagagtagctttctgggtgatatagtgagacctgtctcaaaagaagaagaaggagaaggagcactgagacggagaaggagaagaaggagaaacactctgacatagtactaggtagacagtgtttatggaaattttttagttttgagctttagaagtcttttttattagcaatgataaaatcacagctgtttatgtgctgtctgatgtgatggttactttaaaacacatgtattatttctctatatcaaactcgttaaaataagattatttggttagggattagctaatgtatttgtctgttttttgaagagtgacagcttcctagctttttcttttttctttattttttggtctacttgaagctgccgtatttattatatgattgagtaatgatacagtgataatgtattatatgactgagtattgatacaatgataatgactccatcccatggtctgagtaattttgcaacatgtgggtcccacaggaccgtagagcaaaaatcctttctgaatggggtatctgcgaaggcaatagagacttcactttaagtggatttctgtagtttccaaagggatgagagggagaaaaaaaagtctgtatagaaagaggggggaaaaagtctgtatggaaaggatgacttagttgacatggttaaaaggtgtgctcattgactgggaaaaagttcataagtttgcagtattaggttaaggaaggaaagtccattcaagctgttttaaagactctgagatgccagactaagaacttcattcagactttatttgataggcaggggtgatgtgattaagatcatgccctgggaagattatgactatgaattgaaagaaacagactggaagcctagagatcagttacaaaaataataccatagtccaaagtcataattcaggatgaaactgttaggaaaagaggaaggacatttaaaaagatatttgcaatgaatagctgttgtatattgtatggtgggtttgggtgaaactagactaaaatttttaacaaagcctaaataaacagcaatgagagctggttccctcagcgttttgtttgaggtactagtgattatcaagtgaagttcttaacgcgtagtaatgtgaacttaagaaaggaagagcattactattttttcagggtttagcatcaattcttagctttcttcctgaaaccatttcccatcttctactatttgaagaactagaggcatagatgtattaatgtggcctttatttttcttgtgagaataagaaggataatacacctcccatgctggaaactaccttagaaacttaggtgaagagacaggtgtcagatatattatgtgacttgcccaagattgcctggcccgtggagagagagccttcactgtggctcagggatgtgggcttcctgtgtgaaggtcctcccaagactctgtgctgcctggtctttacctggtccacggacaccaatccttttttacttttttttttttctaccatttcatggtgtttgcatttgtcaatatttaaagacacctacctgaaattcacagaactgtatatgatgcttctcatttttgtttgtttgttttttgtctttagaaagtacccacatattgtctgggtgtggtggctcatgcctgtaatcccagcagtttgggaggctgaggcaggtggatcacttgaggctaggagtttgagactagcctggccaacatgacgaaaccctgtctctactaaaattgcaaaaattagctgggcatggtggcatgtgcctgtaatcccagctacatcatgagtctgacgcacaagaattgcttgaacccaagagacagaggttgcactgagccaagatcacaccactgcactccatcctggatgacagagtgagactctgtctcaaaaaaaaaaaaaagaaagcacccacataataaaaatgttgtgctgggcactatataaagccaggtaaatatacaaaggtctcagcctccactgtgtatcatgtttcatacacggaagattatatcctgaaatcactggagtaaatgttgaagtatcagagtatcagtttctcccccataaattctccggttacacttagaaagttttttgtttagttgtgttttgtgtttagttttggctctaagaggaaggaaaggaaattcacattttgtttgtctgacacttttacgagaagttatatatggccttttaatttacacatgtaaaattaatttgtaaaagcagctatgatgtaatttatggatgaaaaagctgaagattgactagccttgttaatgaaaggtagatagccatggttggaattcatgtcttctgaggttcataaaacaggccatcttttaaattgagaagtgacatcataatagcaacatgggcaacctgaaaggcagtcaaagaaaaacaaggagggtattaaaaggtctgaatggtatatcacacgaaaatcagttgaagagacttgcactatttagaagaaagagataaaacaaaggtgctacttaatcaaaaatttttaaacagctgaggtgttatcctttcaaagaagtatcaaagactagttagctcaaaaagatgaaagtaatttgatattggaagtgactttcctttccaaggctcatgtcaagggtttggggccaggtatttggcaggacttcactgttgggaagattgcaaaagaaccttgccttaaacatttataattttaacctttctgccactgaattcattttaatagtgaatctgatacaaaataattacttataaaatagattaactggaatttctttgcttaaagcaaggatgataaagaggcccctactcttgaaagttttccggggcccctttctgatacactgtgagtacaatgattttaatttgaaaacctttgttggtaaaaatgatttccaaattccattcctgtggaaagatgctaatttaactttaatttgaacaaagtcgacttatgctaacaactcctaatttggtcatgacttttgggggaaatcttcactcaggtttgggcagtgaagttactgctaagatagctgctcaagtgaagggcagatgaccgtcagctctcttagtagtaagtcaatccaaaccaactccttcattgccaattaatccagtccctgcgtcatgcccctggaaaggtacttgggcttcctgagaagttattcatcctgataaagtgaaataaaacaaagcaaactcatagtattttcaggatttcaaggaaatatattgaaagatttttgctgtgcacaatgatttatttatttaaaaaatttaaaattgatgctctgccgaaaaggcataattgtaagggaatctataattgcagccttcatttctcttgagtactaggaaaaaaaaataagaaaggaaaaatggaaggacagatattattaaataaagtgttactagcatcacatgctcaaattaacatgttctttgccacagtgctctaaaggagatatttgcactttatctgtatgatggccagtgccatatatgaagtatattcaatccaagaaaatgtctgggagtcagaagtatgttcagacaagttttctatcatgtgttgtctaccagccttttacatactgtagatattctagaaagactaacaagctagacaaattaatttctccttttgttatgcttatgagaataaactgattaaacagttcctattctatctgtgtaaacagagacatattagttaacttactgcttattttattttcccacatacttacagtaatttcaaatgttgaaaaatgaggagagcagaatatggcattaagcaaagagaatgaaataaaaaataaagcaatgatctgaactagaaaaaaaagttttaaaaatgtaatttttcagttacacaaaagttaccatggcattacctttccttttgtgtctgttggtgatttaatttagtagttttagaaaatgtgtctattgctgtatttaaaaattctaattacagcaattggtaaagaagtttccaagtacaaggggtatttgtagagaacctgtaggactgacaagtgattgacaggtaaacaaccccactgtggccttatattccattctgtgatgttggactatagatactacataagcctcaggaagtaaccaccttccaatttttattaaatgcttggcgtcatggatgtaaacagtattgtgccttagttgactaaatgtggcactttcttttacactgccgcaccaccctgactcagtgtgatggaatatctgtgaaaagaacaaatgggaacttttctttaatgcgtttaactgaatgtatcccccgaaaagaaaagcaagtgcagatttcatcaaataaattgaaaccatctaaaagtgaatgaaagaggatagcatttctaacttcaaatgttctgtttatgacttactagtgccagtgtgaaattgccctttcttctctgctaatgcaaaggctgacaggtcagcatgcacacacacattatgttatgcgcaatcggaagctcttgagcttgtccttgaacatgctttacagttaatatatcttgattttcaaagtgccattttttcccgttttgaacccagactttcttttccttgcttccttacaaatagtttccttaattcgtatgcatttcttactgtacttcttggtactcatttcttttttgaaaaatctttataatagcctgctttaataaaatattttaaaatagttaataaaattggatgaatgctgtcatcaactgtgattctttaagaaatagttcgtatgtttactaataaattcaaaattaatggatttgcctgatgtgaaactttgttttcctgaattttaaaatgtggaagcaagtcttctttttgtaaccatttcatatttttaagatgttctaatgattgcctcagagtctagaggaaaaatattctgagggttttccccccttccacttgaatgctaagaacttggatgttttgaatgagctattcgccagcagatgaaaagtcattccagataaatgagaaaccaagtacagtaaaatctgtgttttctaaccagcaaaatctggaaaatcgtaattttttgattccccaggcaaaaatgtcaatctaataaataggctaactgaaatagggtagggtgactgtggtgaaatttaagttgttaagagatgcaatatgtattcttattgctaattttaaaaaaaatctcatgggtttttgtgagcaaaaatgatatatttgtgtaaatcatggcattttccttccttttctagaccatgaggaaaaacaaataggaggtaaaaagaggagatcaacacatgaattaactctgagttatctgtaacggataccctgtcttcataatgtatctcataaaagttttaataccagtgtatttcaaaggtttgcaagttatttagtacttggaacatgttttcccatagaaacaatgttgtaaatattggttcagttcccaggccagtgcacacagcctatttaatccatatgtatctaagagacagtaccaatgtttgcttgagtactggatcctaaaggcatatgtgcagaaaagagcatagtaatcggtatcttctgttagttttttttttttttttcctttttgagacagaatttccctcttgctgcccgggctggagtgcaatggcgtaatctcggctcactgcaacctccacctcccggattcaagccattctcctgcctcagcctcctgagtagctgggattacaggcatgtgccaccatgcccggctaatttttgtatttttagtagagacggggtttctccttgttggtcaggctggtcttgaactcccgacctcaggtgatctgcctgccttggcctcccaaaatgctgggattacagacgtgagccactgcacccggccctattttctgttaattttatggaaaggaaatggtcttataggaatttccagaaggcactaattttgatatttgtccttttcttttgtgcctcttattcaaaagtcaccagagttctcttgtggacctgtgggaacagcaggacccagagtttactatataacctgctctttaaaggaaaaacaatctccttcaagggattcctgtaggttggggcattttggcccctttattgctctggacttgttgataaagcttattaacctcagtgttctaaatggtacagttaaaatgatttactaagcccaagaaacacaatgaggatatgacagaaacatcttgatatgttgctggaggtttaagaaagtcttgttgcttagttgtgacttttaatttatttctttgttttccccttcacaatgtcttatttcaataaaaactttatagtttttcacagtagctctcatagtgatggtggcagagcctttgctgagctgaggcaatatcagagaggttgatagtaagctctttgtttggaaattggggattgtaatttattgcattatttttaataaatgaaaaattaccattattcatagttgtaatttgacatttatctgtcattaatttttgcaatatgtttttgtatattgcaaaaatgcaatttgacaatgtaatttgacatttatctcagactgtatgactttttacaatatgttttccccaatattttatatatataagcaagcagggcctgtatgattttctttgctcttgccacaccagttgtattcaagccaaagacaatccacccagtgggtgatttataacatagctattttttaaagagatataaagcactgtattgctttatcagtaagaatatacagacttttaaaaaacattatttctaatatatttatatatcaacaaggatcaaaacaaattttgttactggaactttatcacaaaccatgtttttagtgaagaaatagctattatactttcttgtacagttcgttcaaaggaggacatgtgttttgtcaacgaggaaagaaatcaatgctatttgtgatattatatacctcatttgaatattttatctatttcaataaattgaaaatgagttcctactttcttttccatatgctgattttcatgatttctttttctatagagaaaaatatagctgagcagatttttaaatgcagcattggcagtgttacaggtctttaattttgttggcattgttcattttgcctttttttgttttttttttttagttttgtgatgtgaggtgatgtgatggtcaaaaatgtggactttttaaggcccgacagggggagccaattccatattctattgagatttcctggcattattgcagttgtccatttgtcacggccaaaatactttctttagccttggctgtccatagggctccgtaacagatactctttgctaaaaataatacagtattttatattaattacctttcagtcattaatattgaaattattaatctattgagataatgcctaggaaactgaaatagggtcattattttaaaatgtatgatatcatcattcaaggtaaagttaatcttataaatataaccttttcacaataaagatcaatgtagaatatatggaacattttaatgctcataaaaattctttagtataatattttatggttagattaataaacatgggaccatctcttctcagatttttaagcaaatcaaatttataaaataattaaaatcacatgactctattatatgacttttttaaaaccacataccttactttaaaaaaagtaaagatcctaaactaagttcaaggtctaccacaatgaatcatttaggatggtattgaattcccataattgtttggttctgtgttttgttctcagtaaagaaagtggaatggttttatttatttgaattatatagggtatatcttatcaaaagacattctaagattacaaaaacattcaatgtgatacatttatcttgacaaggaacatggaattatatgtgcaagaacattcatttgttttcatagtttagaatatataaaattttataatttctgtgcatttatcactttgtaagccttaattccctagttagctacgtatctatatatcctaagatataatatatgatgagtgcattttagttgtctcgcacatgtagacacgtgcagacatgcacacacacacacacacaaatatagacatcctctttgtttttatttcctgtatattcactaacatgataatggacatatattatgtgataaattatattgtgtgttaaataactaccatagattacctattttaaatttcaagagcaataaatctctgttgctaaaatcaagcactaggcttttatggaactcttcctattttttaaaaaacttaactttgtttctgctagagcttcgtttgagtatgattatgctatcaggagcctaaaatgcaatagcatttaatgaatttttggtttgattttgaaaaaaaaatggatatggtatacatcgttttctaattttaaaaagtaatctcattagcctttgtgttaccttaacatatagtacagattttgccttatgctaaagacttcatgcaagttggataaatgaatgaatgaatgagcaactctttaaaggctatgctctcttgaacagtgtatctacctgttttctcatatattcaatgagatgctaattatttgctttgttcatatggttgatagggaaatcaaataagatattgaagagctttaaaaattagaaaattttaaattttaaatttatgaacaatgataacactacatttttataattcaaaatgctggctatttgggatacatctttatttttatcttaaagagataagcatgttactggctatttgaaactttctgtatgagaatgtctcttttttgcaatgctgcagtgaatcatgcttgtaagaatggccaaatagacctatgtttgctaacgttagattcttgttatacccaattacccttttgttcttcatgccattctgaatgtcattttgcaccaatggccaggcattaacggggcatactaactctattgtacctgccacttatgcagtattagtttcagactccctacttttaattgaagagctatgtagttaaattatcatgtcatgaattccaattcactagaagagctaaggaagaaaatgctattgaaagctttcccaagtaacatttcttttaaattgacaagtctttagactaatgagatattagtagaggaggatgtattttcatttgtaaataaaattgagattaaaaaatgttaaagagaaccattttagaataatcctctctctcctgagaaaagttgtcttgacaacagtaccatttataattagaaatgatgaatattttatttctcgaaggaaaattctccctaactatgctagacagtgatcgggctaaatgttcatcaggctcaatcattttttggtgcaaaaatatactgtcgattttttggctcagtaataatcaagccttgccttgtagtttataaggactgggttttcctatgcatttcttaatagtaatctgtgaaattaagaaaaagagatcttattgacctaattttacagaaagagtatgtatctaataagtgacaaaaatagaactagagaaacgaagattaatttttttgcttttcatcattttgccaaaggggcagaaacacatgacacatttcagagttgtgctttcactcatgttcgaatctattcttttatatcatggaatttgtatttctttcaatttaaaatattttattttctttgcctattataagtgaagaattggcttaaacttaagatatctgatatagatttcagtctttctctagtgttcatgaaaataaagccatttaaacaaatggctattcaaattaaaagatgtgatggaaacttcatcttgtgtcatcatttattccatcagttatccagtgtctgctacatgccaggcaatgggggagggacaagttaaataaatcataatgtctatgggggggatggaaggacacatctagaaagcagtgaccagccttcagagtattgaaattgaaatggctgcatgatgtcagaggctagagcattcactttgagataaagcgttcatgaggactgtgggaggagatggcacttgaggtgtgtcatgaaaaagggggatatatttaaggagggaggttaaggagagggtgtaacatccaccagaggaaatgactgtgcaatccagtgaccaagagaggagagtaatcgattggaggatgcattggaatgttaaatggggcttgattctagaaggccttggtgcaattctaaagcaaacgtttatcatccaatcaaatctattaccttgaactcagtggtttagtgaattacacagttgtttgtatctgattgtatatgacgtggaactttcatgatataaatttaccttctgtcttcacttttatgacttcgttaaaatccattcactgatgaaatcttatcccattatctacattaaatcttatcccattatctacattaaatcttatcccattgtctacattacacttaaagtttaagacatattttattattaattcaaataatatacttttgaaacctttattatctatatctgtgatgacctcaaagttcaagtagtgttacatggaaaatgttagttttatactgtgcaagacttactttaatacaggttcactctttggattctgtttgtaaaagagtagaatttaattcaagatttcctgtggctggctggatttagagagccactctcagtacccttacaagccaggcactttgcagatacaaggctttgaaacaaagactgaaacaaagtgcagtggctctttatatttatattttacttgttttattgttttcattgaggaggaatttatttattagcttccatttatcattagaacacatttcattttagagaagctctgaggtcttaaagctaatatggaattacagttactttttttttttattttgaagatcatatatgaaagacagtacatttcatagaaatgaaagacagatgcctcttcctctctttctttcttttcctcctttgtaccaacctctgtgttaatagaaaatgccttgtggtgtggccatgagcatggtggtcttgaggagcccacgctccactgaatggataaacaaacaacagtgacacagcatcaggcttaagtcagaggtaggatcaccgtctgtgtagacatatgtatgtggtttcttctttctgtctatgtgggtgcctcatagcagagtgtacgtgaatgtggttcttaaataaaattatatgcactgggagcttaggactgaggaagaatattccagctagatggaatggcaaaaataaagacatagaactacaaaggtgagtaggtggtaagttcaagggaaatgataggagatgaaccttggaaggctggtctatgccacactacatgaggtgataactgagtttgaatcacacctgctaggctgggaacagcatggaaaatatttaagcaatgttgagacatgttgaaatctgtaaaatagaaacataattaccattttgagggtgggtttgagggcctagaggcttatgtgattttctcctgcagagttttagctatgatagcagaggaggtgttttctgcagtatctcttgtgtcacaaaaagttcctaccagtgtatattattgtaaactactcaatacacatttgttcattggatgaatgatgctacttatccccctactcttaattaaaagctcaactagataacttttttaaaagaaaagaaaacgaaagaaaggaaggaaaaaataaggtaagagagaactaaaaattggactataaggcagtggaaataggtaatacagagtgtatttgcagaactcaaagatacatggttgtgaaggaaggagaggagttgtaatagactattactttgactccagtgaaacacacctctcaattttcatgcccttgtgtagtgcctttccttgaatctgagcttggccatgtgacaagcgttggccaatgagacattagcaagtgagatgcaagcagaggcttgacaaatgcttacatgttagagatggtcttcttgcttggaatacttgtggttagagtgcaccatcttggaacagctgccttgctgttaggaagcccgagaagtgatacaaagagatgcacatgaaggaaaatggagatgcagagcttacattcccatctgtgctcccagccagtcccagcgctcaggccattttgtaacttccaaccatcccctcacccccaccataccatacaaaacgcaaaaactgcccactcacaccacagaattttaagagagcgtgattggtggttgttgttttaagttgctacactttagggtagtctgttaacatagcaaagtataacttcaaaatgaatggagaatggttttaatatatgcaggttaattacttggtggattgtgataccttcatttatcttagctcaaagtacaagataagtagttttgttgctagtacactagactgtgaattcttcgaagaatgaatctatatttttactgcattttggcaaataggtattcgaaaatgtttgctgaatgtaatattgaaagcaagccatgctcatgatgctatgccatttagctgctgctaaactggtaactctccatgtggctctgctttttatttttgcttttggttatcatgtacccctgtgacccaacatacagaatggtaacaggaggtgtaaatacacacacaccccacacagacatatatacaccaaaaaaagaacagaaaataaatgtttgatgaaatggagacggctagatcacaacacgtgggaaaaattaaggtctatgtcacctgtgaaaaaactgaaattaatgaacaaatttctgtaacataagtcagacattctttctattaaatttaagctaatttatataaaacaccatgtatgggaaccccctattcaaacacacagcttgtatacttgggtaagaaaatgtgggttaccattagaatgaaaggcaaatgatgtatttggagattagttattacttccttgtaaaaatgtgtaattaagcaatcctgaccgggcatggtggctcatgcctataatcccagcattttgggaggccgaggtgggcagatcacttgagatcaggagttcgagaccagcctgaccaacatggtgaaaccccatctccactaaaaatacaaaaattagccgggcatggtggcgctcaactgtaatcccagctacttgggaggccgaggcaggagaattgcttgaacctgggaggcagaggttgcagtgagccgagataatgccactgcactctggcctgggtgacagagtgagactgtctcaaaataataataataataataataataataataataataataataataataatcctaaagaagttatggtgcccacataggttagcgttaagtgtatgttagattttcaaagctgtaagttactcctatgaagttatgcataattcttacatcttcattgcttccaatttggtcaagaaagaaaccctagaatcttgatccttctggaagaaaagggagaaaacaggtaaagtggtaaaattggttagtgaaagataatgaaagcctttaagaaaaattctgaaactgaaagcagcagggggcagtagaacattttgagtatggaacacggggagaaaggggactggtcagtggagaaggatgctggcatctctgaagaaatgttttagttttatttttaaatacacaagactatcttttgatcattacgtttcctgttttcatgatcctgcaagctagggatagtcacctgtggtcaatattaatatcaaatgaaacctgtccatttagaaaagtagcttatgctcctttcccaacatcagtatgtagaatgtgcccctatgcataatatatagcaatttatattttaattctcttttcttcttttgtataatttggcttgaaaatcctaaaatgtagggtagagggactcaaattaggaagcttgagaattacaagccaggtaatccattgagtattaatttttcaatagatttatttcccgcgatttgagatccttatcccactgcattttcgtgtgctttttttgttttgttttgttttatcaagtcaaaacaaaccagtttttattcatggagaaatcttgcctctgtgcctttgcctggactgtacttttacttaggatttcctttcttgtatatccatgactccaagttataatcagttcttcaaaacttatttcagattccagattattggtgaccacttctggtatttccccaaccaaagaaagctgaatccttgcttgcattctccatagcagtatccatgcacttaattatagtacttaattttctatcttaaaaaaatatatataaataaaatttgtatttttcttataggattgtcaacttcttgagtgcagaaattcatttctctgatatacacagcatctactacagtttctttcctccattcccttcctttttacctaccttccttccttccttccttcattccatgcctccatccctccacccgctctatttctttccctccctccctcccttcccttccctcccttcctccctccctccctccctccctccctccttccttccttccttccttccttccttccttctttccctgactccctctctccaccccctctatttcttttccttccttccttccttccttccttccttccttccttccttccttccttaaactaagggtctccttgtcacccaggcaggagtgcagtggcgccatcatagctcactgctgccttgaattcctggactcaagccatcctcctgcctcagcctcccacgtggctgacactgcaggagcacaccaccacactcggataaattcttaattttttttcatagaggcaggatctcactttgcagtccaggcttgtctcaaactcctgacttcaagtccctccttggcctgctaaagtattgggattataggcatgagccactgggttcagccagtttcttattcttgttagacatttgattaatacttgttcaatctatatatgcagttactctttttgaatcttacctatgctgcattaagacattcaagacaatggggtgaaaggacaggaaactagtatttagtaagtgcttaagtgtataccagggactctaattctttgcatctgttcttttaaaatcctattagcaactgtttaaaataggtaatattatgtccatgcatttaaggacatgaatctcacaggcagtaacttgcccaagctcacatggatagtgtgaggcagaactgggatttgagacccactgcctgtcccctgaccacctccaaagcccatgtcgttttcacaacacagcagctattatctatttggtgctacacattgctttaggaactgctgattctacattgaataaaatactctactgtctttgaaagactcacatgccagcaaggaggagattaattattatgatttttagtgataagtgctttaaaaatgtcctatggctaccaggccagggaccattacctgtgcctggcaagagacacgcttcatggagaggtgtagcttggacttgggaagtgatggggccttgagggattagcagttcaccaggtagagatgctagaaaggccaaggaaggagtctaccattcagaaacgggatgtcatagctcacttgatcagctcattggctgggaatttgtgtacatggtaaaacgagtggaaaatgccatcacctcattatggaatctctggagtgctccaaagtgccaataggtaacctgatgtattaaatcacatgacaacagaggtttatagtatatagattagatatcagagaagtgatttatactgcagtggtaaggtcagacagaaaatataggaggggaaacaacgtggtatagaaagcatgagctttgaagtcaaatacatgaagctttgaatctcagctcttgacacttttcagctacatgaccttgaaaagtaatccagttgctttgagtatcagtcactgcctctgtaaaatggggatattagctacttcaaagactcttggtgggattagagaaggaatggaatacttaatagaaggtaggtatttagtaaacagaggcttatatatacccttaatttttgtacatatgggtatacttataaaaatgttggtaaagcaatgctgtttcaaagatcctattttaaatatatcaatatatgaagtaatgtcaagtttctagttgtacatatgtacatacaaacaaacatatatttacctttattctaatttagtgacattctgatgctaaaaggacatggaaagttcacatgcttttcattttcttatacttacttgtatgaaaaagactatgtcattcttcattgagtcttattttggaggtttcgagaataagtttaattttatgccattcctaaggtattttaggattctgtcatcagattcatcattattatcataattaattcaaaattataaatgatatgattctccttgtttgtaaaccagtttccttgggttttagatatggtcaatttaacaatgatactgttcctgttgttgaaataacgtttgccaaaagttatattctagatattcttaaattaaaagagtaatattcttattgcaataaagttatttttatgtatttcacaaacaactttattgaatattgaaagtttttaaataagaacaccaattatagcattctttgcactaaaatcctctagaggctcagatttttacttttagttttagaataaagcagtgaaacctctttctgcttttaacagatctttttttttctttatccactctcttttcttcttttatagcatcccttttcaccaattattttcatttctcttatttttttaacttacaactttttattagagcttttcctctgtcttcaaatatgcttaaaattcttctgtcctcaaaaaataaaaataaaaaagaagcaacaaataaaatcctctttacttgtgtaagatcctatttctctcctctctctagctagacatcttgatatacttaatttgctatatctaatacctgatctttaaattaattgattaaaaatctactgtgataacctcagtgtcctttactgtactactaaagctccttctactaacaatctttggtgaccttctagtctttctttctttttttttttttttttttgagatggagtcttgctctttcacccaggctggagtgcagtggcgttatctcggctcactgcaagctccgcctcccgggttcatgccattctcctgcctcagcctcccgagtagctgggactacaggcgcccaccaccacgcctggctaattttttgtatttttttagtagagacggggcttcaccatgttagccaggatgatctggatctcctgacctcgtgatctgcccgcctcggcctccccaagtgctgggattacaggcgtgagccaccgcgtccggcccctctagtctcttatcagatctggtggttctatcttcatcagctactttgcacaaaatttaccaccatctccttctcatacatcactatttcctcaaatttctttcttactcttttttaatgtttctcattgtacacatgctttctggacattcttgctaattttcaggtttttaacttccaccacgagctgccaacactagagtttatatctctgtctctttttactatctgtacaaacctggatgaaacattagcaactcaaatttagtcagcaaaaaaacaattatctttctctatgcaatcttctctttcatcctgccaagacttcgttccttctgtatttctttgcagttcatagcaccatcataacccgagtttcctagggcaccaacctggatatcacactgagacttttctcttatccccacattcagtaagccttcatccctgacaactttccctcttaagtatctcttcttctcctgtcctgttcagcatcgtcccagatttgccttctctagattattacattggtactaaatggacttgctggctagaggtatgtatgcttcctttcagtgactttgccccaattgctgcagagtgctctatcctaaacccacgcccctgcaggtctttattctggaagctctttcatattatttggtctcattctgtaactgaatttcaagtaagtttccactcataaatctttaaatgaagggaatgtggctattattatctgtgttctgagagagtttatcacagtataggtaatccataaatccttatggatgaactgaactcaattttttaaattagttaattaatttattttcagagacaggctcttattctcttgcccaggctggagtgtagtggtgcaatcatagctcattatagctgtaaactcttgggctcaagtgatcctcctgcctcagccttcctagtagctggattacaagttcatgtcaccacactcagcaaattatttttttaattttttgttgaaatggatgtcttactattttgcccaagctggtctcaaactcttgcccttatgcaattctcccaccttggcctcccaaagcactggaattttaggcgtgggccatggtgccaggcctgaactcaatattttataccaaaataattttgatttaaaaaacgtatgtgtgggaaaagttgggagcaattagaaaacagttttaaactttgtatctaattttaaaaccatgctcttaaaataagattatccctcaaatatttgtgttcacaggtaaatattttagcaataacttttgaaaaatgtgatgaaataatgttgaatttctttacatttttgtgttcgaaagtcagtgttataaatgaaaaatcacataatcgatgtaacaagttattataggatttgctacacagtagatggtaattctgatttttatttaatatagattgttatggaaatctttataaaattttgctacaaaaatgtttacatatgtgaccttactggaagtgaatagtactactttggtttaaaagtttgttcttaagaataagaacattttagagttatagaaaatagtccagtcaatgataatagctgtgtgtaactattctaattgagaatggatcattctttatggaagatttggtaaattatacagaatattgagcctttattgtttgtaaaattaatttaattttgtttgaaatatactctattaagccactataaatgtgtatccaataagctatctgaattagtattcagatgaaaatatattgaatttctcagggctttcaatatcagttctatttccgtgagcattttagctttctaatacaagaaatgcaatttgaattgtttactgctgtaagccactggttattttcagacataatggaataatggtgtttagccacaatgtggtattttctaaaagcacttgaaatatttcatgagtaagattagctaaagaatttagtcttgttttttatgaccatgatagtttatgtctgcaacctgagaagtttttattttcagaacagtttctcaagagttttattttaaagaaaatgaaactttttcttataagatcagatatcaggtttccactaactgtgttaaatatttcgctttaagttacagtatggaaaatttgagttactcaaccaactcaactaacttaggcattttattgtgaaccaagaggagaggagtgtgagataattataatcaaaaactaccataaatacatgatgtgattgtaaatttattctttagtgaaatactgagaacagattattttagattatcatttttaatttatgttcacaaaacattttaatgaataattcatattgataaagtgttatatattttgtagttataagtaaaattaaaatatatattaaagaaaacatatggctgggtgcagtggctcatgcctgtaatcccagcactttgggaggctgaggcaggcagatcgtgaggtcagaagatcgagaccatcctggccaacatggtgaaaccccatatctactaaaaatacaaaaaaattagcgggtttgttggcgcgcatctgtagtcccagctacttgggaggctgaggcagggaaatggcttgaacctgggagatggaggttgcagtgagctgagattgtgccattgcatttcagcctggcgatagagtgagactttgtctcaaaaaaaaaaaaaaaaaaaaaagaaagaaaagaaaacatattttagagtagggcttttaattgatattttagtccttctttaaatggcaaatataaaatagattttcttgctcttattattttatcctaaagtgattttcatggaattttgtctataagaaattgaaataaattttatgctgtataattatgtcagaatttgacacaataaagatatttttcagttctatgattgggttaactgtttctaggcttgagggagaattttgcttgtaaaccgtattaatttggtagatcgcattctactgtagtcttgtcacatttgttgactttctgtaaaaagtggctgtattagtctgtttctgcattgctataaagaaatacctgagacttggtaatttataaaagaaaagaggtttaattggctcagagttctgcaagctgtaacagaagtatggcactaacatctgatggcttttggtgaggcctcaggaagcttacagtcataacagaaggcaaagctggagcaggcacatcacgtggtaagagcaggaggaagagagagggaggcagatgccgtatgtttttaaacagccagctctcatgagaagtcagagccagaatccactcatcaccaaggggatggtgccaagccattcatgagggacccacccctgtcatcaagtcagctcccactaggtcccacctcccacactggaggtcacatttcaatgtgagatttggaggcagccaacatccagaccacatgagtggctttctgattactttctgccttctttttttcttttttagtatatccactttactgtttgtatgtgttaaagcggtggtccccaacctttttggcaccagggactggtttttggaagacagtttttctatggaatgggtgggggattgttttgggatgaaactgttctgcgctagattctcataaggagtgtgcaacctagatccctcgcaagcacagttggcaaaagggtttgtcctcctatgacgatcttacgcggctgctgatctgaacacgaggtggcgctcaggcggcaatgctcacttgcctgctgctcacctcctcctgggcaacccgctcctcacaggccatggatcagcactggtccaggcccaggggttggggacccctgtgttaaagtcatgttcttatagctatttttaaggttacaaagataaatatttttcatctcttatgactgcaaattgtatatcatagttagattgtttctcaatccaggagcaattaaatttgtacattaggtaataagcatttttctgccaaccccatattaagaatacatggtaataaaacaggatgacacagagtaaagtacctgtttctggtgtcagaaacaactgacatattccagctctctattttttgcctgtgttatcttgggcaactttctgagttttaattttcttatctgtgaaatataaacaattaatgaaacgagataatgttaagatctgataaggattagaaacaccaaatgatagcaaagtatgaacaaccttctttcccgcttgggaaacaggtatttcacagttttagaggtttatgtatatatacacatacacacacttactcaacggtttgatatattgagtaaatgtatctgtagctatttactgagttcctgattgccaggctctgttctaggtttctgagatacatgacttaataaaacaaaacctctgtccttgtcgagcttagtattttagaaagtgaatattgtgggttttcctttcatgtcattaatatttattttaaagcattctagcagtattggctgtctatattcttggctcacaatatattcatattcccatgaactaatgggaagaagaaaaaaataggacaggataaaagttagttgtttttcatatgaaaagaggtcttatgactttatttaaaaagacaaacaatataagggaaattgaaaaaatgatgttaacaggtaattcacaaagaactgcagatggtcaataaattcatggaaagctgcccaaacttactagtaattagggaaataataaaagcaaataaaaccatggatactcttttttcctgcataaaattagcagaagggaaaaatgttaataatgcctagtgttgttaaaggtgtggggaatataagcacatttctacacagggatatgaattgtaacttttttggaaagcaatctgtattacctgtaataaaataattaattattataattaaaaattataaacatgtgatcatacccaaggttctgcatttttagtcatctatcttagagagatcaaagtaccaatatataaaagtgtgtcttcaatactgtgtatattattatttgaaatgacaaaaagctaggaataaaaccttagagtttctcaataaagagacatttcaagacaaaagtaccaatatatgaagttttgcccagaaggcataatgttttcatccatgcttgtgagaacaaggactgcaaaacgtcatgaatattcaaccacaacagagtagttcaacaaattgtgatgaactcaaagtacacagcattaggtagatatttcaaagataaactagagttgttaccattgacgtagatgatagatatctgtgatatcttaagtgagaaaagcaagtaggcttgtgatgtgcttgttataatccatttggttttaaatttgaagatactttatgaacatagagaaagaaggggaagaatgtgtatcaaattgtaaatatttatcacttcaatgtggaggttgttgaagggagaagggaaggaacacttgactttcttctgtctgatttatttattttctcattgataaaattatcagaaaggaaaaaacataagaaagttaaaatttcaagctgttaaaaatgttctatttagggtagcattggcatatgtcttacactaaagacagtacagagttctgctggaactctttacattaggtagtagatgtttagtaaatatttcagtcactcattaattgaaatatattgagaattctatagccatgggcttttaatacatacacacacataatctatgatacatttattgtgtattctatgtacttattacatattaattcatatttatgatattttgagggccattacatccacggtacctttatctatacatgattttcctacttactttgcagttttattttcttggtagtgatagtgagccaggcagggatagtaatactccacaataaagtcacctccctctggcctcctcccagattccaaaaatgtgagctaggcaaaacataaagaactttatgcattcattcactgcgttattctaaggtttattgcttgctaagtcttgtgggaggaaaaaatatttattctaagagatttattcaaaggtcttttacctacaaggagtttacacttctgcaggttataaacatgtcaacaattctttggcacttaatttttattcttcagcctagattaaggtttttttacatacttatcaactactacacaaaaatcaaaacccctccattcttaacttttaaatacgtcctcagtaaaggagacaagaccagaaattatttcacagaagatatttacaaaaattatagccaagacataggagacaatttagatatgctacactataaaaatggctaccatgggtattttgcttgttggatcccagtatatttggtctttattttagtttaacaggtctcacataaagtcatctactaaaaacacttccattctttaagtccagaattctaagtagaaaaagaaagcattctgattgattcacagaaatctctgtgaaagtattgccttttattatatttatatataaatatgttttatatatttgtagtgtatctatatactcatatgtgagaaatatgataccagaaaagctactatgaattattttacctatacattagttgttggtatattatgcatttttaatttgtgagtatatttgggtagcattattatattcctggcagggcttgagctttttttttttttttaatctccagggattcttcctattttctaattcagttcgttgttcttggtttattgtgaacaaggaaagcaaataatcaagctggctgaattatgtttaaaataagtatgaataaacccagaaggaggacctgcagtattctatgtgtaaaacacatgggattagtgggaaaaaaatgtgtgaaatattttgactgtttgaaagattaaaaaaaaaaaagtatcgtttggtttacttactagttcacagccacgttttgaagagttaaagttgtcagatggtttgcttctggatgcatgacatacataggagagtaatatctccttgagtttattaacatgctacaattcatgagactttttccccacatacctgtttgttacgcagtattaatgatgacatggtatatttacatttaatttatatagacaaaaatgcttcattgttgaactcatatttgttaaaatgaaaggaaagaaaaaaaaacaaaactgagacttcaatttcatgtattttaaggtaccaaagcattcaatctttaagtaataagaattacagtaagaccctacagcatagcaaattccacaggcagtttattgaaatacattcaattatctgaaacttctgtagtccttagaaggcactgtgagaatcagaggtgcattagctgcagtttcagtcagacctgagtttgaatcattgctcttttattaggttctctaaaatgagttatctaaggctgaacctcagattctatgtctgtaaaatgggatttaagtactgtacttctaagtttgttatgaggaataaatgatccttgtcaagtacctctagcctaggcctagggcttgttcctgtcagtaactggtggtttcgtgcttagttatcatatgccaaaattgtgtgtaatgagttactactacaaaggccaaagcttgaccctggctgtaagaatgcatttttcaaaatcattaaaaaaaattctcattagaggataaaagaacaaatactgagagaatcctaaagaatctacgtcttcttgttgtgactgattctcaagcaaaggaaaaggaattttaaataaaggatttctgttggatttctagccttatagaagaaacattttccaaaatgctgatatgttttaatttaatgatgtgctatttggggtccattttttgtacattcatcatgattctaaaactgagtttggatgaaaagcatgtagtgcttgccttgttcttacatcagaagaattttttcttttgtccattttatgcttgtttccaaaggcttaaaatgaaagctttgtttctgcaataatggcttagtgtaggcttacattgttgatcccctcagtagatgcaatgtaatccactttggtaatgtgaatttttaaacaatcatcggcctctgccattaacccttctctgctaatgataatactctacaaaaactacaaagaagctcgggcctagcttaacattagacttggagcgcacttagctgaatttgcatttcttattttagcagcagtgaattgctgagcatatgttgaacttcatcaataccaaaagtagaataggtgattgtgaaactaatgttcaagtgcaagcattcaaacacaaacacgggaaactagaagaaaataatgatgaaacgaattaaaagtgctttccagtccaaaattccccttgaaggggcttcggctgctgttgctttttgcaatattttttaacttgacctgttgctttgcctagttcattgtagtgcaaatgtctcaaataaagctgtacatgagtcatttttttttccttctcagttcaggctacttggataatagctcactttgaacacaagcatgggaacctattgaatgtttcctgcataaagcctacagagctttgctcagtaacttgacatgtttctttaggagagagaaatggtaaattagctaagagtgattttattccatgacttatttccgaactaactttgagaacacatttccacttagtgtttggattccactctggggacttagaactaaggcttcttacgtatggttaagtaatatatatggtggacgactaagttaagatgttccttagagacttatagacatttaaagctttacctaaagtagagaggactttactgcaactcctattgaagctgcagtactgtatgccttcagggctgtggatttaataaacaaaagatctgtcaccaagcttggttcacagtagggggtagatgtaattatatactttaaaggggaaaagactgttgttattattttacatttattgagtgccaacattttgcaatgtgctgtacctaacatagaattagatacagtccttgcccagtggactatctatttaaattagacacaatctaaatatttctcttaagtagttcctgtgttttcaaatttgttacccagtgcattgtatgagtgtacaaaagtattattgtacttgcaaatgttatttaaaagtataaagacttttaaagacaggtggtgaaataagatgtgattattagactataaaatcgcccatgtttttcaggtctcttcctttaacaattattataaaactaaatttgaaatgaaaagcaggaaaaatattaaatttagaaaatgatggatgcatcatattgatttttactttgaaaaaaatggcagtgtaacaataatagcacttgtttcttgcttaactaggtttggaattatatttatttgtgtggcttttaagtaattccagtatggaattccacaagggtcaagatcacattttctagaagagtacattgcacctaataggcattcagtaaaaactgttaaaggaatgaatgaaatgagtttgcaaatatatttccatcttagttatcgttttctcaggactcttctgattttagagtcagaggaggcagtgctggactggctttgggccagcactaaaaaacaaaacaaaaaaaaaacaaaaaccataacatccccaaaccaaaacaccttcctgggagtatctttgaatagccctggtttggaatgcattctttctaataaagatgtttcttgtctctcagcaagaaaaagcatgactacccagcagatctccgacgcccgtgagagtccttagagctgtcctgatcctcatcagtgatcaaaggatcttttcacactggattcctggtttccagggatgtagtcactgtacagtgtagtcagtttactggtctggtgtgtagtcacacacaattcttaccatctctattataagtcaggctgatattaggggaaaatctacagataaacatgaagaagaatctataagttggtatatttatgtatgtgtcctggatattgtgactattttataccaactgctatattcccagccccaacattctcattcagtttcttcttggtcttaacagcgcacgtcagttcccagttgcatgactatagctattcatttagcagacagaaacaaggatccttggtgtcatggtggaatcactcagctttcagtttgactctctggactcccatttacactgtgttatctaagttattcaacttattctgagccccagcctccttagatgtaaaatgcaggaaacaattgtactgaacttgtcttctgtttgcttatcacatactcactgttctccctgcctcttgtctaagattgtgttccagaaatgcatttgtcatgttctcgtcactgaatctgatagtctcttcagccacttccctttccttatccccactactccctttactcatccctgttttgtcacttaatggaaggattttcctggacagttttaagctcctttcactctcccctcctccttcactaatatcacaaaggggttaagtgttaactattacatttttgtacaggatgtacagatctgcatagcccactccaacttctatctcaagctttacgcctttcatctccaactctgtgctagaaaggttcatccttctgtttttgagacaactccatcaaacacataaaagctaaatttaggccaggtgcagtggcccatgcctgtaatcccagcactttgggaggttgaggcaagcagatcacttgaggccaggaattcaagaccagcctggccaacgtggtgaaatcctgtctctgctaaaaattagccagatgtggtggtgtgcacctgtaatccagctacttgaaagggaggcggaggttgtagtgagactagattgcgccactgcactgtagcctgggcgacagagcaagactctgtctcaaaaaacaaaacaaaacaaaacaaaaaaaactaaagctaaatttaccagctctcctccaaaccaatgtcttctcttgcttttgctgtttctgttaatgatcccaaatttctccaaagaagcccaggctacacatcactcagtcattggatagtcaattgccaaaattctgcagattttcccaccacactatctttcgtatttgccacttctcttgtttcctctgtggctggccctcactaacgcttggctcccctgctagcaggaaaatcttcaggggctacaccatttctaagtcttaagtaaaaataggagtatatgagtaaagaaggagccataaaattcaagctggtgtgtaggaccccagtgactagcttctgacccagtggccaagagacctaaacacataaaggtcacttcctgactctagagctcaatgaggctgcagaaatgagatgcctttctgagagaatccaggagaagtactgtgtaatactggttcactgcattggaaccatgcgggaaaattcataaagcatgaaatgcgtgggagcaaatgcctctttgtgttcctagttagtgccactttacgttagaccttaccgcctcatgcccagattttttctattagtcactttcattttgcattctctctccctacaaattatctgccagaatcatttttattcaaatctgattcctaaactcatgtttaaactttatcagtggcttgatccatctgaagggacagtggttctcaagtgtggctttgggaccggtagtgtgaacatcatctgggaattgttagaaatgcagactctctggcccagaccagatctgctaaataagaatctggaggggtggggtcctccagttaattctgaggcactaacaactcgttgaaagccagtgctttagctaagatagttataaacatagctgggctttcagcatcctactcagtacaggccagccagattccagacttgtatttcctgctttcctctatcaccagaacctccatttcatatgtgaacctccaaatctcagacaggtttcagtcaatttaagaagtgtattttgccaaagttaactacatgcacccatgacacaacttcaggagattctgatgacatgtgcccaaggtggttggagcacagcttggctttagacattttagggagacatgagacatcagtcaacacatgtaagatgaacattgattcggtccagaaacgcaggacaacttgaagtagaagagggacaactcgaagtggggaggggtcatcaaggtcataggtagataagagacaaatggttgtcttgaggcccccaaatttattttcctttcactcataatttagccctttgtgaatgcaggctcctctgtgcttatcaggtttttcataattttgagtttttttcttttgcttctttagtccagccattttttcaagtctgtgtttatgcctcacttccatgaatctcttctgaagtgaaatcctatagtatttatacaatagcaatactatttaagagtggtcatgcattattccctttgatcattatactttatgtcttatgccccaaaataagctctagggaaagaaagtcagtgtctctgccccattttaattccccgcagtgtctagcacaggacttctttataggtttcggtgatgaatttcaggactacagagactaatggtattgaacactctgggctctttattactccatgtcaatacaacttcaccttctaaccaccagctcttagggacactgtttgtaaaaggagtcttctacatcagtggattagttgagtaccattttaaaaatgcttcagagtttgcaaagtactttcatagaaatatgtcattagatcctcatcacaaccctgtcataaaagtgtttttattatctccattttgcagacaaaggaactaaaaccggtcatgtttaaaagtactgctgtctgtgtgagagtggaaagactatggaggttagagcaggaatctcctatctaggcaaagatagtaaaaatttcagttccttttgtaaataatttcagctaaaaaatgtattgtaaccttggatatgcagggtatttattcgtatcaagactctgatatcttgctttccaggcaaaagtaaaaccaaccttttcagttaactgtagttgaagagaaaagagtggattctgtctttggatgaggatattaacatttaaaggattggaaacaatgatcagaataaatgtttatatgtgcacacatgtatacttacaattaatggcagagctttaaattgaattgaaatcaatttattgaatgaatcatattcaaaatactttataagaaattttatcattaaggcaaatacacatggatatcagtctaaatctgatcttttttttttcccctgagattttccacaagggaagtggaggaagaaaacagtagaatataacatatacaataccggcctccagccacagtgctacttcccttaaccgtctaaggaaaataaatatatattatgttccagttcagttatctgtagcctgtagttagagatagaaaacatatcagattgggcagagtctaagattggctggcataggaaaaaacagaaacttgtataagctaaatcaagttatgtcactcgaactaccataaaatagtttgtttctgatttttcctctttaattatccccatgtgccttgcacagtatattgcatatagaatgtgttcagtttgtacttacaaaattatttgatgtatacctaaaacaatattttaaatttggaagttcataacatgatcctgaaggcactttggacaatttttgattaatgacaactaaaacttttcaaggcagaccactaaacacttaaaagcggggaagaaacaataagattgtgaacacttgcggggtaaaatcaaaaagcaagtcaagagcataggggtggcgaaacagagcttgctgaagggtaaggctagccagtcatcacagcacgagcaaaccagactgaggactgaatcatgtgacacttgagatccttgcgatagagtctttggagcctgggcatgacacaaccagcttgctatgttgacaaccccagtgcattgagacaatgtattggtgaggtgctgatgttgtattggtgaggtgctgatgttgtattggtgaggtgctgatgttgtattggtgaggtgctgatgttgtattggtgaggtgctgctcaccccgaccaggccatttccctgctctctttgccattggtgttaaagcagaggaagtgattatagagatatccttttaaaattcttccttaaagtaacggaatgatgtaaccaaagggcagaaacctgcaagtcccaaatcattcctgaaaatggaatcaggaattgaaaagacatgggaaagagatctgttgtacagcgtgatgactatagttgatgacaataaataattttcttgaaaaatgcaaagacggtggatattgcattctcatcacagaataactatgtgatgtagttcgtgcttttgttaactagctaaatttaaccattccataatatatatacttcaaaacatcatgttgtaaatgataaacatatgcagtcttatacaaaggacacaaaggaactgttgaagctggtgaatatgttcactactttgattgtggtgatggtaaacacagatgtatgcatatgtccaaattccccaaatgtgcatcagattggtgcaaaagtgccacttttaatggcaaaaactgcaattatttttgcatcacctaatacgttaattatattttgctttttggtctagttttcaactatatcttaataaagctggaaaagaaaagccataggaagtcaggcaggctttttctcaccctcagctcctcttcctccttctctccctttcctttttgctttctcttttcttcctctccctcctaagctctttttccctcctactttctcacccctctaaccctgtccttcctctgcttttttctaccctcatcttatctttcgccatatacaaaatcaagcaatggtggaagatggctttcaaactgctctcaagttgatcttacttctgctcaagggaacagcctaaacccagtaagaatactcagaaaaatgttcttggagaaaaatatctctgggacagctttagtttggtgaccaactctgagccactcacctgtggccaatggcaagattagtagtaaatgcaaactcaccacaacatgttgtagaaggtcaggggtagggtgggggtggggggtgggaataatcttaaaaaaaaaaaaaaagaatagaaagtagaaaaagcctaggcttaataaatgccctggaaaatacctgcaacattaacaagtgccttagaaaatacctacaccattcattcttatattcttacaaatttttacatcagattaccaaaagagagcatacctaacgcatgtacttattttaaagcactgcttttatataagtatgataaaatattttgccctaacttcatcaaagtttgttttcagaaacagccctatctagaacatttgaattttgtttttgctagaaaggacaccattccttcatcatactgtttggtatctttcatataaatctcaaaacaataaatacctctctgagttcaaagctaggaaagaaaaactcttgatgagctattgtttctttttttatagttgaccataattttatacatgcaatgtgaccaataaatatttgctttgtggtggaatacagtgatgaaagaaatatactttatttagccctttctctggcagccaaaaatttagtgcttggttttgtgttaaatggcagtggcttttcttagttaagtgtttctagtatattcttgttcaccccgatttactattttaatgctcttttatgattttactctgtctgtgcccttaaaaaatctgttttggaagatgctggagtataaatagcatagaaagtgaactgcatattctgacatttacagttctaaggataattctattttaaggatgattctgtctgcaagtaaagttattagctatctatatactatatgttttagacaaattttgattgtcatataccttttctcagactctatctactgtgtcttgtttattgttgttgttgtttttcttcccataaaaccatgtctcttttacacaagaatgtgtaatgactcagtctgacttagtttattattaaactgatgtttcaaagggcatttgattcttctgaacccttccataggccctaaattttcttaattgtaccaaatcccatatggatttctataccccagaaagtatggctacccgtcttgctcatttccaactttgtgcttttattttttctggttcttgttgcatgtgcttgcattttttccttgggttttcaactactccacttctgccttgtctttcaaagcctggcttaagactaacctcttttagtaagacttacttaatgaactctaagtgactcttattctgagtcttcttggaattatctactcagtttttgttctattaatttgcccttatttgtttgacatgttgaaagcattctgaaacctttttttttttttttttttttttaagtacatgaatgagttctggctccagttagaaaatttgataattgtttcttagaatgtgtcttcttttcctttttttattttccccaaaccacagagtttaatgtgctcattaaataatattggctccctaattcttagaaagcatagaatattgattatgtttgtcatagcaaacattttattaggaaataacaagataattatttttgtaaaatttaaatttcatcttaaaacggtgaaactcatttttgttgtagttatacattaaagcatcccaaacagtaggtttctaagccagtttctttgttttccctcctattattcatattctttccagattgaggcatatggctttaattatcaagtatatgctgaggatatgcagagctacagcttttttcctgacttttctaatgaagccagttcctaacagcaacatttgccagaatattttgttgtattatgacattaaacatgggccagcagaggtctggctaattgagaatgatacctttccccttccaactgcttatttactttccacgaagctaatttagttcagttataaaatcaaacctcataatacagtgtaaatgagtttgttcacataatatcaattgctaggatggggaaaatcctaaaaataaataaacaaaaattccaaaaaagttattttagaaaaattaataaatgcagctttgttgcttttatttactacctgcaagactggaaatgacatagagtaattgtttttcttccttcttttaataattggcaagcattatttgtaattagtgggtaaattgcttataggcaaagacttgctaaagagctttaaaatcataattttatttcatttcactggaaaatagaattatttcttatgtgaagtgataaaatgttttaaacttttataaccaaattaagtaataaatattatagatatattttatacttacgatgtatgaaaacttgaagccatgtgcacttgccaccactgcccattccattaattatcatcatccatctcctttgaattatgggactctgatttctgtcaaagcagaacctgtgttgcctatttcatacatgttggaaatctaaatgttgtttgcaaatttggacttttgaattttgctctaatggctgcatactaattttatgaacaatgccaatgactatatggaacatgatgcctttggcttttagagcatattctacatcaataagttacgcaatgggagagtcaacaggactcctgagaatgcagtggccatcaaagtgtgttttagggaacgtaagagtttcttagaactaccctacaaggtttctgggagaagaagaaggttattggtcaagttagaatgtccatttcagttctttgaatgtttttaaacaaaatgcagattcaaattgtaagtaaattttgaataccactgagttcaaaagcttctttcgtagataagaaattattcaaacaagtaatttgatgaatgacacataggaatattttgctaaggcttgaatttgaaccagtactataaattcttagaggatttatctttcattgcaagttgaataaaattcgctccataaagatgtggaatctattttgatattttaatgttaaacaaataattagtttttgaatttaaaaggtggaaaagtaccaaactcctaaaatttgctataaggttcaaaaatgttagttaatgtactccatattgtgtttgtagattttctaatttgtagtctttatctagctctaattgccagttttgctgcaataaaaacaatagaataagaggtttacaatttgaaaaaaaaaattatatttgaaaattgagtttgggtatgtgggacttcaagaaaaatatttttaaaacgttattagattttacttatgtcctaagcactccactgtatattgtggatttaaaaatggagtcaaataaggactccacaattaaagaattcagaattcaacagaagtgacaatctaaatataaactgtggtatgatggtgatgctattgtaatggataagtgactttgagctgggccttgaactgaaaatgagaatgttccaaaataaatgtgtgtatgtacatgtgtgcacacatgtgcacatgtctgtgtgtctgcatgtgggagcgtggaaagtggggagagaagagaaaggcagaagaatgacagagagacagagatattaattcatggtgatgttaatcaagttatggaagctggagaataggacagaatatggggacatttgtgtcacagatatcttcagctaacgaatgtccactagatagaagatagcttagcattcaggcaagtagttaaggctggggatagttacctgtttattcattcattcactatatattatagggtattaactgtgcctcaggcattgtaataggaacaatattagggaaggaaatacgtagatgaaatgacatggactatttctccaggaaatttacagtccatcaaggagacaaatataaataaacattataacttaattattataataagatgattatattagaataattagatgaaataagatgtataattaaaatatatgatttataatcatgttagaataactttaatttttataattctaaatacctcattcttattaaataaggagaattgttttaccacaggtgtttgttgagagtgtttattccataagagaagatcaatgtatgtatactatctagaagtcttcacaaagaaggtagcatttgtgtaaggattgacagatgatgttggaagtcactgctagcatactagtaaaatcataggactagagtctatttaaatataccagttaagcatatatttggattggaaagtggattttgctcacatctctcaaagttaggctttgaatccttgatagcaaatgcccctctgggtaacagtctaagctgatttgatcatacatgtccatgatgtttgatgttttcatggcactgaaaataatcagacaggttctaataatttgctgaggaataatatgctagcatcataaccagcctcaccagttgatgatagtttttcattgtatctcaaccatcctgagaagtaccatgggctagttttctgaggcctttttctgctctcatgagggttttcttgacctgcgtgctcttttcatggcttttccaaattctttggctatcctaattttatcattttttattttcttctttgcctcttttatttcctttttctttaggttttcattccattttcttattgttttcccatgtaaaccttacaccatagcactgtattacatactttctcattttacacttcccttaccacaaatttggcagtgttgattgtgcaaatctagctgaatgatcaatttattctgtggttttttttctttatcaactggtatgtagatttttcttttcaactagtttagaataaatcaatattccaggaggcaacatggctcaaattagaaggtcccaccaaactcctttcctgcatataacttattgttggtttaagatctccaaacaccactgaaatcttaaatgtaactgtgcaaagtatgaaataaaagtagtgtattaggtgataatgatgtggtcggtgttagactagcactattgtgaattactcctcactataacacaacatcagttttggattttgaaaaattagttatttttcatttgagtggtatcttagaagtttagagagttataacttatgattcatagcatgtttgcaaggaaaaatgaattaatagttttaaagcatttggaaagcatgaagtgtcaaatacataataattacatactctcagaagatagatatttatgtttgttagcatatacacaccaattctaatttctcacagttggttttgtggattctttgatttgggaatggtattttttttcctatttccagaaaattgacaacatggggggaacatggatagtattaattcataccacaagtaaatcatttagaatttaagtgtcaagtcatggtcttacagagttagaaaaatcttgcagatcatatacttcattacttgttaaggaaagagacatcctaatatatagataaattcattaagtggcttagccaaaactggttcccatgcttatgttaaaattgggtctttaattgcagttctcttcaaagtaagcctgtaagaaagtcagaaaataaaccaacagacaaatattccgtagacaactaaatttccgtatctaacaaaactcagctttttattgaggaaggacacatgactgtgttgtaaagtgattctgcaaatttgccaaaagcattagaggaaatgtcctgttgttatgcagtctcttttatgatactagacatgcctttttgaattttcagtaaatttcataaagatttctatgaattcacataggaaaaaacagagaaataaattatgatggcataggaaaatattgatgctatctggaggtaaaagaaatttacatcagaaaaacacatttccaatacattttccaattattgctatgaagtgatattcgtttacaaaagaagtgttattgattgatcttcaggagtaaactagtgcaacagtctataagaatgttgcattctccctgagaaaaggaaattttgtgtccatattgttactataattttcaaaatctattttgctaaatacatttgttttcaaatagtaattacagataattatagctaacatttctttaatactgtgatgtcagtcactgtactaagggattttcatgagtttgctcactaatattttcttacatcaatctttgccactagattttttaaataagagctttcttgaagtataattcaaatgccataaaattcagccttttagagtatgtaactcggtggttttattatattcatagagttgtgtaaccatcaccccatctcacttttgaatatttgcattatctaacaaaagaatcccagtacccattgccagtcactttttactcttctgactcctcctggcaaccattttctgtctccatgtatttgccaattctggatactttatgtcattgaaattgcacaatatgtggccttttgtgaatggcttctttcacttagcaaatattttcaatgttctttcatggtttagcatatattggtaagttattcctttttactgcagaataatatttcattgcatggatatgccttactttgtttatccattcaccagttaatgatcatttgggttgtttcctctttttagctgtcgtgaattatgctgctatgagcagtcatgttgaacttttgtgtagaagcaattgtttccaattctcttgtgtatatacctggaagtgttacttatttcctttccaatctggatgtcatatatatgtgtgtttgtacacacacatacacacacacacccacacttttgcctaattgccctggcaagaacagaacttttagtaaaatgtgcaagtgaagtggagagagcagatacccgtgttttattcctgttctttggggaggactatttttcatagacaccaggatcatgagccagttgatttccaaacctgccctggagctggaaagaggggagtagtaatagacaagttaaaacgaaataaagggccaggtgcggtggctcacgcctgtaatcctagcacttgaggtcaggagttcgagaccagcctggctaatgtggtgaaaccccatctatactaaatacagaaaaattagctgggtgttatggcaggcacctataattccacctatttgggagactgaggcgggagaattgcttgaaacctgagttgcagtgagccaatgttgcgccactgcattccagcctgggcaacaaagtgagactccttctcaaaaaaaaacaaaaacaaaaacaaacttgctgtttttattgatatttagctattttatttgaataaattatcctcagattgttgcatgactgtgattttcagagatctgaaaaagttgattttgataatatttgtcattgcttttcttgagtaaaggacttcaaaatggttcttaccttaccattctggacgtggcataagtttttatgagacatattttaggggcagaaaagggaaaacttagtgtaaagagaggtcttatgtaagtattattttctatttttaaaagaaaggacataatattttctgcagaaatatttcttaacatatattatctcctaattttcttgaaaattttagtatatttaagactatcagtttggagttaccacatgatgtaagtttttttgtgctttagaaattgtccttttatttgcaagaaaaagtagcatatttggaggagaatacccttatacatattgaaatgaaagccgttaagctttatagcgtgcttttagattcttctgggggaaaaaaattcaatggactaataattgactgagacaccttttatgttttattatgtgagctgagaacttggatctgtgctaactttctcgtcatcaacacactgtatttttaaacaatcagtttctttgggtgaaataaatctcaagatagaattcaatttcttactgctaatccagaatatgcccttgaatcattctttaagcactctttttttaaatcattgtatgattatgcatatgtttcacctccttgtttctccctctccctccactgaaaacagattgactttgtagtactctgcaatttgctttgccagtcacattctagcagctgaaaatcatccttgcttactttgttctgaataactctgaaccaggaatttagcttgtttttaaaatctgttaactgacagatgtttctctataggcccctgttgtcacacagaacaaagagaaagatgctttagccagttcaatatgccaagaaactgatttttcactatttggttcaagctttgagccatagacagttcctttattaatttgttttgaaaaataacacaggtcaaggatacgatgttgtattgcttttatttcatgtgtaaaggttgcaattatttaggagaaaacattatgaaaaatggtttcagaagaaactttattagggactagttagaaatgtttgtcaattgcatttgctttggattgttgcctaatagataacaagaaataggtacctactgcaaagattggtgccaattgatgcaattagttatagctttgaagtaattgttcagcaatgttttctaagctcactgtgttctccttgattagtgaatgagagaattcagtaatttgtgtattgtattttccctatgtctctactttagatcatttttaaaatcatcatcccatctctagagagaaaatatggttatccctcgctagagaaattaaatactgagggaaaagattatgttgcactgggttgaactttggaggccacaatcgtggtaatatgtaagacttttgcacccccaagaactgtttgcttcattcgggatgacattgtccctgttgagtatgcatgccttgtattgtctcttttaaaactatgttttaaaagttcatgatttcaaactagacaaatgggattgcatcaaactaagaagatgacacagcaaaggaaacagttaactggaactgaaatccttcttaccctagtatctcaaaacctactttaaaaggttgccaataaagtataatataaaactaatttttaaaattgtttaggagagatatctgcccttaactgggtggttccttttctaattggtatgaactcagttaagacaaattacataatcctacactcagaggtaaatcatttctgttttgtctgcaaaatatcaccttccttgaattcattgtaactccctgaggtaaaaaagtccatgttgaatttatctttatatgtccatgcattcttcttcatactctttgtacctcagtttttcatagtatggagtccaggaattagactgtctgggtttgaatccttgttacacttattactactaatatggcaaatcaattaaaattctagaagcctcagtttcctcatgtgtaaaattaggatgataaaacctcatagaatagaaaggtaatgcatgtgaagtcttgacatagaatccagcacactgaagtaaggcttttcatatgtatagtaattaataaatatgtttcagggatcgaataaataaactcagaatcctctcatgcagtgtcatcaccagttaaataaattaaatactagaactttcatcttagatatatgcaatggtgttctttctgtgtagtcccaaagggctggagagagagcacagtgttaccaaagcccagtgagagttgatgttgaggaatgggggtccctcccaagtcacctgggaatttgggagctacaattcaagatgagatttgaatggggacacagccaaaccatatcagggagcttgagtgattcatctgcagagtcaggattatggtgcacaaatcagggcacagaatggagactggagctgcagggtgaagccaaacagaatcaccggtgtgcatagtcagtgtcagtactctctagttttaaccacagaagttaaatcaatataaagtagaaatgaaatggcatggcttattattcaatgaatgtttgaaatgttacaatgccatataaatgattacctttttgataatatgtgtaaaagaggaccatagttgttattgagcttatattatgtaacagggcgggttaaaaaatatgagttgaaatattggagctgtgtacccttccaaaaaattgttttgaagttggagcacaagatggaaatatttctccttaaaacacaattcaggagtcaaggaaccagcactgggtcatcagatctcaggttggaataatatttgttgtttgtggctgagtgtactggagaggggtgataaaactgctcaagtactcctagtctcaaagcaaagtagatttgagtatttaaatggggctataaccatcagatggaaaaatcagagaaatattactgtctaaggactcataggccatagtcatggtaataccattaataataatatacaattaataataataactaccatttatgggggactacatacatgcccaacatgatggtatacctttaggtaattttataacaatgtgctgccaatgacaactgatagatgtagagaggtagaaaactgagtttagccgaccaacatgttattcttgttgtatctaggatagggattttcatgacaaaaacctaccaagttatattccaggtgtgtagggtgatacagtgtaactttccattccatgatgacattctaggatatcaaagtgggcacatagcccaagcaccttcatcaaagtaacacagtctttgtgttgcgtttctagccacctcttctcccaggagaagcctccccaaatttccattttaatgagctgaaattagtttttcctttaatatgtgaagacacacaataacaaagacttgcaaccaacccaaatgtccatcagtgatagactggattaagaaaatgtggcacatatacaccatggaatactttgtagccataaaaaaggatgagttcatgtcctttgtagggacatggatgaagctggaaaccatcattgtgagcaaactatcgcaagaacagaaaacctaacactgcttgttcttactcataggtgggaattgaacaatgagaacacttggacacaggatgggaaacatcacacactggggcctctcatggagttgggggaggggagagggatagcattaatagaaatacctaatgtagatgatgagttaatgggtgcagcacaccaacatggcacatgtatacatatgtaacaaacctgcacgttgtgcacatctaccctagaacttaaagtataataaagaaaaaaaagaaaaaaaactgaaatatgaagacacagagtatacagtgaaggcatagacacaactgagcaccagtttgcacatgttccaagtgtgaggggctgcctgcagcccatgaacttttcagtcacttactttcctccccagtcattaccatggtcatttgaaccgcatttgcaacattttaattttaaaaatgttgacaccatgtgggaattccacatgattttctaaacatttttagtgcctgataaaatttttgtttggatttggctcctgagaatacagctaagaattttatacttttcttcaggggtccaattgcttcctattcctcttataagagttttcagagtattttattagaattcttttagtaaactactgcaataggaagtagttacatatttttatcactttttagcaaaggctaggttaagtagtgtattagtctgttttcactctgctgataaagacatacccgagactaggtaatttatacaggaaaaagggtttaatggacttacagttccccgtggctgggaaggcctcacaatcatggcggaaggcaaggaggagcaagtgacatcttacatggatggcagcaggcaaagagaaagcttgtgtggggaaactccaccttatgaagccatcagatgtcatgagatgtattcactatcacaagaacagcacaggaaggacctgcccccgtgattcaattacctcccactgggtgcctcccagtgggatacccagcacagtcagtccttaccacataaagacctgcccccatgattcaattacctcccacaacatgtgggaatttaagatgagatttgatggggacacagccaaaccatatcaaatagcaaagagcttaagtaattgacactggatgaactaggtagataattatagagtcaggactgaaacttagataacttgacatttaattcaattgtctctctagactagcttagtactaaaaggcaatactgacactccacataaactaagccaaaattgggccactaaatagtttcaggctcacatatacatactgagtaagaagcacagaggttgatctcaacatgtagcagatggcttctatattcttaagggataaaactttgagatttttcttttgctccttgtgtgttaagaagaaccaaaacactttagaggtcccagtcaatttgtgttttaaaagaaaaaaaaaatgatgccactaaatacgccagatttttcagtggaaaaaaccctaagttcacagcaattgcttgaaagctgctttaaaaattagttgtaaatccaaggaaaaggaaggaaacctgaaaaatgtcactcatttgaaaagggatgttcatttttgataaattattaggtaatttttcaaggatatcactcacaagtaaagatttttttggtatatttaaatgattcattttcagtctctcatacatttttaaattgttctcattcaagttgtcacatcctgacagggtttcttataaggatttctcttcccttgtgttagaattacagaggatgaaagtattttaaaatctctgttgctgaacagggacatgtgctaggcagcctacaattgtcagttttattccataggtacgttagtggtcagaatgacttcttttttgatggcacaattattttcataatattagattgaattaagctggtgagacaatctgtccctaaaagattcagaaaatgacgctttgatgttagctttgaagcagggtattcccagcatcacatttagtcagaaatatggaaggtatatgttaacatgatttacatatcctactctggtggagtctaaaggtaaataacagaaataagcaaggagctatgcagcaaggcaaattcacctttgtttcttgacacaaacagtgaagcttattttgggaataatgactgcatatgttcaggaaaattgggctcatgagtctactgtcagaacatttttcagaaaagagaaaaatgaatgtactgctgggagacagcagggaggggttcttttattatatacacaatctcttcttatgagaacaaataccaacaatctattattgttcccttaattaataaatcattactgtgggctgggcagagtggttcatgccaggaatcccaccactttgggaggcccaggcaggaggatcgcttgagtccaggaggagtttgagatcagcctgggaaacagagagagatcccatctcaacaaaaataaataaaaattaggtaggcatggtggcgtgtgcctgtagtcctagctgcttggaaagctgaggcaggaggattgcttgagccaaggaatttgagcttatggtgaggtatgatctcactgctgtattccagcctgcatgataaagtgagacactctcaaaaaaaaaaaaaaaaaaaaaagaaagacattgtaatgattaaatatttagaaaaaaatcacatacactgtacattctgtatggattacaattatttctagtattgaaaaggtaataaccaactctttaacatgataatataactgaacctgatttaatttgtttttttctttggataagggagtggaggattacaatttctcagtggtctacttggtcacatatatttgttaaaagccattgtatgactgaaacaatcttagtgccggggtgtacacagtaattgaacacactccctgctttccagatactcagaatttaatttcaagaaaggcacagcaacaagaatttcaggagcaaaagggtatggtactaataacgcttgggctgtttggaggaatcttcagaggaaatggttaaagagactcttagcaaatgaatttctatgtgattttcatgtggactctagggcaaaggacattcccagaagggatggcaacaagcacaagtttgaagtgtatgaaatggcattactctttctaggtagcacaagggattagatgtggctgaagcatagattgttttgaagacattaacaagatctaagtttctaatctaaagacaggccatgttgtgatcatgaaatggcctgtagactctcctatggtcttggatttctatcctgaagaccccaagtcattgaaagaaagggaaagcagtgtgatttaaaaaaaaaagaaaaaaatctaattgagtttcagaaacaccattctggtttttaccacattgtatatcatcgtatgtctttgtagtatggtacctgacacattgtcaaattaatctaaggatcattctaattgcctttaagtatagtaatttgttcatagttcattactaatcccctccatctataatctgaatacctttcccatcaatcttgccttctccaaaactttcttttctcctttattctctttctctttttaaaatttttaaatttgctttctgttttaaatttatgtgggaacgtagtaggtgtatatttttatggggaacatgagatgttttgatacaggcatgaaatgtgaaataaggacatgttggagaatggggtatccatcccctcaaggattcattctttgagttactaccctttctttctcttaatctaagtgtttcccttctgtactaccttctttatttaatattcttctaacccttgggaagagaaggagaaataataaccacaaaaacaaaatcaaaaatccctggacatattaatttatgtgtgaccattcttcatttatgtattataatccttttaaaccaagggagtatctgtatcttgttcattcattaaatatttattaaaaaccttgtagtgctacttctcttctggatgtttaggacatattaataaacaaaatgatccatgatacctgccctcatagagtttaatttatggccagaagagatagacaaaaacagtaacataataaatattttttataataaatatatattttttgagatggagtctcgctctgtcccccgggctggagtgcagcggcgagatctcagtccactgcgagctccgccttccaggttcatgccattctcctgcctcagcctcctgagtagctgggactacaggtgcccgccactagacccggctaattttttgtattttttggtagagatggggtttcattctattagccaggatggtcttgatctcctgacctcgtgatcggcctgcctcggcctcccagagtgctgggattacaggcgtgagccaccgtgcccggccaataaattttgtaatatattagaacacgttaagttctatgggaagaaaaaagaaagacggaatgaggagggtagggatggttggtttcaatttcaaatagatagctagataagccttactaagaaggtaagatgaacaaatacagagagatacagatgcctggggatggactaaaaagacagccagtgtagggccttcaaaacaagttgccactagtaccccaaatgctgaggaccttgcactttgtaggagtatttgaaagtatattgaaataaagagcaaggggtcactggccttctgctcagacgcatagactttagcaaaggagagctgaaggaattgtgttccccttcagtacccatggagaatgtgtcctctgttgtgtaagaaagaattggatgagatattatactgagtcaatgtttgtaccataacaccttatttttccttagacagacagtaaagcaaccactaagggtgcttaggcagccccacttactgttttgtttactgtaacttttagtgttcaccaaacacatcttcaagggcattttaaatagacttgttttcaaatagagtgaaagaaaatttccgcaagacatttgtcattccttatttccacacgaaccaggagcagcaggagtgagtggagaaatccatctgcgagttaatctagtggaacaccactgagtctgatcatttgacagaagtaattgtatctaggggaagtattcaggtctctgctttgtggtaaacatcctgccctcctaaaactgtgaggttgaaaaagatcaacaaaacagccatttaacgcattattgacagatacaagttttagagaattaatcactattaactaactgtattacatactcacacttaatactagaaataattatagcttctttaggtatgaagtagatttgtgtctttacttctaattctctaatcattcatgaatttgctgaatttagattctgtttcagttaatgtttgtcaaataggatgttataattttcgcatgaaattgcatttttgtctacatggttaacttcctagagtttgttcttttctggtagtcaaaatctatgatgaatttattaataatgatattagggtaaaaaagtcattgaacatattttgtgttcagttcagtgagttgaattcagttgctagatttctttgtataactgggcagattaggacataatttttagaaagtgtaccatttattattactagttaattaatcacatttctaggaaattagtgatttcctttaagtttatattccactgtgggataaaataaaattaacatctgtttagcattgtatgccaagtatggttgatgatgcagatttcatggatgattttactaatagacacattaaaataataaaaataaaagtaaattttctaataattccagacaatatattgataaatactaaaatggaaaaatgaattatagtgttgtttatttgagtgttgatatctgggataatcaaaacccatcatatatgctaacagggttttaccacatcatttttcccatacagaatctcacatagctttacatttgagaagaggtggaatttgactcacgctatttctaaatctgacttttatatcataataaagtattacctaggatagaacttttagcataaatctaattaatctatgatttagaatctagatttgaatatgctactttaaaataaaaatattgatttatttattccttttttaacctcttaaaatagatatcttatagttatttgatttgattctgccattcatcgactatcgcactttttttttttttttttttttttttgcacaaatacacgttctaatgtcggtccatgtgctggagatacaggcataagcaacagcagggttgactagctgtggatagtggtacatgattagaagcctaaatgtgtaagtcaggaaactaataaatcctgcctgccttgcctgccttttcttccttcattttctttcttttctttctttttttctttcattctttcttttttccattatttttgatgcattatacttgtacatattttgagatacatctgaaattttgttacatgcatagaatgtacaataatcaattcagggtgtttagggtatccatcaccctgaagagagggtgttcctctcttctagctattttaaaagtacagtacactgttgttagctactaacacttatactcttctatcaaaggttaggatttattccatctatctaattgtatgtttgtacccattaaccagcctctctcttcatcccccaatccactcatacacccttcccagtctctgatatctatcattccactctccattacttcgtggggtcaacatttttagctcccacatataaatgagaacatgtagtattttctttatccctggcttatttcacttgacgtaatgatctccatttttattttattttatccatgttgctgcaaatgacatgatttcattttttatggccaaatagtattccattgtgtatgtatacgcaatttatcctttcataaccctgtattgctgataatcacttagatcttcataaaacttttttttttcttgagattaagtctcactctgtcacccaggctggagggcaccgacagcatcacggctcacagcaccctcaacctcctgggcttaagcagtctttccatttcagcctcctgagtagctagggctacaggcatgtgccactgtgctaagctaatttttatatttatttttttgtagagacaagatctcactatgttgctcaggctggtctgaaactcctaggctcaagctaccctccctctccagcctcccaaagtgttgggattataggcatgagtccttaaaactaaaaaaaaaaaaaaaaaaaattgacattcattcagtaatctattattattattagtattatttttttgagatggagtctcgctctgttgtcaggctggagtgcagtgtcatgatctcacctcactgtaacctccgcctcctgggttcaagcaattctcctgcctcagccgctccagtaactgggactacagatgtgcaccaccacacccggctaatgttttgtattttggtagagatgaggtttcaccatgttggccaggatggtctcgatctcctgaccttgtgatccactcacctcggactcccaaagtgtgggattacaggcgtgagccaccgcgcccggccacaaagtatccttttaaatatagttgaaaccacaaagggaaatgtggtgtttttgctaccgtggcttacaatccaggagagtagacagacacctgatgagacagatacccctctgataaagttgacaatgatgtaagtgctataaagagaaaatgagtttctctgggattggggaagtgagaattcattttgattagagcaatttgggaagaattcttggagaaatttttttaggtattatacacgatttcatggtcttctccaagattttgatatttctctcggtctctctctttcattctctctgtctttctgcctgcattgaaacactgctagcaaaaattttgatgttgccagggcatataaggctttaaatgaaaggaatagccatctgttgtgactgactgaggcagggagagtggatatgtagtcaatattttctctttcctttccttttacttccaaagtcttcacacatgatttgtatcctttttctgtctccctcattgatatcctggaatcttttgctctgtccattctagtgaactgctttgtgaatggtcactgttgaacttgacttagtcaaatataagaacttctaatcatactaatcccctttaacctctgtgggttaagagatactactgataaccctagcttctgaaaatcattttctcatgagagtttctttctgttattttttctgcacttttcttttgtttaaatatgaaagatatttttctcctctaatgcatttttggaagagaacatgcttaattttaaattctgtagtgcttaccttgccacgtgtatgtatgtaatagaagctctataaagatactgagattaattttgggagtgattatattggtcatacccaccattaattattgatagtaaaatacataagttatgtggatagaattaaactaatatttttgtgaaataatacaaatatctatgttttaaatcaaattaaatttgattttaagtttgcatcctatgaggcaggtaagaaattaaatctcaatcattatggcacacctccccaaaaataaaatcctgtgagaatagaggatattgggtagtactcagaaaataatggcaggtcttctctctttagtctgtcttggtctgtgctgatatatttttatccacatctccttgaaaacctgtagctctttggctttgtgcctcaattagagcacaggaacttttgccaaggttgggagcttgaatgtccaggtccagcatcctattgcacacttttccctgcagaaaccctgctattcactaatggtactttaaaaatctggctctttcctggtctggaatacttatttcttttttttttccttttttctttttctttttcttttttccttttttcttttttctttttttttgagatagagtctcactttgtcacccaggctggagtgcagtggcgtgatcttggctcacggcaacctccacctcccgggatcaagcaattctcctgcctcagcttcctgagtagctgggactacaggcacacaccaccatgcccggctaatttttgtatttttagtagagatggggattcaccatgttggccagaatggtctcgatctcctgacctcatgatccacccacctcggcctcccaaagtgctgggattacaggcgtgagcacccacgtctggcctgaaatacttatttctatgtgactcttcttgatcccctttctcctatcttcatggagccagtttcctgaaaagaagtaccttgaagcaagatatctgtagactaattctgcatttgcccttgtaatccaaagtttctcaacctaggcactatttatttttgttgttgttgttgttttggagacagagtctttctctgccacccaggctagagtgcagcggtatgaccatggctactgcagcctcgaacttgctgattcaagcaattctcccatctcggcctcccaagtagctggaacgacaagcacgcaccactatgccctgctaaattttaaaatatttttgtagagatgggagcctccctctcttgtccaggctggtctccaattcctgggctcaagctatccgcctgcctcgtgctcccaaagtgttgagattacaggcatgagccatcactccgggccactcttgatattttggaccaaataattcttgtatatgagaagctgtcctgtatagataccagtagcatccctcaattgtaacaataaaaaatgtctccagaaattgccaaatatcctctgaggggcaaaataacacctggttatgaaccactgttaaaatctgaagttattgaggtatgaaagactgttaataaattacgctgtaacagatatagtgttggatgatgtattagggttctctagaggggcagtactaatagcatatatggatatatgaaagggagtttattaaggagaagtgactcacacagtcacaaggtaaagtcccatgataggctgtctgcaagtcgagaagcaaggaagccagtggtggatcagtccaagtcccaaaacctcaaaagtcaggaagctgacaatgcagccttcagtctgtggccaaaggcctgagagcccctgactatccactggtgtaggtacaagagtcttaaagctgaagaacttggagtctgatattcgagggcaggaagcatccagaacgggagaaagatgaagaccggaaggatcagcaagtctggtccttccacgttcttctgctgcttttatcctagccaagctggcccctgattagatggtacccacccggattgaggatgggtctgtctctcccagtccactgactcaaatgttaatctcctttggcaacaccctcacagacacacccagtaacaatactttgcatccttcattatgatgaagttgacactccgtattaaccatcacagatgataccaattatcctttggaaaatatcagaaaatgagtcagattagtagccagatggaagatggtaaagaaaaggaagcggattggcacttatgtgtcagcaagatgttattgccattttatagagcactgagggattgtttgccatggatgcttctctgttaggtaaaggaggcagggctcaagcccacatctattcaaccttagaatcccaggacttttcatgataccatatactgttccagctatgtaactcactttgccaaatatttaagtacataattaagaagactgaattcttttttttatttgtataaatttaggggtacagtgcagtttgatttcatgagtctattgcatggtggtgagggagaagactacattatttaccttacttattcctgtggcattttttagtaggcactgggtgacaggcatcagtgtatttcaccaaagataagtcagaatataaaacaccatcagttcattctgatatgagtggcaaatatgtcaggaatccttaagagttttgccttttataaattatatgcatggaaacatccatcaggcttagctaaaagcccatgctatttactattttgctaaactctcattcttttaagccaagttaggcaactgagaaggcgagagagcagtgatgaagcagatatgataccctttcaaaactacacattgtgtaatacggcagatgcaacagaagcaaagggtgaaatgaagagaagtaaagctcatagatacccagggacttggctctagcatctttttatgctgtgtataatgagctttgactttattctctaacacactagaaagccatggaaggattttaagcaatatcattgtttcatgaacaaatctttgttttaggaaaacaaaacaaaacactagtactgttacaatttaaacattgaataaaagtctggatgctgttggtataatctaattttaaaaagggtgtgtaccaacaccgtaccagtggtgaccatttatgtatttacgtatttatttatttttgtatttgactaaagtttttaattttaattcataagttttcagagtttagtgagcaaccaaatcacctgttaaaatgctgagtctgatacattgggtttagatgaggcccaagactcatgttttttgtttgtttgttttgttttgagatggagtcccactctgttgcccaggctggagtgcagtggcatgatcttggctcattgcaacctccacttcccaggttgaagcaattcttctgcctcagcctcccaagtagccgggactacaggcatgcaccaccatgcctggctattttttttttttaatatatttttagtagagatggggtttcaccaggctagccagggctggtctggaactcctgacctcaggcaatccgcctgccttggcctcccaaagcgctgggattacagacgtgagccactgcacccggcctgactcacatttttagcaagcttccagatgatgccaatgcctctagttgggcaaggctatgagctgccaagttctaatgacagccactgtgctagacaaggggagaataaggtagtggcatgtagtattgcaactgtaatcccaggtgactggaatataagtgctctgtcattaagagttcgtttgtcaacgtcttgagtcttaaatatcctgtgttggtttcattctgatttcacacagtggccttctgcagctctgggagttcatcctcccagattcaagttttacagaaagaaattacttggcactttcacagaaatcccagtgagaagcctcattgcatttgttccagttaagtcatatggctgcttctgaatctaaacaaatcactgtggtgagaagactatgatgttctaattagcctgactccactttgccttttcctagaatcagtagtagagtcaactccatctgaggtgcttggactggtaatatggaaattgtgccattcccaaagagaaagtgaagatgttgaactacaaaggtgattggatatctattacatataggaattcggtgtggacaagaggtttccatactttcttggtttcttaggaaatgttcatgataccctcaagtccaaaagaaatgcctgagagttgatttattcggcagttagttccaaatgatgtaagatttacgtccttactattaagtagctgtttgataaaataatacataaggacttgaagaaaattaatatttttgtttccatcttatataaacacaatcacttcctaacaaggatgtgcacagctattgggctgtacagaacgtcttgcccttagattgagattggatactgtcaccctcacttcctgttctgcatggattttcatgcagtagttcccttttttattctaatggtaaccactaaagcccagatttataaagatatgatgctattgaaagaaatgtactgtgagctccacgtttcctgaaactgcaaagtacttgaagctagtttttgatgtgaacttcaataaatgttcagtatcattgtgtttccctgaaaatgttaaagtatcacgaaagccccatgaattccccaaattgcttttgtgcacagattgagaaccataatcttaggacttttatatttgaatttcttattagacatctttgtagagatgtagaataaaatgttgaccctatgggttcagttctgataagagatctgggctggtgaggcatctcagcacaaaggttggattcctttggtatcatggcctatagtgctctaggcatgcactacacatctttctgtctcttcaagagaagaataacatatgtctgctccactaccacacaactttacaatgcactgttttattttttgatctgaatctgtataagtaatattctacttggagtaactcatcctagtatttgcattctacatgtgcattcacatttacagtagactgcaataagagtgatttttatcctaagctctggatagttcatatattggcataaattactaagaggtaggcatcatgtacttcttgttcagattgcaaaccctctgaagtttaaatcttgttccttaaaacgtaaccatctgtgggatagctcaattaataagcactgagcagagcatacttttgattctgaagtgattttttttattaaataagtcgatatagtattttctcagtgattacgcttttctccttgctttttttttttaatgctgagtacaaatatcctccaacccaattttaaaaataacttatatgtagtctggaaccagtagatttcccaaagcatgagcaaattctattttactggagtcaataatgtttcaatctctcaagtccatgtgtgagatatagtgaatcattgtcatattatcattatatcactatggctcatctcataagatcccgcatcatctgatggccctatcattactgcttattttgcagaataatatgtaagtctcttcctaaaatccagaaaacaaatggattgaaaatattaagtacatcattattatgtaaatatttaatttttgaaataaaaatatggaagctagtaacaattgttcagttactagggaaacactagttagatttttctgtttaaatattcaaattgctgggtttggtagctcatgcctgtaatcctagtgctttggaaggccaaaacaggaggatcacttgaggccacgagtttgagaccagcttgggcaagaagtaagaccccatctctacaaaaaaaataaagagttaaataatttcaacttttacttataaaagtaatataatattaaaatgcgtattctttctattaaattatctttttaataacttttaatactgcaaacaaaatatttgaaaagtattagtgcagcattggccattgttcacagtagatctggaacacacaacttcattatacatgtttttgaggtttgatatagtctgtttctttttttctttttttttttttgagactgagttttgcccttgttgcccaggctgaagtgcaatgctgcaatctcggcttactgcaacctccgcctcctgggttcaagcaattctcctgcttcagcctcctgagtagcttggatttcaggctcccaccaacacgactgtctaatttttgtatttttagtagaaacggagttttgccatgttggccaggctggtctcaaactcctgacctcaggtgatccacccgcctcggcctgccaaagtgctgggattacaggcatgagccaccacacccggcctatagtctgtttcacaaatggcagaaacattgcttggctatggatgtgtagatatgacattataatatattaggacatagaaagtaactctttttctattgcaatttccctgtcttcataaattggcctttctgggcagtgggcaagaagaacccaacacttatatgagaattcccaccctgattcctctctaccacagacagctccccaggttactcaattatcattactgccaggtgacaacctccacttacaaagatgaggacactgaccatcccgggcacaagatcagtgagtggggaagcagggtcacatggaggtgggaagagtggatgggcagtcctgggcagctctgaagtgggacagtatgaaaggaaggccctgggctttgtccctatgagtacctattgtgtcacataaacaatagtgtgttaatggggtgctgaaaaagtctcctgcttaagcaactcagtttgtttatgattatgaatgtcagcagaggtctataaatgacaatgcagtttgtgttttgatgattgtctctctgatgggggtgttgatagcttttcttagttcttgtctcagcatttattcttgattggcatatgacagtcatattcttgggttctgttggtgtttttaaatcatgcacatgcttgaatttctcttacagagcgagaatgacattatatctgctgcttgttaaatagattctcagtttatgctggcaaagtgtcagtgctgtatgtctctatgtatgcaatttttcttttgtacagtcatttttctcttagcattctaaagattgattgaactcttgtgttatagcagtacttaatgtgtcacttactgaacttaaaatcatcactgtaactcaatgcataacgctattcatcatccattgaacctgtcactcctgctgattgtgcagaataaaagcctcttctcacctttttttttattataacagatatagtttgtgcattttttcttcatgttttaactgatattttgtcatcagttctctgatgtttatcaagagttaactttttttccaacccagattaatacaggttagagagtagaggagtttgttaatacgtaacaactactaatcactaaggctagatttattacatataaatatgtcaaattagataaacgctacttaaaattttggctgttggaaaaatattaacttgtaccttcaaatttattagggctcaaggcatattaaactttatagcagactttggatgttttatcttttaagaaatatttgaggccggatgtagtggctcacgcctgtaatcccagcactttgggaggccgaggcaggcagatcacgaggtcaggagattgagatcaccctggctcaacatggtgaaatcccatctctactgaaaatacaaaaattagctgggcatggtggcatgcacctatagtcccagctactcgggaggctgaggtgggagaatcgcttgaacctgggaggcagaggttgccatgagccgagagtgcgtcactgcaatccagcctgaaaactgagtgagactccatctaaaaataatgataataataatttgacttagtgaacaaatttgcagtaaaacagaaaaaataatatagattacacacctttataaaatctgttgtataatcatctagagatgcaatttgaatgcagcagtataacggagaagcatcagatgaattctcagagtatatcaatcttgcctttgttctagattagagcctggtttttagctagaggtgctgtagtaggaaaaacaggtttgtattgattcagattgtgtgtgcattcatagcagatgtggaatgacatatttctgccagataattatcacttagcaaagggtaaaacattagaacatcatgaaagttaaagttttaacttcacaggaaaaaaaggagctttactttaaagcatgatgaaaattatagaatttatgcataactcagttattttgttctgaactttaagaagaaactttcagaagacatccctaaaaaagcaagtataatgaccatagtatgaaacttaattgtgatataataaagctttttgctgtatccagacatgttacacaaatattctttatgaattacataaacagaaaggcaggagctagtacaaataatgaagaatatttatttaaaaaaaacaaaaagcggttattttatgtagaacaggctgcatacattatttattacaccgtattcaaaatattgtacaactctgttatgaggaattttacttgcacttggagaatacaggtaaatacattagaggcttatagatcctgaatgcagctgcagatagtgtcccttaaaagaagaaatgcagctggtttcctatttcccactcttttttgtgccagacaaggaagtgactttctttagaaaagaggattataatagtcatatccttaaatgaggaaactagaaccagatttctttttagaacttgcagtggggattagaagaaatgttgcaataaactttaggttattctaatctcagtttactaagtttttggtaacactgctcatttaacattggaaagagatgggatctgcataataaagtatacttcccataacttaaaagtaatcatgttcattgcgtaggataaaatcatccgttattccaaaaccagaggaaactgcaaaaaaagagtgctgtgttagcagtgacttaagtatcctttcacagtttgctaaaaatttttaagaaatttttgcaatttccctcaaattaactaccaggcaggcatcaatttgtcatttttgtatattgcattaaagcatttaatgctaaattaagacggaaaggtaggttttttttctttttttttttaacttttcctttctgcaaaaaaaaatcaaacatttattaactgctctctattgttgtctttctctttagaaggtaatttgtggtcagtggagcccagcagggaagctccttctcctccagatggcagtgacatttgagaaaaccttggaggattaaagacactctagtgagcactcactgcaaagtcctgacacaatttgacagtcctaatctgggtcctcaactgattggatgaccaagggcacaaaattctcatccaactgtgcaatcaccaggcacattgttaagggcactaaaaatgttccaaagttttggtgactgttttaaacaaaaatatataaaccttttcttcatggcatgtttttggaaaaggtcttggaggtaccttgcatggcttttaaaaactgactatatttttgcatgaatgagcacagcatgctataaatgtctttactctttattaagtagggtttgcaaacaatctaaatggttaaatggtagaggaaactatagaaattgatctcagtgagcaaagcctaccaaatctaattatatattgtcaccatctgctgcaatatgataacagaattaatacaattactttgagaattttgaagaaaaaacttttgaaaaaaatggacacgtgtggcaagtctgcgtgtgtgtgtgtgtgtgtgtgagagagagagagagagagagagagagagagagagagagaagcaagggcaagaaaaaaatgccatcttagctgttctttctttttctgtttcttttttacctttcctcatttttaagttattgcttaaaatgatttgaaatatgttttcctaattttcgtgttgattaaagttatcaagttttggtaaggtgattttatgggtttggaattttaattatatccactgcagcttctaaaatcaccatggcaacaggtgtgtaattatcaacattgcacatagcttcaatgtgtaatgcatttcttctggctgaatgaatattaaatcatactgcttaacacctcctctactagtaaacagataaggctttggccatggcttgcaaattgatcttgcttctgtagatttctattactgcagagccattgaatggggtaatttgtgcctttgagggttttctgactttgctagagcatgacagaaagtccagttttatttcatgtaatgagaaaaaaaacatgtttaattattactcacatttccattagtagaattctttccaagagaatattctccttattgttttccatttcaaggtgtgtattcaggacagatgagatttttttaaaaaagacattttcttaaggaaagcttacattttaaatgctacttttcctagcaaatgcaggtggtcattgtatgaagcacatatgaaatgaaacctttgatttaataccaaactatagcctactgtcaactctaagaaaactgtatgatccataattttaagtaaaccaaaactttactttgtttctaatattccaggtggtcttttcagactgatatctatgtagaagtacgcaagaaagtgacgtgattatctgattatcagattatgtttatatgtctctgattgttatcaagctcaaaattttccttaaatagctatggaaagagatagcagtttactactactactattattattaggtcatctaatgtaattcaatttataaatctgatgcatacatttgactgataggatacagacttttaaggacctagcattataaaaaatataatttaaatacatagatcaaatagagccatatataatattgttaaatagggaacaagataaatgattatgaagatgtatagatcttttaatcattcagtgtttgtttttagtggacattttattttgggatgccattcagtaacttgaagttattaaatgaagcataatcaatattagaacaaaagccagcataagaagatttatttaaatttgatgtatttagaatttggagtctggtcactagaattttgaggctaggtgattctatgaaaggctgtatgtaaccaccttctactctattccttcctctccacccaggtcaaatatcccagaatatggtattatttaagtatcatcaacttttaattttagtgtgtttccattttcaaactaagacaggtgcaaagttgaggttaccagcggtacaagatcagatcacctagttagatattgatgcatagtaaaatgtagcctaacacactctattcataatgtggattgacaactaagaaaaaagtgaatgctttattcacacaaataggttaatattcctgaaatagtgtccaatgcatttaaagccatttaaaagaacatagagaatacattatttttcttagcttatttctccagtatttctccctgtattactctagctcatatttagactttttgttaatcttagaaaaaggataaacacacacagtgtatttctgcagactcccctttaatggatctctgccagtgttagccattgtttcagttgcctgtggctgctcaactgtgcaaggttgcctggaaacgctccttcttcagtgcaaagctctccggccactttccatacctcccagcccagggcttaaagattcagggactccagccactggtgtttctttttgaaatctccttagtaaactaatgatcttgtaaatgtagaaaacagaaaaattacttctcagtctgtagggcgtgcaagtttaaaacaaaacaaaacaaaaactttgaaaaaaatatgtatttgttacaagttaaaacaaatacaatttttcttctctattgaatttgatttaaaattttgttaaaccagcattttgtaatgtgtaatatttttggcaaatattttaagttaacatctaccactgtctttcagcctggaaattgtgtgctattcccatcaaggttacatcatgtttccattactcctttaattgggggaagtttcaaagtcagacaccttgatttggaatttcaatgcttttaacaaattttaaagcaagtaccactattaggtaacagaatattattattactcacttttttccttggttaaatttgtttgttagtcctaagaggctttaggaatataaaatgaatgtgatgtttgatagtatcaatacagttgattttacttgtctctgctattttctcttttcatattataacttaataacaacaacaaattagagatatgctatttttccacagttagttcaagtttctaattctggagtataagatggggatatcactgtgcatgagttaaatagatgcccctacataatacctatatatcattactagttttaaaagaaagattatgtaaaaagtggtagtaggtagtaggtagtctttttcttttgttacaagtgctttgaaattactggtttgtgatataggatgtgaaaagaaagacaaaatccgtgatgtttgaaagacatactattatcagatatggcttacttaaaattagttattagactttggtctcctaacagcttttattccccccaatatactttcaaattccgattttcagaaatcttaattgtacaatattaatattgctacagacacaaactttgctagccctttattggtagattacatagactacattggttattagattttaaagtttattaataacatcatatccattcaagtttattttaatactttttccttatttatttaaggaattacttcaggtgatatgtggattttaattgttacataaatgcattttatggttatttataacattcactttaatttaaaggcctataagacctgtggttggatgacggtatgtattaatgttgtttttaacattaagaacttacataattggtccagaaaatcagacctatcccttcatgttctctttccttctgtacttcataagcctacgtgtcccttaggatagattactggatctgcttctcgattgctgatagacctttttcagttaaggtaagttatatgttagacatcatagagtgatcggactggttttattacatagcatattgggagcaaagcaaaagaataaagcagatacatatttctgcatgtcgatgcatgtatccactgtatttttaacgcaaactaattaattgtgggccaaaagttacagtaatgaatagaagtctgttgttcttactcacatcaggcacgcagtcttacttttttgtaaatttaaattgacgaggtaggtagagtatcacgataagcttaaaatggttattttgaagaaattttcaagaaaaatattaaggaaaaatttgggtgtctactctgtgagacaatctgtctctaaggtgctttacatattttatctcacttaatccgaggaaccaccctatgatttaggtagcattgttcctattttgaagtttgacaaactcatgcaccttgaagttaattaaactcagggttgtcttaatcatttctaatttcagtgaatatactttcccattggacatttaactttctaattaatgtgaaaaaaagacagtatttctgatagcatatacagcagtcactttaggggcagataaacatgagatgccagggatttggattgttcaagtcaatagtgtcctgaagaataatatattcactgtgtgaaacaacaacaacatcaactagatacaaagtttctgtaaaattcggacaatcattttgggttcttaacataaatagacaagattgatatatataatggtatttcagtagaaaccaggaaaatatcccaacttcgagaatcgtttcttgccaagcccacagtaagagttctaaatataagttaaaataggttctctgccaccatgaaactggtacccaacacatatcccaattataaaacgtctttatagtccactatggcaattatgaaggcagagtataatatgggagcctgaaaagctatactaaagaggcgacttttgaatggggtctggagggatgtgttcaccaaggagtgaaaggaggaaaggaacttaagttggtgaaaaaacacagatggatgtgtgaacaactccacatggccaaagaatggtgtgttttggtgtgtagggagggatttctggttaggtccatgagccagtattacaaagggctttgcatggcatgagaaggtattcggatgccactttgttcaatacagagatctactaagcacttaaaaattagagacaaataatattcagattcatatgttgaaaagattgcatttgtgccaatggagaggacatagcaaagggagctagattagagttagcagtgtcacttaggatgccattacctttgtctagggatcttagactcaaggtaagcaaagcttaggtcttgaaccaagcagataaagactagagaagaggtgctcagaaatgttgaatcagtacattttgttatactttaaaaattgttacaaggccagtggctgccacacaagacattaagcttttttgtttttgcttaatgaatgagtacaaatgtgggggaagtaaggaaaaaggcagctctgaggtttgctggaagttagctaccctcatgtttagcagacctacaaagtcttgaagcaggaagtagatttatcatggtgggagggagatggcttgatagaatgaggaagtgaaatgaaatggctcttcccaagagtgacaatgcattttagagaagatgtgaagatgatgcggttgttgagaagaaagagtattcagtgagcagcacagtggagaaatggtatggtacctaggtaggaaaatgaaaatgaaggattcctcattttctcttccagatcaggtcatgtgacaggactctgctcactccctctctacactttaatcttcactgaaagatacatagggataggaaaatttcctaacattctctcttttcctctgtattaagtcattccattaaccaaaaagttcaataaatatcaactgaatacctattatctgtccctttttaattttctttctgccctgtaaaaagctgaatagaggaatgcttatacgttagtgggagttttagaagtctctgaaagtgagaggtaagtcgtttgtcattttggctagatcttcccctaggaacttctaaatggtttcatgacctcatttcatcctagacaaatgcaagagggctttaatatgagaagagcctcaggaatccaacttgtagatataagcctctcttttaacaggttacttagtaaattagttttctttgtactgtgattcattaagaacaataactttgatttcattttatactttacaggaagcatagaatgactcaatagtagaaaaatacaataacatttttaaaaattatgtaaattaaataaaatggtatacgttaaaattgtgaaaattgtgtaaattacataaaaaatatatgtgattaaattaaaaccaggatttgtggggtggctgaattagatttcttaataaaatttatgaaaaactgtgcatggtacatactattctttcagaagcaataacagttgtaagagattattttttaaaaaatagataccatttattgagagcttactaggtgtcagccagtgctgtatccacattacatgtatgaattcatttaatttttaaagtcaacctgtgacttaccctgtgagctcactatgtgagccatcacccttgttttgcaaacaaacaaattgagggggagaaatgaatccatattcttattttatatcagccatatctctcaacaaacgctaatcagagctgattaacaaattataatcagcatgttcaatatttgatatttcatttaccttgcaggacatcctttgttttacagaattttttaaaaaccttagtagaatttttcttttttaactattattaaggctccttaggtgagtggttttcaaacgatatcctaaaggtctccagaaatttcttagagaatctcatatcttcttcaaccagattcacttgaggtatagtcatttcatatattaggttttattagagcttttccctccttctcttgctctgcctcgcatccatccatccacccgtccacccatctacccatccatcaatgaacttaatttttttagctttaaataactaaatcatgtactactaataaaaaataaagctaaaactggaggacaacatattaaaatattagatttcaggatctctctttagattgtacacatcacttcatgaatgttagcagtagcattaaatccaaacttataaaatgttagtgatgaagtagcagtgcattaaatataggcaggtgcattactttcaattaaaagtaatggcaaaaccacaattacttttgtacaaacctaatatgttggcctttcctgattgaatgtatattagctactttatacatattgttataatgtataacattaaaatggcatattgaatttttaaagtagctaatacctttaaagattctacaacataaaaacaattttgcataagaaatgttaggtatctctaagtatattttatttttaattttttatttcttttttctcttccaaagaaaaaactcaggtttattgatgtataatttacacaaaaagcattcacattttttgggtgtacagcccaatgagtttctgtaaatatgtcctaaattttttttaacaatcatattcagaaagtttaaattcaaaaaagtttaaaattattttcgaccttaattcaaaatacaccattcaggatgtttcctgctcattttgctacactgtattaagaaagaattttcaaaatatggctgcgttctcttggtgaaaagtactttccaagggacagcctaattagcccatgctttccctccagctccatcttgtcctcctttcctgcgctggatggcctttttcctgaggtaggtgagagtgcccaggacaaaggacacactgatttctctgggaaatttaaaccatgttatcaaggatggttctgtctgcctaatttgtaacttttggttggggcttggagtcagttgtggagcacagggtgggtgaaggcagaggagagagctccataacaggaacgcagagcagcaaggtctcaagggaacctgacaaggatacctcggaagaggcaggctctcagtgcgtcaacttttcattggttctatggactgtgggggaaagcaaagggacagcttgtttttcatggattgattttccaagcagctttatgaattgttacaattttgatctgggttacatacattcagttaaatggatgtttgtattaatataaacattaattttatattatttatgtaattaaatatttgtgtttaattatataaatttttatattctgtgctgttttacttttttgtattttttaaaataacgtgtatcttctttttagcttgcataaatatgtttattcacttaaaaagtaaggtttttatatttaaaactatattaaaacaaacgcacaaacatggatttttcttgaaggttattctggaaggttttgcttcatcttaatctcaaagactttgctttgttgtttactttttataaatgaatatattttagcctaatacttctgttctagaacttaaatattggctgtattatttttcttaatattaaaatgtttcctttaaaatttattttccaagaggaatgaaatttttttttttaaaaaagggattttaatgtttaaaaactgctttgggactgggtctgtaggttcagtacaccttctgagactgaaacaataagagcactcgtggcttattgaaccatgataatcaaagcaaccgaataacagtaaatactagaactggattctgcttcttatacctaattaaaaatatatattgttttaaatggggaatttatagtgaatctcatgaacaagtaatatagactaaacaatctgacattaaaattagagaatacaaatatttgtgatttatgtccttttcttaatttgaaacacgtgtgtgatacataacatgtacagcaaaagataaaaataagattaagccagaatgccattttgaaaacaaaatacaaaaaagatatgttccattaatccacagatataaactatagtagtgtttctgcattaccataattatttctgcagagcaggagaataagcagaagagaatttacatctatgtttgcttaatattgtttctgtctttaggtttcacttctctcccatggtaatgtaaaagtaggaccacctgttttccattgggcattcagtttgggtaaattcttacaacacagcaatgtatttctaatcagaattttctggaaatctgagggaagttaattataacaataatatttttaaaaactgcagtgaataaaattaattccaggaagacacccttcctccccaccaaaagagaaatctaggaagaaacacacttcctatgcagatttaaaagctttgggaatcaaggttatgaataaaaaaaatcatttcacttccataaggatccagaagggaaatatttaaatgtaaaatttgatctataaaatctaggcagcatgtattttcctgcaactatttataagagaacggggcattgtagaataaaatttgtaataagtggaagtatttctgtcttcgaaaggattgctgtaaattgtgggatgtgtagaaaaactgctcctgcttaaaaaattgcaaacgtgtttttaagcaatgtttctaagtttctattttaagtcagcaataggaaaagttattttcttgtatatatgtcaaaaaatatcaaatcagaaaggccatctacaattgatttttctacttgaaaggaacgaggaagggaaagttcgtctttgctcttgtccatcagagtattatgcctgccagcttgtgtgcaaatgatttattctgaaaagcagactttacacttagagaaatactgggatggagcatttgtgccctgtggagtgtttggaaatggaataatgcatccacaaagacagctttctgcatcctttctgcctgcacatatgaaagggtaagcattaatttcaataatggttcaagtaattgaaaaagggcctgcatttcaggatagctggacagttcacccattagctctctactgcaaagagaaaaagaaagctgacctgcccattttaacattttaacagataattaagaatgacaaaatctaaagatatcaaataaaatgtaaaacttaaaagtcagtcagtaaccatactctaatagtttgttttctagttcctacttttcattaactccaaaatttttatgcttaataccttaactgccatttggtgtaattatacttaattttttttcatgtaagtcattttcctgctctgaaggttatttttagaaaaacttgatccatcttttctctcattcacatatatttgcaaacagatagtttctgtgaaaagccaggtgttttcagtgatctaattactataattacaggctttgaattttaaacccaattcttaacttttaaaataaaactttggagataaattaaaggcactagaaggtcacaaaaccagtattaattgtaatatactgtgaagttcctcttggtttacatactaatgtatagaagatttttgaaggctctttttactcttatcaattgactcaatggactcatgactgtagcatgtcttattttcacagatgaaacatttcagatgcaccgtaccaaataaaatcatactccttagcatgatttttcagattatccacagtctagtctcaatctctttccagcttcgactcactgcttcattcccccagttgcctaaactctatgttattttgagtgtgctcgttctgcaagtatttcaaagtttcagtgcaggtcccagctattcagggcagacatttgaacataaaagtgtttaactgctggacagttccagtttttcatcacacatgctgttattcctaacattcccgtatcagttaagaatggttcatataacagaacatacaaccctgctgttggtgttgatataagaaaaagtccacagggaggcggccagttcagaggtagtgtaactcctcagggatgctgttaaggacccaagatctttctgcctctcagccgtatcatctttactatgtgaacgtttgtcctcatgatggttgaagcctcagttgaaggctgccgcaccttcaactctctgccatgttccaggcaagcaaaaaagagatgtggaatggggcgtgagtaacgggctgtacccgattgttctgtccttccccccaccctcccgtcacttctttctttttttcaggaaattacaagctttctcagaggctgacaacagtagtctttgtttcacatctcattgggcaacacccagtcatggctgcccctacctggaagatggctaagggagaaaggaatgcgagtggggactgggccagtgaaagaactgtgcctgccacactgcttttcactcgcacgcatccctccacttgaaatgccttttctcttatcctttatgtgtgttcatctacatcttgtgtggaggctgtccactttctccagttctgtgtgagctcctatgagctgctgtttttattttcctatgggatatcatttttaaccttcataataaaaggcaaaatgactgtcattagctttatgtagctgtgtcttaacactgaggtcagaaattgtgctatatgaattaggaatctttcagtgacaagcgtcaaaaaattatgttaattagtttatcccataatttgttggttcacttaacatggaagtccagggaatcgctggcttcaggcatgtctggaagcagaagctgaaatgatatgctcagtgttaactcctgtgcctcttgtcattcttaatctcatccatcctccctccctctcttattgctcctctctactcctctttgtccttctttttcttcctctctttctcctactctttattctatatccctctattttgctcattctgaaactggttctcaacacttcgtacaatgtataaatgataggcattcacagctcttagcttacctgacttctcattatgccagagtcaaggaattcctttctacaaaatgcatatatcaaatgtttctggaaggaatatgattagccttggttggccacatttctgttttttgaccaatcctaccatggaggagaatagaatagtaagattggctatgaataggtccattctagttgcccagaagtagatgaggcagtgtatttgataatctcacccaaaccatatgtgttgttgggagaaaattctgggaatgcaaaataataagtacttatcccagatctccttttacctgtcatcattcattgcatgtgcctatctctatctaagtaataggagctcagtagggagatgaggaagtgaatggataaatgggagaggggaagaactgagttgacctataagcaaaagaagaaaacggcagttttagtgttttatgagctgtatttagatcatgcaataatattttagggtttttttagtttagtttattttttttaatttttgaaacagggtctcactctatcacccaggcttcagtgcagtgctatgatcgcagctcactgcagcctcaacctcctgggctcaagtgatcctccaacctcagcctcccaaatagctgggactacaggcaaccatcaccacccctggctaattttctgatatttttacagagacagtgtcttcctctgttgtccaggctgctctctaactcctgggtttaagtgatcctccttcttcagcttcccaaagggttgagattacaggcatgaaccactgtacccagatgttttatgttttaaatttatataaatccacagtggctgcatcattcaaattacaaaaataaggaaatgtggtacaaaatcatattcaaaaaatgcatctgccattgctccttcagaaaatagttattgcttgcttactctgtgataaggcattaattacatggtgcttcatttttttagtgacaataattgagatgcttctctctgttcttagagaacatcttaagctgatagaaaaactaacaaatgggatacatagtttgtaagtaaagtatatttgggaaaccttttgtctttttaaagcatataaaactaatagtgtgttttcaacttcagtgtatggatgtaagaagcttaagaaaatgaattcatatatttagcctcatttattttaaaccatttatggagacatttgatatatttttaagtctcccagaaaatatcctaagcataagcaaataacttcaaatacaatgtttatatttggacatactagttctctgctgtcatcttgactgattcagaaaagttctgaagtgaaagattttagcatttatttctcctggctttcttccatctgccaggaataactcagttcactgaaggcttctgacaggtccctgaccttggcccctatctttgccatcagtgtttggggtgaggagagaatgggctttgaggatggttgcctctttttcactgctgcacctcctcattatctctccaggaagcaggttgattctggccggcaaagctccctgaggtgggatccattcagtccattcttacaggggtaatagggcttggggctcatttcagtcagccttcgttggaagagagaggtccctttcctttccttttgaagattgattagtttccaaagaaagacagataacaccactctcattctcactttctctcttttttctgttcttgaaaactcaatagttgtgtacaataagaagtcttgctagacaaattgtgcctatgctttatgttctgtaaacatgattcttgaagctgagaaacttttaatggaaccctttagctaagctgaaattacttacataatccaactctgtattagttttcctggtttttgaaatagtgtcacaaaatagcaaaaaaaaaaaaaaagaaaaaaaagaaagaaaaaagagaaagaatgggaagtagagaatttctaacacagtcatctaacagactgactcagatgtaacaagaaagtataataataataaaatttaaaaaaaaagattaacagaaaacaaaacaaaacaaaaaaaagagaaagttctcagtagccctctggaaagagaaatttctaagcacaacttttttttgttaaagataattgaaaataattatatgtgtgtttggtaaaccacaacgatctttctatattgttaacacctaaagtaggtgaagaggttaatgaggaggtttcccagcaacaaatttaattgtagtcatgtaaaaattacataaactcaacataaaatttgaacacctgtgcaggaatctgaaaaaatttcattctaagtaattcttataatttggactctcagtctagtggtgagaatttgaaaaagtaaagaatgctcatgataaagtttgacaggtgctctgaaagcagtaaatatgaggaattaaggcaacctctacttttgacatcgtttgctctgaggaagtattgtatatcctgactttaattttttcaggaccctgtgcacttacaggatgacagaaatgatatttcttctctcctgaaaccctggggttgatatttacatatcacactcagacatacaaaaaatactattctgctttatttatcaataacaagaccctgtcctcaatgatggagacagaaaacaactttgctaagttaagctatttcagccactacttctggtttttattgctttatttcagaggaattcaattgcagttgactaaatcctcagtcaatttaaagttcatatttcatgtgaggaatgtttttctctaagtgagtccacattcctttctctttctttcccaagatggtccagggaacagggctgaattcccatgttctcatgatgagagaggaagttccttctggtttgtgtgctgtctctgtcctcattgatgtcctctgggatatagttgcctggtatcttgtgttcttgcccaccgaggtctggccattacagggttgtaatgctcatacatgctgttgaggcagaggttccttttcctctggtttttgagatttccatagcaggggtcggtaaactacagcatacaaggaaaacccagctgctgtgggctaaatccagccatttagcttgttggctaaggctgtcagttttcgttctacaacagcagttgtgagtacttgcaacaaagactgtatgtcctgcaaagtctaaaatatttactctcaggccccttacggaaaacgtttgccagcccctgatctctctgagtccttggattgtccactctttgtttgtccttcctcttggcatgtttcatcttttccagagcacacaggaaccactgggtctcctgcacagaaactcagggcagacagagtcactgtctagggacctccccatccctctcctatgtcactgctttggcatcatgctgtatataaaaaggtagcaggggaccagccctatctcagcctgtctattgctcaccatatctggaggtatttgaagtttctgtgttttaggtttccaccctcttgcctgaaggtctttgatatcttcttagagactcatgtatcattttcaagctacctttctcccttgcaaatcccctttcttctttcctcgaaagacttagtatctggaaagaactttccttacgtgaatgattcttgaagtgttttctgtaccagcaattctgcatcatatgagaatttgttaaaagtgaaaatatttggtctctaccccagaccaactgaataagattgtcagagggagaggcccagcaagctgcattttagcaagctcttcaggtgatttgtgatctgataaagtttgagaaccccctaccttacatcatatctgccactaaaaccagatgatctgagtagccaggtttcctgcttgatgtgtgaaagggagctttcaaaatatagaaaactcctttccctttccacaaagattggctggagtagactcaaaaattctgttttgaaaattgaatatttcaatcgattatctttttccttgtctttctggtctactaattcaactcctccctgaggcggccaatgcctctggttaaacagagagtgtataggaagtgctcttaaggagaaacatctggtgcttttgaataaatgctcttctatgcactcatgatgcacacatttatctaaatagcacagtacatgcctgaaaccagcaacactatttgctgagtcagaaatttaagccttagcctgtgagacagagactccaatactggattccctttagatctccatggacatttcaaacttggcaggtgtgaaaggaaatttactgattccttatctttctcctcaaatcattctccatttcccaaattcttgaccttggtaaatggctatgaggaagtgactataaagtactgatttggaagtggactgatctggattcaaacaccaatttcagcatccattaactttgtgatctgcaacagccaacgtttctagctatacattttcctgtaaaacagaggaagtcccaaatcccatgggtagtttttaagctttggagaaaatgtatgccggatatatgatatttattatcctatgcttgcccattctcaactccacttagtgaccaaatcactaggcatcgttgtgcattctcttttagaaatgtcttgaattgatcatcgtatccccttcctttcaacagattgccactgttaataaaggtcatcttcattaggggatggcatagtttcttatttcttcctatctctagttgggtcacttcttgggagagccacttatggttttgtgggtttgggagtgcacaagaacaccacatctaaggggcaccattcagatgttacccagaccttataaaggtccctctgcacacttacactaatgcaccaacacacattctcacagtcacacatgcacatgttctcacacagtcactcatacactaacacacactggccttgatgctcacacagacttaacacaaatgcacatcctcatagagactcagataccactccaccacacacacacccactcacattcacacacacttttgagtgttgtgtattattacaacaaaacagtaaatcatgtttctccaatagaagcagtatattaaaacatgttcctgtaaccatattgaagaaggactatctttctttaaatctttaaagcacatggaggtgtcctggggccgctctgctctccactcccatcttttcttcaacagttgctaggatgattctatctgaagcccccactttttcaggcttcctgtgcctaagttcccattgcagctcatgcagactgcattttggccctctcacacagtgcatggttatgccacccgagagggaaaaatgcactgtgatcatcactgataaccaccattatacctggtcaaaaggagatgtgtaagaatgtaagaagttattttgcctactgcatgaataattaatgctagtggcctgttttccatatgtatggaaatatagagagattcagccaaaaatactgtactcttgtacttttttttttaatttggtgattatccatttacctattttaattacaaggaagagctccaaagaaataggaatgttttaggaagaacttgatggaaagtgcctaactgctttttaggactattctgtgcaatatgtttttaacaaaaagagagattccatttatccagcactattttcatcattctgttgcttcaagtggatgagagggttctcttgtctttcttattcttcacccacttttagagtttaacatcttacatttactgagtactctttataggtacgacacattatgccagttgtttttgaagccttgatttcatttaattcttcagaccagtcttagaggtgggttgattctatttccatttcacaggtgaggaagcaattattttgagaggaatttacctgacattaagtggtgcagaaagggcagaacatggcttcaaaactagttttgtctgctttgtgagcctgtgatctctagaggcgtgattattggactttttttttttacctccttaaattttacaaaaaactaaagtgaggaaaagaaacccaaagagaaaaggtaaaatactgttgaataaaacctgttttctgactttttattaaaaagaaatgattttatattatctattgttaattttctaatttccaaaattaactttgtcctgtttgtaaattgtctttataatttatatctttaactgtgttctatagcatggatcctgctaaattctgactttcatgctgggaaggaccctattttccatttttatgatctttgttggtttctttgctctgttcttacaattttgcatatgaattctagaaataaccagataagagaaagcaaagcatagactaggagacttttaagcccactcacagcttcaagcatcatgataacaaaattgaaagcaagtgtattgatttgggtggtattatatttgtctctagggcttgaaaagacctttaatttctctctttttacacaccattttttgttgtaagtatgtttacaaatgaataaatgtcatatttaataaacctaatggagagaagttgcctttaaagaaaccaacagatatgagcatcatgttgtgagcatgtttacatttacgaacatattattttctcattacctactcagttatttagaaatcataggagttagatgctaaatgtcattatatttatatgtgaagcagcatttctaatctccagtcacttctttcaacttacacatctgactttgacctctcacttcccatggcatttcagagttgttacagaatttataatcaaaattagtttggcagcttagaacttattggaagaaaaacatcaccttattctgccgctattatcatactcaagaaaactgctttttcactttgtttaaactgtatttttgacttatagtagatcaatttctccgcatttcaatttacaattatatgtaacatgaatctcaatttttgaaatacctaactcaataatgtatgaaatcatttataaaataatttctcctatttgctttgaaggaaattttaaagagataaaagtgcttccactttcacacacaagtttaactcataagtttaatggtgaccaatattatattcttggtgtaaatcctactaaaattttatctatcctgtaatattaaatatatataaattacacacagtatgtgtgtgttattaatatgcacatgtatatgtgttggtgtttaataaagttggtttctacaaaatttcttagagctacccttagcattaatttactcacttgataaatatgtattgagtccttttgaggtgccaaactcacttctagggaccacaaatatataaatgactaagtgaaacccaattgcatatcctgcaggagcttagaatctactggtagaaacatacaattcaagagcaatgataatactctgtggtgtttctctggtgtagcacatggaagaggcacagtccatcccagggaaggctaaacaagaagcaggagttagcttggaatcacagggggaaagaagattttcagtgagaggaacaatgagcagcttatagaagaaagatgtagtagcagaacctggtgatattttgtctcttagaaattgctgtcatctgtgagagacagtgtgtgtagtggctaaaccaatacaatttaaactgcctaagtgtgaatcttggctcagccacttttggattgtgagtcattagcatcacttccctgtgcctcattttccccatttgtgtgaaagtgggttttagaataatgcctacttgatgaaggtacagggaaaattatatgcgatgatacatgcagggtgtctggaggaatgaacaccagatatgaagagagtccttgtatgtgtttgctaggattgctatatcaaagtactatgaagtgcatggcttaataatagaaatttattgagttactttttcctagcctgcttattatttgtgtgaagagaaggacttcttaatgaatacatgaagcaaaattgttctttaatcttttgctttcagttttacccttactgctttttgtgtttggactttttatctagattgtcatttctgttctttggcatttaaatggcctgctttaagcagtccagacctttctttgttgtctgagactcaatagtttcctgctgaccatctatctgataagttgagtcttttgctaattgtgatctcatagcctactccttcaactttcttcttatcccttctcccaatttttccaatctgtattctttttcctcttctctccttctcttccctttctccttctttccttcctttcccttccctttgtccctatttactgctttgtcacttattttcctgtttcttctgcagcagtaaacaggaaatgcagcttcagtttgctgctacatgttgttataataatactctgaagaaattaatgcatggtttcttcgctgtgacaatataaacttattaaaggcttacgttcactcgatacattgatcatttttctgataactctaaaaaccacaaatgtcaataagtcacagagttgaaacctgtcaacatcactacagttgttagatttgttgtttagccttttttattattgctttttttttcttccttatagctcattgaaattctagttggaaagaatggagcagtgaactatgaagaaacattaattaattttacatgacgtgtgtatgtgtataagtggattttaaataattagtcacaattagtatggtttttaaaaattttagcttagtgatctagaccattatcatcttggttattatgtttttaatgttcagattgtaagtggattaatagtagagtgcacattcatccactgaataattgttgaaggaagaatggtatcatcagtctttttgaggagttttgttcgtccagttctgccatctcactgtaaataattgtagaaatggtacaatggatggctgatgaatcggtaaaacatggagatttcctatagcaaggaatatgtacacctgtcacttaaaatctattattttcttttttctggtttataaatagaggcctgaaaatagtttatacttaaaaatatcctaatatgataattttgttgattatgaataaagagtattttatctaagtcgtatcacttgaagagcaagggttagtagaactaggctctggatttagttttgcattaactaacagtttgatttatggcaaaccatttaatcagtcttgaccttcattttctcatcataagttgaaagtgttaacttctgtgttcctttagggccctttaaatttcatcagttgatattttaatatttttaacaacctggtcattacaataacatctgcgtatgaacccatcaaaggatctaattttagagtttaattttatactttgtagatgtctgaaggaaaaaaaaagggacagtgtcatacataaaaatgcactatgtgctttcattttaaaaatattttatatcactgttcttcaaatattgaagcatcaggatccctttatattcttagaacttgtacagaaccaccacgagcttgtcattatgtgcattatagataccaaatttagcattttataaatttaagcagtacatttagagatttaggaatttattcaaaaacaatagacccattatatgttaacataaataacatatctataaaagaaataaaaaatttttcaaaacaaaaaacaatgagaagaatatcattgtttaacttttttttttttttttttttttttttacaaatctctttagtgtctggcttcttacaagacacctggattcttctctctgcttttactgtattcatactgttgtaatatcacacaacatggacctctgggaactccactgtacagtcatgagagattgagaatgaaaaaggcaaatgacatttcagtattgttacaaaaatagttctaacctatagggacccgttgaaaagtgtctcagtgacccatagatgaccctggaaatcactttgagaactaccattctatattttttaatatgagataattccattgtagaaagcatacttcaaaattcgaagttttgatgtatctttcagttacccaaaaattcaacttgacttttaatggtgcaatgatgccgaaatccccctgtccgtgcatcagtttatttttctactgcctatttgcatgatggttaaaaatatgggtgaaatgattttcttcccttttagcccctgcaagagaccttatctttacatatgcatcttctttactcgactataaactctgtaagaagagggagtattcctgggcagccataaaaaaggatgagttcgtgtcctttgcagggacatggatgaagctggaaaccatcattctcagcaaactgtcacaaggacagaaaaccaaacactgcatgttctcactcataggtgggaattgaacaatgagaacagttggacacagggcggggaacatcacacaccagggcctgtcgtggagcgggggttgggagagggagagctttaggagaaatacctaatgtaaacgactcgttaatgggtgcagcaaaccaacatggcacatatatacctatgtaacagacctgcacgttgtgcacatgtaccctagaacttaaagtataatttaaaaaaagtaaaaaaaataaaaagagagagagaaagtattcaatactgtatcctatctaatttctcaagaaatatgtgttaaatgactgaataaaatagaaaagataggaagaagcaaatggaacatattaacaatattaacaaatttgaataaaatgctaattcttgagaaaattggtaataaatgtctaaatcattctcaaatagaaaaatgttatcaaaatttaattttacagtttgtatatgaatgtattatattctctcaggtacaattgaaagaaacttactgaaagtgaatacatctattaagattaaaattaaatgaacaaaaactctaacaatgtagaagtatatggacttgcttgaaatgatggaaatgcttctaagtatataaaatgggaggtattatcagtattataaactagtaatcataagccctaccctcccctgtcatgcagagttataagtagggatccatagaagacaaataaagagctgctcatactccatttcgaattggaccgcctggattctggtgttgattgcatatggcagtcccatcataaacttactcagcccctctgggcttctatatcctcccacagagaaactttgtaacaatggaaacctaaaatgtaacagctgtttacttacattgagggagtgaatttctcactacagaaggggttcaagtccaagtaggtaggacagttccccaactctcagtttatttcatttgaaggaggtagttggtttctcagactgctccccttagtcctgcccatatctaataggtgtggtatctgtaatgctaaaaattcatacaacgagtagcaaaagttgtgcctagaatttatatgcatagtttgtaccattattttaaaaatgaagaataaggaaaaactatattgaaatcaataatcaccataatggtggttttagaaagttgttcttgtgacctaataatgtggtgaagagattttgataagtccctacacccagcgtgtgtggatataatgtcattatgatatgtattattatactgagatgcagagattcatttataatttacaaataaattaattatgattgaaaaaggcagaatattttggaagctgtgtcccagtgactgtacaattttcccagaatctcctaaatgataaaagtgacttataaaaatcagttttacaaaaggtgacactgtttagtaacatacatttgcaagtttcacataatagaaaaaaataatgtattctttatttgaggagtgaagaaatctatctgcatgtaaacaggatatgacattccttgttgctaacttaacaatgtgattacagtttacatatttcttcggatagtggtgctttactagtaaatgactatttatccttttgatacacaaacaagggcttattttatatgtagatgccataaggattactcatggagtttcagaagattttgagctttttttaattaggaaaatgatcagacatacagaaatattggaagaatgtatcatctatatagttatcacataaactcagtagttgctagtattgtgccccatttgattcatccatacatttatttcatgaaccatttgatcacctgtattttcagtaactggaaggttaatctaaatatgtgataacgaccactttggaaaacagttagccagtttcttactaagctaaacatctctgggcattggtatttactcaaacaagttgaaaactcatactacatgatcacctgcatacatatatttaaggagctttatgcataattgccaaatcttggaagcaactaatttacccttcagtatgtaaatgaataaataaactgaggtacatctaagcaatggagtattattcagtgctaaagagaaatgaactgtgaaaccatggaaagacatggagggaccttaaatgcatattagtaagtgaaagaaattaatctgaaaaggctacatacagtgtgattccaactctctgacagagtacagaggggttttaggccagtgaaactattctgtatgatactaaataatggtagatgcatgttactgtaaatttatctaaatacatagaatgcacaacactaaaagtgattcctaatgtaaactgtgggctttgggtgatagtgatatgtgtcaacataagactcatcagttgtaataaagatactactctgcatggggatattgatggcataagaagctctgcacatgtgggggcaggaggtatatgagaactctgtaatgaacataaactgctctaaaattaataaagattattaaaaataacgacatttattataacatttttgagaagaatactttacagatgatattatgtactttattttatgttacattagaggatatatgtcgccttatccaactattaatgatagtaagtgtgagtgcttgatggatcatcttaatacaacacataaatattgatactgatttcaatttctttggtagcaatttaaatatctaatcctccagttataatttccataagcaatagaaactagccactgtgaatgtgtgttctttactgacacagacctgcctttgactattttgagtggttggcattttaaagacttccagctgcattagaatgacaggaatgggatttactctcctgctttaactagaaaattaatgaaaatatatggaacaatagtttcagagattgaacaataataagcaggacaggagagaaatttatgagagatgggaaacaaggtgagctccgcgactccccaagcttactatcgggaaggaatttcaaaacagtgcggggaaggggagcccaaacagaggtgtagtatttttaaatagaagagaaagacttcgaagttcagggaggacgaggcagctggaatttgaggggtaaaatagcatagaggaagaaactacctagagacagctctggaacactgcagaggggttcagtcaagtgtttggtagattactgatctatgcttgactgtgatgaaactaggtaagacgagggaattgatcaatgtaaaggagtatgtagagcaacttcaagagttcatgcaggaagagaatgactttgttcttaccagcaataggacaaaacccttttatgcaagacagcaggtagagtcctcagaaaagtattacctcagtagtatggtcaaattagtcccagatcaaatgctcttctggacttcccttaacaaatcttataagcatttctcaaaatgaataaacaaatccaaattgcttagctatatcccagaatatagtcctataatatttaaaaggataaaccaaaagtccccaaaccaacattgtacaaattgcagtatcttacatgcaataaaaaattactaaacatgcaaggaagcaggaaataagacccataaacagaggaagtaaaaatcaatagaaaaagtttcagatagcactgaatagaagaataagagacaaagatgataattaggtattgtaattatactccacatgtaggacatggaggaaaacatgagcttgatgaggagaaaaatgaaagataagaaaagatgcaagtcagtctcaacagatgaaaaatatataaaaattaaaaatacactgtatgtgagcagtaatagataaacacttaagaagaaaaagttagtgacttgaagacattacactagaaaataaaaaaatgaagcagaaaaaagtactgaaaagaaaatgaacaaagtatcttctgtgggaagatgttatggtggcatatcatacatgcagttgaggttccaggaaataagggggacaagcagaaaaataataaaatacgtgtaaaaattttttccaaatgtattgacaattacaaacccccaaactaataaactcaatgaacaagaaacagaagaaacatgaagaaaaccataaccaaagcacatcaaaataaaattgctggctgggtgtgatggcccactcctgtaatcccagcactttgggaggcctaggcgggtggatcacctgaagtcaggagttcaagaccagcctggccaacatggcgaaaccccgtctctactaaaaatacaaaaattagctgagagtggtggtaacgcctgtaatcgtagctactcgagaggctgatgcaagagaatcacttgaacccgggattcggaggttgcagtgagctgaggttgcgcaactgggctccagcttgggtgacaggtgaaactccatctcaaaaaataaaaaaaaacaaataaaattgctgaaaaccagtgatgaagagaatattttaaaagcaggcagagaaatcaatgcacaaatcatacagaataataaatataagaatagcagatttcttgtcagaaactacacaagccataagacaatggagtgactattaagtaaatttcttggtcaacacagttttagctgtattttacaaactgtaatgtattttcgttttcatgttcagtttgaacaacttctgatttcccttttttcatgtcttctctgttccatggataatttagaaatatgttacttacttttcctgatacctttctcttgttagaaatctcaattttccaaaaatagatagcatgtagtataacctgtattgattaaataaatttcatagtttaaaatctttctaccaaacaaactaacaaaactaacaaatgatgagcaaacaaacttcaaggctgtatgtcttcattggtgaattctgctaacatttaaagaaagtataatgtcaagtctacacagatttttttagaaaatagaaaaggagagaatacttctcaatgtattttatgatacaaaaatcagaaaaattcataacaaaaacataaaactccagaccaatatccttcataaatacataatacatatgtatttgtataaatacatatgtatttatgcataaatacaaaactgtatttatttatacataaatacaaaactcctttttaaaaatttaataaatcagtatatcaataaataaaaaatgtgatacatcatgaccaaataggatttatcccaaaaatgcaaggttggctttaagatttgagaaatcaagcattgaaattcaatatattaacagatttttttcaaaaggaaaaaggatttgactaaatttaggacccatccatgatcaaagttctgagcaaactagaaatagaagggaacttctgcaaactgacaaagggcattattgaaaaacatgtagttaacatcctccaatatggtgaaatgcttttcctccaagttcaggaacaagacaaggatgtgcactcctatctagcatttttccagatgtcctagcctgcctagtaagtttttaaataactaatacagcttgaaaaagaagcagtagagccttctaacatgatcgtttttgtagaaaatcttgaggaattacccaaaatctactcagacctacaaatcggtttaccaagttagcagtatgcaagattaatgtataaaaaatatatttttgtgtgctagcaatgtaattaaaaatttaaaaatcaccattgacaataggatcagagaatacgaaatatatacacataaatgtaatagaatatatattcagtctgaacactgaaaacagcattgctgcgaaaggttagaaaagtttcaaataaatagaaaaatatagcatactatgagttggaagactcaatactgtatcagttctgtaccaagtgatctattgattcaatgcacttccactcaaaatatccacaagtttttctgtggaaattgacaaactaagtataaaattgatatggagatgaaatacaaagtttgaatagccaaagtaatttgaaaaaaataaaataaaattggaggatgtacaaaactgattttaagacttaatgtaaagctgcagtactctacacagtgtggctctggcataaggtagacatagattagtggaatagaaaagagagtcaagaaatagctcatatataaccacatacatggttagtcaattttcaagaaattaccaaagtaattaagtaaggaaataataaccatttgaaatgatgttgaataattgccatccacatctggaaaataaaccttgattctaatgtcacaccatatgcaaatatgggtagctaaaaccttgcaacttctagtagaaataatggaagaaaatcttaactttggttatagcaaagatttcttaaatagaacacagaaagcagaaacattaaacattcgtcctctccaaaagacacaggttaaacaaaataaaagccacagactaggaggaagtattttaaaaatacatatctgataaaggatttgtgttcagaatatgtaaagaactctttcaactcaatgataaaaagataaatgactcaataaaccagtgggcaaaatatttgaacaggtatttcaccaaaggggatacaaacaaacacctgaaaatatgcttaacatattactcactaggaaaatgaaagttacaaatgcaatgatataccactaagcacacacttgaatggctaagcttaaaaagacttccagtccccagggttagcaaccatgtgaaacaactggaactctcacatatcactaaggggagtgcaaaaatggttcatttatattggaagacatttcagcagtgtcttataaaatgaaacatatacttcctatatgaccagtgttactattctttttttttaagctggagcctcactctgtgttgcccaggctggagtacagtggcacaatctcggctcactgcaatctccatctcccggattcaagtgattctcctgcctcagcctccagtgtagctgggattacaggcgctggccaccatgcctggctaatttttttagtatttttgatagagatggggtttcaccatgttggccaggctggtctcaaactcctgacctcaagtgatccactcacctaggcctcccaaagtgctgggattactggcatgatccatcacacccagccagtgttcctattcttaagtgtttttccaacagaaaagaaatttttattcacaccaaggcttatatgcaaatattcagagcagctttttttttttttaacaaaaaataatagtcaaaaaccagaaaagaactcaattgttcattagctttttgctgtggtaagcaaatgtgatatgtatgtacaatggaatactgctcagcaattaataaaaaacaactatcaatacagataactctcaaaagcattatgttatgtgaaagcagctagctgcaaaagatcccaggttgcattttcatgtatataatattccaggaaaatcaaaattattctgataaaaaacaaatccctggttgtcaagggttggagagagattaagagcaaacagatgcaatggaactttttggggtgacagaagaattctgcatcatgacagttttagtggttacatgacttgtaaacttaacattcattaattttactgctcataaattataccgcaggaaaaccgactaaaaataagatataagaatctatcttcagacaaatcctaacaattatactgacagttgtgtcactaagaatatttctcactaattggttcagagttgtgggctgctaaatggattaaagcaaaccaagaaaagagcttaatattattttagaaaggaaccgttgaaagataatcctggaatatagccacataaggagattagcacatactcgccaaaaatttaaatcttttgctatttaatgaaatcaggccaagcagcagcacttgtcagtaattataccggtggtgacaattcatatgtatatgctttatggttttgaaagtaagttaaaatatgtaagctgaaagactcaagggcctgagacacattctggccataggagcaagtaaacaaaacattttcatgggtgcaagatagatggcatcaaaaattggaatgccgttcagaatgcaaaagaacttccaaaatctttacagtcattctgctggtctgtctgcttttcctgctcctactttctgacgatctcttcttgggtatcttacagtcttaactcactgagactagatttgctggactaagtaagtcactgtgatatagaggacctcattgggaagagttcttggattagatcacctttgccagggttaggggttgtttggggccaacagtcctctctggtctacactgttgtaatgaaaatcaaatggcgaatgaacaaacaaggaaatatactagcattttataatctacaaactatttgtaaattatttcatctaattcctctaacagatattataaacttttctttaacagttgtgtattttcagctctttgcacagtgagctagtcttggtagatgctcagtaaatatttgttaaatgaattcattaggagattaatgaatggattgagggagatgtgaatatatcagtgatgtcctcaaaagttgtatagcttggccaagttcagagagcttggcacatgttaaaggaaaggcagtggaggacagtaagcaactaattatacaggttttgcagtcatatctgcaccttcacttgctgagcctctgtttatttcatcggtgaaataaagtcagttgcatttctcttcaggattttaagaagttttaggtgataaagggttgctgtttgcaaacccaagagcacataccagcacttaggaacttcttaattaaaattcaggatctctgattataattcctgtgattcttgtcattacactgtgcttctgaaatatgagtgttcatttagtatatcaaaagaagaaaatgaacacaattttcatcttgggagaaataaaaccatacagtttctttatttcatgtttcttctgcaaattttgcttattactgtttttctacttgtggttgcttatgtaattctcttctttgataactgaatgatgtatcttcccaaatttagtaaaatataacttatctagaaactacatacatttaatttcaactagttataacggccaaagtccaggatgtgaagaaaataagcaaaatacactttcacctccccccaccaaaaatgccataatgtgtatgatatatgtataagtgtataaaagctcatgcatttgactcataagagaataatttgggctttacttagagcttgttgactctttttgcatgtaattgtattaagctgaatgatctgattttcccacaaagagcagattaaaactagccaattaaaaggaagcaagagaattgacagcagtgagaattaacaataatttcccacaggtattactcttcagtaactttacaatacaatgtttatggcttcatctaagatgtaaaatattaattatgctaaaaatgcttctttaataacgggttgtgtttgtgtgacacaagtgtgtcacacaagtgacacattgtatcttcttaaactatcttaaacataaataactcagaaaatattcctttgttgagcagcatttatgaagccctgcaaattgaattagacttgttgaaatatggataatgatgattctgcaataataccaatgtgcaagcctcactttttgatttttcagaacatactgaaattctattattcagtcctcaaccactgatttattgagagctatttatatgtgtcatacagtccagtctctccttagcacagatattgggacagactgattccaaggcatactctagaaatgggaaaatataaatgtttaatagaataatctgtaatttataacctacaaggaacaaatagctatgtgatgcatgatgacctctcttgtatgcagatggtttttgttctaactggaagaacggaattgtagcattttctaaataatgaaacatgctcccatgaaccacggggtatgtggtgggcttttattatagttttaacttctcagcctcttatgcacatttcctttgggggattcctctcagtatgatttgtggtagagacggggtgtggcttcagcagtggttatcagtgctgttctcttagtatttccagctttctgtcttacaggacggaattacctgaccgccttctggtagggtgagcctgtgactgctgtgggtcagtgagatgtgaacagcagtgatgggttttttccagctggattatccgagtgctggtgtgagacccactagagcagtacttaacctttattgttgttctcagggctcctttacactgttaaacatttttgaggattctaaaaggatgtagtttacgttagttatatctattgatatttattgtattggaacttaaaactgaaattataaaaatatttattaaattatttagaagagtaaaataaacccattccacatcaatgtcagtaacatattcatataaaaataattatgttctcaaaaaaaaacagtgaaaagaatagtattgtttaccatttttggaaatcttaatttttaactcaaaagaagacagctagattttcgtatcagcttctgcattcaatcttgaaatatctcagtgtcatgaagcctctggaaaactccactgtgtgttaattagaaagctaatggagaaagtgccatgggaaaatactaggtacagcagcaaaagaggccaaagagctgtggtaaaacgagaggaacttggccagccagtgccggttcccagatggaggcccacgggcaacaaaaagagaggcctctgagagcagagggtggccaccagccgacagcagcaagacaatgaagacctccatcctagaaccacgtataactgaattctgccaacaacctggatgggcctggaagtgggttctcccctatgcctccagtagggtatgcagctttactgacaccctgatttcaaccctggatctacagggttgtaaggtaagaaagaggtgttgttttaagccacttctaccccaaagcaagcaatgtataataatttatcatattaataaactaaaaaacaaaaaaacacgtttcatctctatacatgtagaaaaagcatttgacaaaacaccaaatccttccttcataaaaatcttcatgaaactaggaagtgaagggaatttccaaaaactgataatatgacatctatgaaaacccgacatagaacatcatatttgctggtaaaaaatgcaaagttttcttaaatatggtatcaaaagcacagttctaaaaaactaaactgaaaccttgggcttcattaaaatttaaatcttctagtctttgaatgacactgttaaaatttaagccacagactacaataaaatatttgcatatcttatatttgataaaagacttgtatccagaatatataaagaatctgcaaaactcacaaataagagcaaataagccaaggaaactcaatgacttgagctaaattttaaaatagggttaggttatggactgaaaaaccaagcttaaagggagaagtgaattataaggaagaggagcagcattaaaaatattacggagatacggccaggcatggtggctcatgcctgtaatcccagcactttgggaggccgaggcatgtggatcacctgaggtcaggagcttgaggccagcctggccaacatggcaaaaccccatctctactacaaatacaaaaattaaccaggcgtggtggcgtgtgcctgtagtcccaactacttgggaggctgaaggaggagaatcgtttgaacccaggaggcagaggttgcactgagtggagatcatgctcctgcactccagcctgggtgacagagcgagactccgtctcaggggaaaaaaaaaaaaaaatatatatatatataacatatgtaaaatatatataatatataatatatataaaatatgtattatatataaaatataatatataatatatataaaacataatatatataatatatacatataatatatataatatataatatatacacacatacatgtatatatgtcaaaaaatatatgtcaaaatatatatatgtatataggagatatgaacaaagtcaaagtttaaaaatatatagttagttcaccatagtttatgcttaaaatatctgttcttagtcttgttatccataaagttaatgggtatttgtggtgggtagacattactatttatttttcaagcgtatgataatcaaatgagatcatttctttcagtttataactgtaaattgccattagagatattatcatcactaatatgttattgtaattattatagggtattattatcatcaatatattattgtaattattattattgaagaactagcatatcattataaaaatgcaacagaaacaggcaaataacatctaaatattattatgaaaatagttttgaacttgcagatatccaggaattcccagactccactttgaggactgctacgccaggagttgttctttctgacatgataactagatagagtggctatctcttctggagtgaacacaacgtgtggcagagttcccagctaatgtataatgggacatttaaagagagtgagaaattaagttgttatgtgtttttttttttaaccaccgagattttgagagtgttttgtggctacagaataatctagtttttccttttatagtttccaaaacaaaaatgcaaagggccagacactcacttttttgaagctttagcaaccagaggtgagcataagacttatctgcagccaattacatactcctatctggtactttgaatgaggagcagatgtgaagaggaggtacagatgagagtttattctagtagttgtggtagctgtagaaacacccaggtaccagtggcagcaaagtcagttatcattagcaatggaggctctattgccagacatgtattaatgtctgatatttgacaaaacaagtatcttctcttagttcttatctgcttgtgaccttggttttccaatcatccgataaatactctccttgcttacattatccagctttctattctttgcatctaagaatctcagctagctttgtgcagtccgataaatgaggttttgctctataagaagttaaaattcagaactctccaggggtctccagacttctttgatcatagtccgtatcaagaaagaatgtgtacatgtaactccaatatatttctctgctagagacttggatcacttttataggtcagacaagtcttgctgcatcagaataccttattctaaaatgtaacctcactattctaattaaatgcaaagtcagctgtctgatggaaatgtaaaatattgtatataagtaatatacaaaaaaaattgccgtgcattgaataattgacactattgattttgcttcaccaataagcatcttaaaatataaattacaaacatgcgtgaggcaagtactatcacagaattttcaagactgatgctttgcagtggatgataggaaaaataatacagagataacattaggatgcaagctgtataggctttgatattttctgacagaggggttctggggcatggagtgagttcctaaaaccactagtagtttgagttgaaacgtcatttgaaaaagacatcacaaagttcctatggcactgtcggcctgctgcattgaagaatgactagtttccttttttgttgtattcttcatttagaagtagtgctgctttaattggcattttaggattaaaatttattaaaaggagtatgattaaatgtaaaagaaaatatcaacacattatttttcaaagtcattattttcaacattttagaaaaagatcttattttttttttttaaaaaaaaatatatatatactaagacaattagacttccccaaataccataaaacagacctttggttttttacttcattgtaaattactgaaattcattacttaattgtatgctatgaaattctttgaaagttcatgattactttcaagttaaatttcaagttcattggaaaaaatacacaaagtatctgaatgcataatcttacataattttttccagaattttaattttacggtgcccataaataatccacttaaagatggaaaacatactgtgcttcagggaagtatgcatacaagttgcttttatcataaatatctatttgactctaaaggccaaagagcctttttgtaaaaacggttagaattgtcggggtaaatccttttacctatgtaaattacagaacttgttgcagaataatgtatatgtttctccaggcttctctggtgggtgataacctgatagtttttaaaagtgcatcagccacaatgcacataacccatctcaaaagcatcttgatattcctgatgcatgaaataactgttttgaatgactggcaaagtgtatgagatggagatacaacagtcagggaaatacacacgaacagaaaccaccaagaggactgccagcaatttcattgcaccaagtgtttattcaactgtggaaagatcatatttggcatagaaagtacattctttacagaagctgactatattgttcaacagataatttgcctttatggctgatccatttagacttaagctggaattttcatgacacaattcatttgctgaaagcatattgttgaaaatgtgaatactttgaagtgccaggttaaaaacatgttttagcacgatttctgattcaaccatacaatactggatggtggaatagttgagtaaatgattggcgacctggttatctttctgagttgtaggttctgatggttcctgacttgacttatgttgtcagaagaagtttctgaatgagattatttaaaaagatagagttagtaaagatggcttgatatctatatggttcttttctttgttttgaagacaacgtagtcttcttttgaaaaaaagtcctcaaaatggatatcattgatagtactagtgtgccatcttctagaggaagaaaccaagtactaggtaagaggagaatgtgggattctcaacgataccagagatcactcatcagttcagtgcagagtactatacctatgctcttcaggagaaattgatagtatgccagttgttagcatgagagaattttatatacggtaatatgacacttaacgatggagatacattctgagaaatgcatcactaggcgattttgtcattgtgtgacatcatagagggtacttacacaaacctagatggaatagcccactctacacctaggctatatggaatagcctattgctcctaggcttcaaacccatacagcatggcactatatggaatactgtaggcaattttaacacaatggtaagtatttatgtatctgaacataccgaaatatagaaaaggtacagtgaaaatatggtgtaaaagatttttttaaaaaggtacacctgtatagggtgcttaccatgaatgaggcttggaggactggaaattgcatcgttcattgaatgagtgagtgatgagtgaatgtgaaggcctaggacattactgtacactgctgtagacttcataaatattatatacttaggctacactgaatttatttacagttatttttctgcaataataaattaactctagcatactgtaacttttactttacaaactttttaatcatttataatttttgactcaagataacacagcttaaaacacaagtacattgtacagctgtataaaatgtttttctttctttatatctttataagtgcttttctatttttaatgttttttcttactttttaaaattttgttaaaaactagaacacaaacacatatattagcctagccctacacaggatcatcaatatcactgtcttctccctccatatcttgtccagctggaatgtcttcagaagcgataacacacaaagagctgtcatctaggataacaatgccttcttctagagtacctcctgaagaacctgcttgaggccatgttacagttaactttttttattagtaggagtacatgctaaaataatgataaatagtatagtatagtaaatacatacaccgtactgtaagtacataatattaggtgctagatttttatatcactggtggcacagtaggtttgtttacaccagcatcaccacagacacttaagtaacgcattacactaagacgtcacaatgactaccacatcacggggtgacgggaatttttcaggtccattataatcttataggaccatcattgtatatgcgatccattattgactgagacgtctttatatggctcataactgtatgataattaaagatacatatgagaactttcttgctgataccgtttggatttcttctgatctcttccattttgagagcctatgaagcagcaaatagaagcctaattacatttctgttctcctcccattccccccagaatcctgacccttgggaatgggatctggagccagtgggaagcattctccgaatatgataatgtggttatcttctgacgagtgctggcattatcacttgttgctagtgagcattttttaataaataatttttgctcttgaatcttagaaatctttaatatctttaaaaccttgactaattgatttttatcatatgttcaccctcttggttgatttagaaaaaacaccaggcttgttctgaggttcacccgactccactgcatgtattacgtgcatgtgtaccttggaatggaaaatacatgactaagccctgtaagttatgagctttccagacactataattcaggctggcatgctttcattttgtcccttctttcattcttttctttctgcaagagcttcctacataagaggatgaagccattgtcattttatagactttgaaagcttatgctcatcactgaaaattcatggcttgtcaagctgaactgcgtgggttgttttgccttgtgagccacgtgcattaacactggctgtattggtgatcacagagactgagggcagcatctttattgggatagccagcagtgctgaatcaatcacgtcctgttgtggttggatctgtatgcagattgtctttgcacagcatgacttaataaaagctggccatggtggtattttattataattatgatgacttagttgcattagcatcagcctcaatcacacagtaaaagaatatttggtggctgaactaggaagtgtgagaacctccatcatttgactacttcagatggtgtattcatgatccttgaattaaaatcaggcaggtaaaagggttttcaatgaaaaaaaaacatgaaaaaggagtttgaaaatatataactactaaggaaaggaaaataaagccttgaaaattggtatcgcataagcttacgtggtatcattttgtcgtttaaaaaaatgtgtctctcagtctttacttagaaatatgtatggaactttatttaaaagtttcccttaaatgtgaacttatgtaaaatccttgtttagagtctttgttaggctaccatttcagaataataagattttacccccatgcatgtgatccaaagcattacacctctccaagccacctactaatcttgtctattcaaatgggattttttttttctaaataggagacaactctgcactgtatcctgctattcttccaactgcaggacctcatggagcgagagatccaaacctttctgaagtactttaccttctacctttttcatgctactcaggattgaatcaattggaagccaacaaagccattctgtgttactgtgcctcctgactgtcagcacgctgcactgtgcatttagataattctgccagaaggcatttttataaaaacagctttcaaaatctattcttgaaaagacatttgtatactcattatgccattctatcatttatccatagggagttctgtaaataaaacactgaggtctaatactatagtagctgatggcagtaatcttgaacagagtaatttctttttctttatttatctcgatagtgcacagctggttatgaaaaaataatcacaaggctttgttgttggtggtggtggctgccttttttggacagtaagccgtgatgactcagagtctctggtagaaataattgctttttattttttgcatacacctgtcccaaacctcttttactctaagataaacaagatggaaatagatttaccttaaatagatgaccatccacatattgccattttaattacataattatgatttatctatatcttctaaacgttaagcatttgtgagtgggtgttttgctatatgacagaattagaaggtaaatcctgggccgagatgtgaaggacgagcagagctttgttgccctctcccagcataaggaggaatacacacagagatttggagtatggaaaggaatgtggttagggaaatttaacttcttcagatggctgttttgtcaggtacctgcagggggcagagttgctgaaggttcaaatgcataggcaggaacctgattgagggcatggaacaaaggatatggattttattcaataggattagggaccattgaggtattttcttcaggaggtatatgatgtgatataatttacctattttgaagagtgttccagcaacagtatggaggagagctattatttaattatctttcctggtcagtttaaataatcatagcatcattggctgaagtgcaaataaatagtataccaaaaaagcattgggcaaaatgcaaataaaatacattacctttataaatagctacatgctagctcttaacacagatcattattttttaaaatttaaaccactcaactgatctcatatagaccaatctttagctgttaaaaatatgaatgttacaagctaacccctaacttatacctttattaaaacacaagtattgaaaattttaaaagaaaactaacagtaacaaagacacacattttttcaagcaatttattatgtgatgctgacatttttgagagaccttagacaatgatttttatttactaatgttaaacattacaaagtaaaattaatataagtaaaatagtatttttaaaaggtagatcacaagaatatactattagtagtaaatatttaaaagtacccccccaaactacatttcattactatattctgtcatccaggtacataccttggaaatgttttggcacagagtatataataacaaaaacaaaattggataatggcattgttctacctttatatctctgattttttaacacagcagaatttaataaatgctatgtgtctgcatataaatgtatgtgtgtatgtatttaacaaacaccatgtaggccttattatgtgcaagatactgtcatcagcactttttttcagttattctcatatatttaaaagaataaatgaaggcacaaatgaaaataaagaagatatggtaatcatatagctcattaatgttcagatatttttctccactaccacaagactgatcactttgttgtctgaattgccatgctgtctacagacccctcatctagttacaaaactggatgaaatgctttatgcttggttgttttcatatacttgtcatataattctgtttctgggtgttgttattaccagaaaggttgataatttgcaaaataagtacagataagtgaaaagagttcttttaaaaacctaatcttttttcttataccccagggagaggcagggctagagaaagagcaattcagggtcctctgagtgttctcttcattgcgatactcatagaattaactgtgcttttttctcttttctggattttgtatattgtatgactgacaaaaccacccctatttatctctttttttttacccctttgtgtatgcatatgtggttttttttgttctcatatatatgagaacatatttcatatatatttaaatatttaaatatatacatctaaagatatacatattaaatatacacacctaatatataaatacataaattatatttatatttgtaaatttatataaattttactcatggtaaatatatgattatcattcaatcaaaatatggaatattaaatgattaatttacgcatatatttccataatattagtcatctaattatatattactctttgttaaaacttaaaaggcctggaattaaatcctggcttgatgtatgcatgaagtgattaattaattcatttattagttaaactcatattttctgaagacttgtttcatgctagtgggagcccccagagtatcacaagtttagtgggtaagacaccctgtgtattaagaattattcaagtgctcttgtgcagggacctacctaactaactttcacaaaatcattcaaataatctaaagttcattgtctttgtttccctttgataaagtgaggataacagtatttgtcctactacctaggaacagagttctaatgctaattaaataggataacagatactacaaagcacttcctaagcctgaaagtgctgtgttgtataaatgatttagtagttcactgcttctcaaagctgattatctactagtttgttctgcataagaaactgaaggctgcttccctggagtttcttccagggaatgctgcgttgttttcatggggtaaaccacacacatcttccttttcttctacaattttgcaaggcagttataaattgtcataatcttctctgtcaagatgagcatttcaggtgtatatacctgttttatacataatatagttttaaatatcttgcagttgccaataatatcctctgattattcctgttttaattttttaaattgagactatttttagagcagtttacatttacagaaaaatagaacagtaagtgcagagagctcccatatacccactgtcctcccacacacggcttcaagtttgttttttaatcacatgtggttgtcggaattgtacacattatcccagatgtgatctagaactaactttctgtgatgctaagtagagggagaagtcaaagatgatacccatggtgtgcagtgccattgggatgtcagtcatttactcatttcagtctccaggaaaaagtacagacgagtgagtagagaatgatttcagtttttatatattatgtttgaggcatctgtgagatacccatgaagtcaggtacatgaggtacctagtgtgagattgtggctctcaggaaagaaagctcttaacagatgaagtgatggtggagttattagtgcaaagacagctgagatccctgaaaagtggggttgagcaagagaacaaagaggacccaagagagggcatagaaaaaactgaaggaacaacagaagatggagatgtttcaagaaaaatcagagttgtatttgtttggtttggttctctgcagaggcaaaatgaggaaaagggtctttgcatttgatttggccttactggcttcagtggtcttagcagagcattaacatcacagactgaagctggttcgagagtcctgagacatcaagaaatagagacagttgctacaagtgagttcagaatttggaatttgaaaaagagaacagagttatccgtgtttgcaaatagcactgaaaatcaggaagttagaagttaactttatggccagaattttggaggatgttttatctactttcagctggactctcttttatcatcgcaggtttcttcttggcactttcctcgctagctgccagacaacatgctctgatttttactcagtcatgtattgtttttgtctccccaatactagtagaaataaacatcccatccatgtttatattgattctaggttttaatttttctgtttgaatgtatatttcatttgcttatgtgtggattatagtgtcatttatcaattataatttccattaattctggaatatttaattatattttgttaacatttgtgatatattttaactctgtatttagctccgtcaataatgtctatcctttcgacaatacaaaattctaatgatattataaattcatgcagttatacttcaaattaattggacatttaacccatgaaaaacctatatataagacagtcattgaattcaaaatacagaacattcaataaagcgttagttttaggatgctacaagtgtacgatgatacaagcgtactttgtggtattcaagcaatcttgtaaaacatgccaagcagcttaaatgagcctactaaaataaaaaatattaaatatggtaaaaaaattatttaaaaaattatttatatcaaatgttgcactaatggggtaagtaaaactttattcttttatgctatggctggattataaaataatagtagcataatataatttttcacaattataatttatataagaaaaatattttgttcaagttacagaagaattttaattgagataatattacaataaaagtgcctataccacagtcttaagtctagaaccagtcagggtttcaatccaggctttgtcatttaggagctgtgtgtccctgggcgaaccataaactctctgatcctcagtttctgcatttatataatagggctaataatggtaactacttcataggtatttgtgaattttaattacgttaatatatgtaaagtgatcggaataataattgaatatgcattacttgaatctaatctctcccctatttttgtttattgactcagtctacaagtgttccttgagtacctaatgcatatcaatcattataatatggtcttaatacttaaaatggttgcaggtgtacccttgagaaagctcacagtctggtaggtaagagttatatcaaacaattaattgctacaaggaaaaagttacagtgatattacactatgtaagagggtgtctctcctagaactttatcacacaaaaaccacccttactgaagagctatagtaaactgagaccaaagtatgaaggttttagccacctgagagggataagttccagggaatgtcccaggtagacagtagagtgtctgagcattcagaagatgcatcagaagatgatggatgaggataatgttgttaaagataaatgcactgactgaagagaaatacaggtgtgatgtgaggcaggagatggaaaagagaatgatctcatagaacccagagttcctgttaaggatagtaacttatgtaccctaaatcattttggttttgttattgttctcctactatcataaaggtgacattattagatttgtatcttttaatggagggggactttctactttattgtgtgaatttggcttaatgagcatatgtataaatcctataagtcttattatgatggttattctgactgatatggtcagagtatgatatggggaagattaattgaatggtaaaagtgggtgtggagaaatgaggaggcaatttagtaatatagaagagggatttttagcatcctggcatagaaggatggccatagaaatgaagaaaagaagatagattttagaatccctagaagatgtaattggtaaaatgtggtgataggtaggtagaaaaagagatgagtatactatgttttcaaggtttctggtttacacaaatgagataggaaatataggatgagatatagccttagctataggggagttcataagttgagcatgagacttttttttttcaaattagttcttgattactctagaacttagagcaaactatggactgtctacataaatctaggagtcataaaatagagatggaaattgaaaacatagaactggattgagttatggagaaggaaagaatatggaataacaaagaaaagcgcttaagagcacctactgccctaaggaatgcgggcatttaatgatcagttaaagaaggaggaactaataaaggaagctaaagaggaatccatgggaatgtggtgacttagatgtctaagaaagagatcagaagtttgagaagaattgagaatttcagataaacatgtggattgccatgtgttagtatatcctgctcaagggtggtatccataaattttatacagatataactgaactctgagatttttccatagtacttagaagctaagatgatttgtatctgtttagggttggagctacttagggcacatgtaacaaaagcttgaaaatataaacaagtttaggttaatggtagagatacagctgctttgatgaaccactgaatctaagttgattggtctttcatcattattctcatccatcatcttctgactaaggatagaattgaagtcagaaagcctgatagaaatgaataaagtctaagttgttggtaaaaggtgaatgattttcccatctcatcatgtctcaatcaccacaaggacactgtcttgaaagaacgttgtctctccattcagttcttgggaagaactataattaatcatgttgatcagagctggacatttgttgaaacaagttttgctagcaagctaaaatattgtacctccaaagcaagagccagtttggcttcttcctttttaactatctggcttcctgctttgtgcttcatttgcttctcctctgcctttggtgaatgatattttgcatcatgtctctctgtgagagacaaagcttgtgaagagggctcttcagacacaaaacatgctgattctgaccccttcatccagcaaatctgcatgcttagccacgcagctgggtgggtaggttcacttacctctgtgagcagttccaagacctagattcagagtgggaagatccctttcaacctcaagtctaaactacattctacaacttgacataatgaagagattatgaatggtgttcctgcctgtgtatgatcccaaatagtgagaccttgactaagttacctaacctcacgattcttcatctaaaaatgggaaatgaataacactgtcacaggttggtagtgaacattgaacaagttaatacagggaaagcatttacgcagtgcctacagcatcacacttaataaatcttagtttataaaaattattgttttatcagagagcgttttatggcagtttagagagtccttagatttatttttaattttttaaaatttttatttaaagtattttgttttattctttctcatttgattggcgatccttgaatacgtattcctcctttgctctaggggaaagagggatagtgggaagtgtggacactctgaacctctaagagcagtggaagaacaggtatcctaaaggtaactgagcagataaaaggaaaagacaggaagttggtcctggaagtatgggcagcatgaatacgtaccatgctagagtcatatagctgggaagacatggaacccaaatttgaaccaaagactcaaaaggctcctaagtcttactcttcccccaacactatttttcagttgttttcagtgcacctaagaaaattaagtggcagtcatttattaagccagaataaaaaacaaagttgatttatctgcatgaaacttgaattacatcaactagcttaatttttttgttggagtaaaaacaaagctatggaaacagatgaattcatcgcttatttaaaaaaccagctcttgaaaatttcatgtttgttatatttattgttgtagtactttgtaagttgtctatattcagttatttaactgagtatattacctattcagcctaaagaaataaaaggaatatagtattattgtgataagggagaaaatttatttatctaggtacaaggaataacatgggatgttaattttaacatgtgcattacccaactaatatagcttttgtttcctttatcacatttttccatacttcctaccctacacaatttgcctcgagtatttaaatgtggaaaaataacggggtaataaggtaacatattttttcaattaaagcgtggtaaaggattttgaattttttaataaagaattttacttttttagtattaaacaacaaaatattgagatacctaagaaggtaatataagttgaagtactttataagctttaaatagtgtatagctgtaagatgatactgctattaaaaaaataagtaatactatttatataaaattctcaaatttctcgagatatatctaaattattttcattataatagtgcatttaataatcatatcaaattacatttatatccaaagcttgttggttaaacaaatacatgtttaaaatagttgagcttgtgaaaatgaagtttggctctatttaatcttttgggatccagatgcaacttgaaaatggaaagaaatcatattaatttaaaatattgctatgtcatacatttttttaagttgattcagaaaatccaagtgccatcaaatgaaaaatacatctagattgtaactatattaatctagatatataataaggcaatgctgcttttattttgccttacaatgaatcattgctcagttatcatatattgaaacatactattggcaaaccatacaccaattcccagcagttttcactggagacagtgttacaagaggccattgaatttcacttttttgaacctccgttgctggggcattggttgctggattgttattctgttagcatgatgaactaattgacctagcagggctccctgtagaataacagcttctgcttagttcatcaggagtacaatttgttgtttcatttcctcttctagtcccattggggaaattgaattgagaaaagactacctactgggagcgttcagtgctcatgactgaataagtaactttatttatgtatttatgtatttatttatttggtactgtcttaattagcaaagaaggaatgactctattaggcaagagtcgactgtgtttttgatacaaatgaataagctccgttagcaaaacatttgattcacagagacttgtcatagtcagggccccttgcaggtgcagatcttacataaaattttaatttgctatggtagagcagttttctgttttataattgttattcattcaatgaagacattgaagacaagttaatggctgttaactggacttaaaaaaaaaacaaaaacaaaagcaaacacccataagttggaagtttggaagatagattcattgggccgcatacaaacatgaaatgtcaactttgcctcaataaagatgaattatttatctacagcagtgtccaaatgtggacttgaacagtttgtcattaaattttgaagcctttacaatttttcagttgcatcattgtttcattagtgtgtgcattcttagtcaacaacagagaacatactatctgaatgtaatgaagaatgaagtctgatgatacattttacattttttaagaagctattactagtttctattgtgtcttagcaaattcttaagtgtattaagcagatgttctaggctatgatttaaacgtcccctatattacaatctcacatattttctagaacactgttcaatttgttgcttagcctgagagtaggggaagagtagcatagtcattataaactcttgctctgaaataagatatccctgattcacatctctgctctatccctcacttgctttgtgaccctggacaagcagcttaattctccgagtttcataaggttaagttttggataatgagtgttcctataagggaagctcttggaaaagtgcctagcacataggaactgctcagtgggtgttagcagttattacatgtatttcctaataatccagtgcaaaacctggtgcaaggtgtgtgctcgaaaaagttcaccaacgaatgaatgcatgaatgaatgaacaaggggaaatcttgcccagaaaacctagaattattagaaatccttgtctgtcctacatatttaaacaaaacagcacatttctgtatagttataaaattatacccaaatgtagaaaaggctctaaatagcttggaatctgtatttatataggagaaacttaatatccacaaaatcattacagtatcttgtaaagaattgagagtttactcacaagatcgtatgagtccagatgactagaaatagcatttaaagggtctaccattaatacaatattgtgaaatactggtatttttttctggagtatgatttataacatttttatgaacctctgtaaaagattttatttgtatataattctctgatttttgaagtgagggagaaagactcttcttgtgctaagtttgtacatgttctatgccagatattctgaatttaaaaaatacatataacacatgatttctttgtccaaaaagtttataatctatctacttgggttggcagttgtgatgcataataattaggatttaacatatacactacactgcctattatatatatatatagcattaaataatgtatcacatactctaaatccatacattaggaatttaagaaaataaagaaattttcttcaaccactgagtatgtcctgcttccctttggattgtatttatgtgaaactgttgaagtaagataattgtctaattggatttcttagaattctcagaaagttttgaaatctaggaaaaaaggtgaaaacacagaatttgtattatgggagttgttttatattatactaagaaataggaggacagaaacatttttttcttttcatgattgttatttaagtaataagatgtgtgagagtgtaaagcatagtgtctggcacataataatctttgtgcttgccgttcttcactcctttataaatccatgattatcaacaggaaaacatggaggctattgtaatcaaatttaacccaaatggaaggtggtattagtagactcagtggtccatggtggccataatgaagcttccataagagatgttatttggaaaccaaccagttatttctgtttttggctaattcttcaaaaaaaaatctccatttgggttctttcttttagaggaatgtggtatttttaaattaatttaatttaaaaatttttctcaatattaggacataagatgactcgaatacatatattcatatgatagaagagtaatttttatctttttaaaatatgacagcaacaataatattcacaaacattaccttggctgttcttggtcttcttacaattagtaagaagttgggcactgtgactggatctggacaatagtatatgatgtgtgtcacttttgagctaattcagcccttgtatgatactacagtctctttccctgccttaaggaaattattatcttctcaataatggtcccaggtcaatagatttacacaggtaaacaactgaatcttcctctttatctcagacctacaaaaaaattaattacatgtagattgaatgttgaaagatgaaagaccaaacaataatatttcttgcagatatcatagaatagtttccaaatccttggttaggcattattgttttttatataagacatgtgaaacatcaattataaatgaaaagattgagaaactcaactttattaaagtttaaaaacttatcaacgatactatttcctgaataggagtgggagaagggatttgtaatatatgtaaccactgaaggatttacatacagattctctatctttaaaacctcttacaaatcaataagataaaagcaaataacccaataaaaacgaaagagaggaaccaaattattgaataggcactcaaaatgagaatatacaaatggctcataaatacattaaaaagtgctcaacattattatccatcaggaaaataattaaaaccatagtgacataccatcacttatctattactatgactattaaaactttcttaaaaaataaactgacagcaccagtgttagaaaagacaatacaactacaaggactctcaaacattgccactgggggcataaatcagtacaattagtatggaaaactgttttgtagtatatactaaaattaaacttattcattccctatggtctagcaatgccacttctaggtatacagtgaacaaaagcatcaatatttgtatatcaaacaatgtactggatgttcattacggtggtattgtttaaagcccagatggaaacaatgtaactgtcctatcaacaatgaaatacaaaaaaataaacgagaatattcgaacaatggattatcatataacaataaacaaatattgctacatacagcaacacaaagtcttccagcataatgttgaacaaaaaaatatccaggcacaaaatggcttcctttatataaattttatttcttcaaagttcaaaaatggcagaactaatctgtaataacatcaaagttgctttttcctttagggagataaatgactgaaaagagttataggggagggagttgctagtaatgttttgttttcttgctgcaaaaacacagatgagtccattttgttaagcttcattgagctgtatatgtatgatttgtgcacttttaggtttgtttattacactgttctaaaattcaacacagtctctaagcaacttatttaaaacagctcttttagtaactatactagaaacagaaacaccggtcaatataatctgggaaaaataattatttttcagttcatgaagaacaaaactagactaacaaatgttctagaaacgcctgccttttgttatttatccttgacttaccaaatgatatcttccccctccctggccctgccatctcttcgactaccctccttcagcgttgctacttggcaggcatttgtgaggaacttgactttggagtctcagtagcttagtcccaaacaagccagcacaacatcagcaaactcaattggcaggaacataaaagtatcttcagaaggccaagggatataatgtgaaatctctgtttgcctaccttttttgtttgagttaagctaaatggaagtgatttcagcaaaatatgagatgtctcaggcttttgattgaattctggatgtggaagtagctagggaaaactaaaaatttttttggaaagttcaagcccctaagtttccaatgaaaaatttgcatagtggaggaaagccaaggaccaaagataatatctactgcactgtgaaaggcctattctgtgatcaaaagcaaaaataaaacaaaacactttgattggcagtgctcaagataaccaagtcttttcaagcagatgctgtgataggggaacccatatagaaaagcagagaaaaaatgcgagaaccgtggtgatcagcaactattgttatctccacctgcatcaaaatagtgataaatgtaagtaaattataaagttccatacaaaatacagtgagttgtatgcttaatattaacgggttttactcatttgtttaacagaggcttattaaacagttttttcatctcagcgattagctgggcttgtaatatccagaccatcagacatctagctccaaggactcataaccagatgataggagaaagaagctgagattataatactgcgataaaaacatttatataaaaatgtagttattccaccagaagaatgtaaaccacagcccctaagcccttgccaaaccccttctcagaccttgaccttccattaatttgtctgtttgaaccctaggattttgcacattttgattttttgttctaggtgaaagcttgagagttccttgcctctactatgcccagatctcagcccaaagccatccctgatcccctttcccctgcaggacgaaatttcagtttgctgactctgctgtgctcaaagaaccttcgttttttgtgattatgtgcttatttttagtttatttttttacctccttctagcgctactggattataagttactttgggatcaaggccatttctatctcactcattgtggaaacccagcttctatcgctctaatagtccttgagtaaatgatgagtgagctgcagtctgagaagcctaggggacagaatgactcagctgcttggaggaaccaagaaaagcttggaacagaacagagtttgcatcgctgtggctcatggtgttgctctataattacttaagtgacagttttcttatacagacactttgtcctagacaatatgtaaatggaaagaaagaataccatctacttctaaattaacagctcctggggctgcttctcccacccccacctcccatatgcacttgtgctcatatgcatttgcatgtaatttctgtagtaccacagatctgctaaagcccatcagagactgcagctcacgaaagctgccatgtttttccttttaatttccaacttttgttttaagtttggggtaccatgtgcaggatgtgcaggttggttacataaatgccatggtggtttgctgcagagatcatcccatcatctagatattaagcccagtatccattagctagtcttcctgatgctctccttcctctcacttctcgccctacaacaggcccctgtgtgtgttgttccccaccatgtgtccatgtgttctcctcattcagctcccacttataaatgagaacatgcactatttagttttctgttcctgtgttagtttgctgaggataatggcttctggctccatccatgtccctaaaaggacatgatctcattcccttttatgactgcatagtattccatggtgtatatgtaccacattttctttatccagtttatcattgatgggcatttaggtcgattccatgtctttgttagtgtgaatagggcttcagtgaatatacatgtgcatgtatctttataatagaatgatttatattcctttgactatatacccagtcatgggatttctgggtcaaatggtatttctgcctctaggtttttgaggaattaccacactgtgttccacaatggttgaactaatttacattcccatcaacaatgtaaaaccattcctttttctccacaacctcgccagcacctgtgttttttaactttttaataatagctattcttactggtgtgagatgatatctcattgtggttctaatttgcatttctctaatgatcagtgacgttggattttttttcatatgtttgctggccgcatgtatgtcttcttttgagaagtgtctattcatgtcctttgaccactttttaatggggttgttttactcttgtaagtttttttaagttatttgtagatgctgggtattagacctttgtcagataaatggattgcaaaagatttctcccattgagtaggttgtctgttcactctgttgatagtttattttgctgtgcagaagctctttagttgaattagatcccatttgtcaagttttgcttttgttgcaattgcttttggcatcttcgtcatgaaatctttgcctgtgcctatgtcccaaatggtattgcctagattttctattagggtttttatagttttgcgtttcacatttaagtcttggttttttttcttttctttcttttctttttttttttttttttttttttgagacagagtcttgctctgtcacccaggctggagtgcagtggcgcaatcttggttcactgcaacctccgcctcccaggttcaagcgattctactgcctcagcctcccaagtagctgggattacaggtgcctgccaccatgcccagctaattttttttttttgtattgttagtagagatggggtttcaccatgttggccaggctggtctcgaactcctgactaggtgatccgcccacctcggcctctcaaagtgctgggattacaggtgtgagccactgcacctggctcacatttaagtctttaatccatcttgagtttatttttgtatgtggtgtaaggaaggggtccagtttcaattttctacatgtggctagcctgctctcccagtaccatttattaaatagggaattctttccccactgcttgtttttctcaggtttgttaaagatcagatggttgtaggtgtgcagtcttatttctgggttctgtattctgttcccttggtcttggagtctgttcttataccagtatcatgctgttttggttactatagccttgtataatttgaagctgggtagtgtgatgcctccagctttattcattttgcttaggattgttgtgactatagggctctttttttggttccatatgaattttaaagtatttttttctaattctgtaaagaatgtcaatggtagtttaataggaatagcattaaatttataaattgcttttggcagtatggccattttcatgatattgattcttcctatccatgagcatggaatgtttatttgtttgtttgtttcatctctgatttctttgagcagtggtttgtagttctctttgaagaagtccttcacttcccttgttaactgtagtcctaggtattttattctttttgtgaaaaagcctgatgttttgaagcactggcttcctcattttttgtgtgcccagacacagcttgtcgaggcaccacattcagcttctatgtacctttaattaactagcaatattagtagataacacttactatgcatctagcatattgtttcatttaacaatggtaaccaacttatcataagagaggtccacttatcttcccagtatatagatgaggacattgcactagagagattaataacttggcaaacacccacagcttttaaggattggagctggacttcaaagccagggggtctggcttctgggtccttgctctcatccaaacctctaaactgacactctagaatcttgctgcatttcaggctttgtgtcttactaggaaataagtatgattatattcattttatagtcaaagaaacttgaactcagcaaggtccagtgacttgttttaggtcacttacatattagtctgtgatagagcttcaagataacccaggtgaatcttactacaaaatccatgatctttacactacattagaattcaaagcatctggcacatagtaggtgctcatctctgaaaaggcaaagctggaaaaaggcaaatgcagggtggattgagccaatatgttttaagatgtttggttttagtgtgtcattttgacacaaggagtttgaaaactcttcggtgtgcactcccttgccagcgcaggaaagtgaggaagagaggacagccgcataagaggagagtgtgggaaggcaagaagctaccctactgcaaatggagagttgtgaggaaccatcattaatgttctttcatacaactgagagttgtgagaaaccatcattaatattctttcgttttatactattttggatatgggctttggaagacaatattttcagggttattatgactcagacccagtttgtgccatggccaaatgcagggatgcacacacacttacatgtctgcatttatatttaactcttgaaagatggtcaaaaagatggtcattttcagcttggttaattaaaaaaaaaaagaatgctcacgttcttgatttttcaatgtttttatcaagaacaaatttgctgactcttgattctcacctctactatacagtaggtttgatgtatagctgaataaaatgcaatatttgctatatgattgatttattctcttaactcattaagtgtagtttagtgtaaattaatcatcttataagagaaattgtttttccaacaacaatttactgcatattttatttttatcctcaacctatatcagaactgctgatttaatataaaagaaaatccaaattaattgttttgtatgctatgataaaatctttcatatttatactgtaaactaacagagtagataggcaaatactattttgtcatgcaagcatcattttatttcagatatctgaggcctgataagttaccttattactcataatttttaaataaaatttttaaataaaaactttattgatatggaattcatataacataaaaatcatgcttttaacttatacaatttagcgattttatattttcatagagttatgtaatcatcaccactatctaattttaagactattttccataaccccaaaaagaaatcttcagcccattagcaatcattattaaaagacaattatttttctatggaattgtcttgggacctttaggaaaatcaatcatgaatgtaagggcttatttctgtactatcactttcttcttctttttcaagtttgttttgtcaattctggatcttttgaatttacatgtgaactttaggattaagattgtcaatttctgcaaaagcatcagtttacattttaatagtgattatattgaaactgtaaatcagtttgagtagtattggtattgtaataatggtaaatatcctgattcatgaaaatgaatgttttccatttatttactttttttctaagtgctgcatccagtgttttgctttctctgctatgattttgttttcattcaccttaaagtattacataattttcttttgttctcttcccttaaatcactgcttatttaagtatgttgttgaatttcacatatttgtgaatttcccaaattttcctttgttatttatttctaattttatttcattgtgttaaaataacatatttcaatattatttcaattcttttaaattgagacttgttccggagatgttccaggtgcatatggaattaatgtgtatttttattgctgttgcgtaaagtattctatagatgtctgttaggtttagttgatttatagtgttgtttgagtttctattttgttactgattttctgtccaggtgttccattcatagttgaaagttggctttgaagtctccaactataatttataaattgtttatctctcatttcaagtgtggccactcttgctttttattttggagctctgtttttacgtgtcatgttaatgattttcatgtctgcctaatatattgatcattttctaattatgaaatatacttctttttctattaacagattttttcctattactccagctttcctatgggtactctttacacaataggtatttttccatccttttattttcaatctatttgtgtttttgaatttgaagttagtatctttatatggcatctaggtatatcatgtttttgttttgtttttccattctgtgaagctctgccttttgatttcattatttaattcatgtactttacttagtaaagtaatatttggtccatttaattactgacaaattaggatttatgtcagtcattttgtaatgaatttgtcatgttttgctatttgaatttgttttccatatgttttatgtgtttttctctcttattgcttccatagtcttttctaatgtaaaatatgtattttctaaggtgcaattttaattcccttgttatgaaatttgtttttatatttgtttattttgctttgtttgattttctagcttctgctctgcagattacaattaacctcttcatttataataattgggtttgttaaattaattaaataccaacttgatttcatttgtatacaaaacctgttccaatacagcttgtgtccccctagctactttatgctgtcattgttatacagattacatccttacccatcctaggtctaacaaggcaacttgtaactgttgctttatgcagttgttttttaaattagatgaaaaaaagttgtgaaaatatatttatactatcttttatatttacctatacagttacctctctattttttcatgtgatttgaattaccctctagtgtccttttatttcagcctgaatgactccttatagtatttctcttacagcacatctactagcaacaccttttttaaaaatttttttgttttgttaaatatggaaatatccaagcttctccctcaatgttttggaggatagtatttttctgaatgtagaatccttgcatgacatcttccctcccacccttgaagaatttcaaatatgttatttcattgccttttgacctccatggtttcggatgagaagtaaactattaatattcttgaagatcccttgtgaatgatggtccgcttttttcttactgctttcaagagcctctccttgcctttgtctttcagcagattgtctatgatgggtctgtgtgtggacttcattgatttcatcttacttggagtttgttgagcttcttggatgtatagatttatatttttcatcaaattttggaagttttcagccagtatttatttaaatatttttattctattttttcctctcctctacttactgaattccctttatgcatatttttgctcagtaatggtgttcagcagatctcaaagattaatgaattttgactgaatatttatataagtgtgcagtggaagaaggaaatattttgtttcagataataaaaagtctttatactggctgtgcgcggtggcccgcgcctgtaatcccagcactttgggaggccgaggcgggcggatcacgaggtcaggagacagagaccatcctggctaacacggtgaaaccccgtctctactaaaaatacaaaaaattagctgggcgtggtggcgggcgcctgtagtcccagctactcaggaggctgaggcaggagaattgtgtgaagccaggaggcggagcttgcagtaagcccagatcgcaccactgcgctccagcctgggtgacagagggagactccgtctcaaaaaaaaaaaaaaaaaaaaaaaggctttataaatatttagaatgctgggaggtacagcttggagaagtgaatatttaatgttaaaatgtgtcgttattataattatagcagatataattttgatcacttaactaattttttcaatattaccaaatttaattctttacataggaataattacagaagctttattaatgggttaagatccataaggcaatttgtaaataaacctatttgtctcaaagttccaggttgctttactacagctttattatagctatcaatatgttttggctgagagcagggtcagtgcactctttccagagagcatgaaagcttgaaccttagtagttcatatgtagagtgattctgtattcccattttatagatgaggaaactgaagctcaaagagatttaacatttttaacataatttttgttatattatcaaagatacataaaattatgttccagactggtagattataaatagtttgtgagcggggtctttgatttattaaattcttatcctcagttccaagaacataatagatactcagttagtgatgacacagtattagaatcaaccaattttacaatatatcctggccattgttgaggcatttatttcctgtactctatagattttatgtgtataaatctttggaaaatgtatcaacatgatatttgtatattgaaaatgtcactcttgaatgtattattgtcattctttctggattcgtccactagggctaccatagcaaaataccacagactgggaagcttcaagaacagcatttattttctcatagttctggaggctggaaatccaagttcaaggcaccagcagatttggtttgacatcgggttcctgactttggcttgcagatggctgtcttcttgctgtgtcctcacatggccttttctctgtgcaagcactctataccattcctattggattagggccacatacttattatctcattacttattatctcatttaatgtagttacctccttaaaggtcctatcaccaaatacatttacgctggaggtgagaacttcaacatatgaattttggggagacacaatttaatccataaaaccctcttttgtgtaatgattctgagatactgagaaaaatgctccatttcaggtatttttaaatgaaaaaaaaaatcgtatcaactcctgccctttaactttcaaagttaaaattcatgttagatgattatttgttttaaaagtgcttactctggtgtgctttttaaaagactataaatcccattaataaagtcgaacagaagcttgaaaacaattaagaaatttaagaatgagctaaattgttctcacaaaaagaggaaaactacaattcctgctgaacaagtctttcattcagttcttcattcaattcacattagcctcaattggaaaaatgtccctgttcagttaaacaagttaagcctgatcttaagtgtatctgacttgccttctatgttcttccagccacaggaaattcctccatgccaattttttaaaactgctatcaaatcttttttttttttttttcactcaagtgcgacacatttaaatgtgaccacaggaacaaatggaaagagattgaagccttgacttgaaatgtgagctttcctctttactagtcagtaaggtattgagaaagttacttgacctcatccttcattaccttgtctctagaattaggagatcagcatgtatggtgatcatggaaattaaataaaattatatgtcagggcctattgcatttattgtctgactcatcctaatccccttattcctttcttagtgtttctttgtttgttgatttatttttgtccatagtctcatgatttggagatagggctccagctttctctgctaatgtatttcctacccctctcttcctctgtcagtgactggagaactatcttcttctgacatgcccagctagcttctacttcaggactttatatgcctgcttcccgcaatcatatatatatgtgtgtgtgtatatatatatatatatatatacgtatatatatgtgtgtgtacatatacgtatatatacatatacatatatagatatgtgtgtgtgtatatatatatatgtatatatatagagtcttgctctgtcaccaggctggagtgcagtggtgcgatctcagctcactgtagcctctgcctcctaagttcaagctattcccctgcttcagcctcccgagtagctgggactataggcgcaccaccacgcccagctaatttttttacttttagtagagaagagctttcactatgttggccaggatggtctcgatctcttgagcttgtgatccgcccgcctcagcctcccaaagtgctgggattacagcctgcttcccacaatcttaaccagtcttgtctcatcttcacatagccaactccttcttatccctttgatgtgtacaaaaatcacttcttcttgtggcccttataatcactcacatcctaaatggcatatgtgttcctactatgctccactgtagcccataactatctttcaccttgttaaattttcagcactttccactgtatgaaatgatcttaaggggttgtcctgtctctcctatagtagagtgtaccactggaagaggcagagacattttctgtcttaatgttggtatgtagtggggtctgaccatcaatatcagttgaattggcatgggaatggatgactctgtacataggaggccaaacaaataaaaattttaaaaccgcttatctgacaggatcacgcttttttcacttcggctgttgttagttttaattctctgaagttatacatggttagataaaatggtctatgaaagtcctgggtggtgatgggactagagacaaggattcaaaatgtattatagcaaatttatgtgtagaaaaaaacacgtggttaattaagacttgctttctgtcattttatgaaggtatctatgtaaggtcctagttttctccattatacatagctgaaagaaacaccagtaatgaaacgtttttgtattattctcactccaaaagcctagttatactgagggcggccaatagatctactatgggatacaatgaatatttaatttactttgatgaaaaggtgtcataagagcctttgacaacccacagtgaaaacttgaggatgattttattaactcaaacccgatagcatatgttgtgcaaactaagacatcaaagactttttaaattaatacctgggaatttcttgggagaagtaactgcatattaggattgagaacaactctaagttgtcacatattgaaatttgtttttaattactgaaaagtcattttctcttatttctggctcgggtaaatagtaggaaaaataacacacacatacacatacacaaatgatatcaaattaaaagagagaaaacaaatgtgaaaggattatggtgtgaactgtttgctttccagcatattaactgtacccatgaactctcatctcccgccccacagaaaaaaactaattattggaattttttagtgaacaggaaggatatcagagtacgatactttctgtttcccttaaatgcataccattttctctattttcatagtttaccagtttcccagtagatggcaccattgtgactcacaatgttgctccaccttgtaaggaagtattatacacactttcaatttcaaaacatttgtaaatagtgcagtatagtaacacttgcggtggtgtcttagaacacaaatacttctacagtatctagaagacatgtcaactgttgaaagccaataaatgtcacaagaacccccgtaattcctttgtatatgtgtgatttcatatcttataatttttatacatttaaattattttaataaaaatgtgcttacatacatgtacacacatatgtgtatgtatgcttataaatgtctaaaactgtataattatttaatgatttacttactactcttactatttctttctacctggattaatgtgacaagccactcagagaaactgaaaattcccatgggcttctccagttgttcttgggaaaaaggagactagaacagtgatttcagatctggaatacactggactccaacctcagattttctctttgctgcctgtattacctaaagcaattgacataacctctctgatattcaattttcccacctttaaaatggggaagatggcatatacctggctgtgttgctgttaagggtaagttttaagctgtgtgtgtgtgtgtgtgtgtgtgtgtgtgtgtgtgtgtgtgttgcaaaaataaatacagtgactgttatagagtagaagttcaaaaatggtggctgcattccgattacagcttgcattaaagttgaatattaagaacaggagagatcgatgatggtgtgttttgtaaccttcacacggttttctatatcataggatgagtcctagctttcagagatttccttgcgcctatgtctaccctttcttttggtcctagaaaaggtcacagatttaaagtaagtcaatgtggaacattaacatggctcatgcaggttctgtgcagctgtctctatgggttcttgaaataaaatagggccaaaccaggcacttcaaatggtagatttgaacaataaatgataaccactgtctctaatatccaaatcattccctactcatccttctttaggctcatagttcattgcactgtcttcttaaataactacccgaacacaactccacttttctcacttctaatgcgtacatttttagcaataggttttggttagggtcttctctgtccacatactacaactgtgagtacatgactgacccacacttttaacttggtgcttttggattcaggcagatgtttagttccaagaagcctttgagaatcatgttgtacttacagaagcactcactatgcttccttttccaagtgattagtctttcactattaattcattcaacaaatattgatgcaacactttgtatgccagttactatgcagacactaagttgtgccctcatggtccttcaactttacctgaaaataatatattttatttatttaaccaatattaggtatcaagtgttttacaaacattgcctaattttatccttgtagaaccctaggaactagaggccatagattaaagatgtggaaactaagacacagagaataagacatttacagaaaaagaagtgaaggaaggagggaaggaaaaggagagagaaagggagggagagaaagaaaaaagggaggaagaaagggaggaagagattcaaatgttgacaccctaacctccaatgcagtggtatttagaggggggtacttgggaggcaatttgatttagatgaggtaatgggccaggggctctcatgatgggatcgatgtctttataagaggagacaccagagagcttgttctttctgtctgctgtgtgaggatacagcaagaagaaagccaggaagaaagcccttgccagaaacagatcatgctggcaccctaatcttggacttcttagcctccagaactatgagagaataaatttctgttcttaaagccacctagtctgtggtattttctgatggcatccctagcaagttaaaacaccattttttgattttctgaaactggtacctggaggtagaatggagggaattaaaagaaaaggtaattagtagtgtcagcattttagcccagatattaaaatggggatgaccttcagtttcctaaatttgatgaaggatttggtgaaggatgagggatgtcattattgaaaaatatgtatcagactttcgccttttccaagaagtcagtcacagctttcagatcccaggtatgtttgaaagtgactttagtctgatcttttcatgccacttagaattcccaggcttgccagtggaacattttgtagtaacatttaaaaatataaacttttcatttcttgcctgcagtggagagagctgattcacgatgagttcctctgtccctcccttcaccatatgtctcttcttcattgttgatttcctgttgacattaaaaggagcaacatatgaaggagttagaaggaaagctttaaatttaacgataaacttttttgaaagcatggatcagattttcttacaaagccatttaaaatgcattgtaaatcatttctttcatattttgtagagacttgttttggaagtatcgatattcccttctccccagcccccaaaagattaagaaaaatataaatagatttatttttacaatgtaatgagatgagagggatcctgtgagcaagctgataagtcttgcaattcactaacatagcccatgaaatccagctctgatgtcaagaggctctaagcattttgcaattcttaacggaatgttttctttgcctccctccttccctttctccatttgacagcacctgtgcatgtgcatgcaagattgcttttcagatctatgctttggttttttgttcatttttgtcagaaaagtcagcctatgcttattagggatctacaggaattgtttccacatggttctaatggatgcatggacggaacacctccacaacatgttgctgttggcctggtgctctgtcactaccaagatttcagagttcatttcttggctcctttttgttcttcctcgatccaagttcacacttcataatacgttttaattgtcatctcaatgagatgactcaaatttatatattgatatatctgtatcacaaaaaaattgcaaattgcgtgcattgtcaatgtgaattatagatagtatgctatgaaaacaaaaatattttctaatctgtctgacttttagtagagaagtcaagatgagatcataattaatccaggcttgaattaacatagctggaatagttaacatgggcatagtccctcatctgtctttggctatttgggggaaaagaaatacatgttaaagtgaaaattagtggaggaacttttaattagtcatacatttttactcagtttcatacacaagaatattcattttggccataggaaattgccactatttgatcattttgattgaccaaaaaaagctggcaatttcaaatgatgcaatacaggtcaccatcactgcttccaggaagcttacatcctaatgttaacaggtaaataacgaaataattaagatggctttagtgtaatgagaggcagtgggcagaagggggcatgagaggctctttcagatggtctgatcagggcaagtctctctgagaagacatttgcacagtggcctgaatgagatggagccagactgccataaaggtgactttacatctgggagatctgaggcagcaacgaggcaggatttttgagcagcagaaaggaggccagcatcaatgaaggaaagaagggtggaaaatgagaatggaaatagaggtcggagtgaagtggatgtgcagaatactcaatatcattctgatttttttccccatgtggcactattaactttagccactctatttaaaattgcttattgtggtggggggtgggaggaggtggttagaaaatgtatgtttaacctattcacttgcctttatttcttgttccttaagttttttaatgctttctatgacatcgctatcccaatctctactatgcttgtgtcttctggtttacccccatgtttctttcatgccttctcccagaggagtgactcacagtttgcatatactagacccaaatttttagactacagccaaagtaaatccacgtacagacataggggaaacactgagattggggatgatcttattttgtttaatttctagaaaaccaagttaattgagataaaggaggcatatttaaaaaccagaaaaggagacttaggacaatggaaagatttaaatagatacccttagtgaacataattgaaatactcattatttacattttctgcaacatccccgaatatttaccaaagtaaagaacttattaaaaagtatactataatttataatttcaggaaattataaattataatttataattttagtgtgactaaattagaatttgagaaatacaaagtttaacatgtttacacaaatttgtcgtttaggatttaaattatatttcaaggtggaagaagagagtgctcctgattacaaatggagaagtggtagaattctcactgaccacaagaggtctgcctttgattctcacaatttcacatgggacctttctcttaaaccttcagtactatgattggcatttaagggtcagacagtaaacatttgtataccgaatgacggaatcaaatattgaaggtagaactcataaacataatgcaaatataaatgttatatgttaaaattatctttatgagtaaggaaaattctaagcttactctgtatttacaccactaagaatggatgattatgagttcatttaaatgtttgagttttaagtgtcactttgcattacatgtgtttccttaaaggaatgtaattttggctcatgtgatcaacttgatatacgaatttcatatggttaaagaatctattggcaatctctctcttcattggtttacttttaaagattgattcttctagaaaagggaatattttagattgcttcataaaattagtaaattaaatgtgtaaatgaaaccatttgttcattgtcatgttactcagagttggcatagaacatacgtggaactaatgtttttattggcacacttttccatcaactactgccaccttccaggaatgttaaattgatcaagttagtacaaactaaccataaaacacttttatctgcttatcaatttcaaagcaccttaacttcatgaaaatgacaaagttttattgttctctgacaggtcttctttctgaattagattacttacccatcataatacctatggaattccagaataaaattctagtgtagaaaaaatgtttaaagtaatttgagaaaatacatcaagaagttcaaatgattcaaaaagcccatgagtttttccataaacttcaaaaataccaggcatgttataacatctcatacaataaaatttcacatgtatgggtttttctcaaatactgtagtaaccatttattcacagaacatacatgtcattttctatttgtcgtctaatttttttaaaatgcttagatttgacaatcaaaatacagaaatctagcatgattccatagaaatctattttctagttgaaattgttttaatgccaagtgtgtcactaagaaacaaagtcaatgtgcacatctgcttttgggcatttgtatatttttataaacagtcacagaagcatttgttaacattctgtgagaggcccccctgctttcagagatttaccaggtgttcattaccttttgttttcatctctatatatcccttagtggatatttctgtatttatcaatccacctcagtaccgtggtaactcaaattttaaagtaacaatgaatgagactttactaatatcagatttgcaagtccaaataaagtgtgtctatatatttttggtttacatatttattctttctaaatatttcagttgattgataaggcataatttgtctcatgaaaacccttgtctttttcccaaaggatggtgtttgcttattttccctgaacttttggtatgttttaaacagtgtttgaagtttattatgagtgctcatgaagttttagtttagctgtagcaatttctggattgtttttgaccttcagactttgtggatacaggcaaaccttatttttttaattaatgactttgtatttaaacaataagttttaattttttcacaaagttttatgctttgtcctattttgttgtatttttgcagagttattgttactgttttgtttaaggttttttaaatgtcatttttaaaaaactcattgtccacattccagcctgggagatagagcgagacactatcaaaaaaataaataaataaacaaataaaaccattgtccatttctcctgagctttcaccaagtctttttttctataaataccttccaagtttctaatggctattatttatatgaatgaaatagtctcagaaaaaataagtttatacacgtgtgtggtgtatatctactgtagagaacaaggatcccgtttaaagaaatgtcatattgattagatacaattttaacttgctggaaattactttctaaaaatattattttccaaatcttcctgtccataaatccgtttgtaaagggaaaagccactcttaatacatagaaattccttttagtgagttcaactttaagcccctaggaaatgctttagtctttcaaatatccaaaaagttaacagattttatatgaacactttacatgagaaagtggtacttttgctgaaaacttaaagtagtaaatggagaaaactcaagtgtagcattatttccagctgctgcagattccatgctttttcatatgtccctttctctgcctgcctctccctcctatgccaatcctttgtatgaccatgagtttttcaagactcttctgtgctatccctgacaattcagtttgggatttgctgtcaccttaggagcttctctgtaaacctgtgatttttttcctattagactaatgtgtgaatgagtgttttgctcagtgctcccttatagactgtgagcttcttgagaacagggttgctccttcttcaccattgcatcctcagtgtgtagtgtggtacctaacacatggcagctgactttggcttaaccaacacatgcttgaatgaagcagctccaaacctggaatgcggaggcagtagggaaggaaaggatatcaccaggactgctggcagatgagcacagagttgagtacaactttcactgtgtaggaggcagcatagaaggggaagatttataaatgatgtatacaaaaacaaattcaaagctagtaaaagaatgagtggagaggctggggaatcagattctttagaaaatagggagttttgtataagaaaaggtggtaggggaaaaacagttttgcaaaatagtcatatttcactagatttagcagtgtgttatccaatcacagatgacctgaaaagatgcactgtgtaagatgctattaatgagaaaggatctagaggttgacaggtacggccatttgcatgctgatgataactaaaattgtaaggaacacatatttagagtagctttaggttttggaaattgattgaagagggacagaaaaagaaggagaaccttaaaccgtaacttaagaaatgagagctgggatctacagagcaggaaatgatacttggctgaaaagctacagatgcataataaaaagattacctgttatttgataatgatgataaaaaaatacaatgataagtagtgcatatgggctgggcttatattctttcatttaaaccccaaaacaactgtctggggaagatttcattgtttttcccagagaaataacagttacagagaggcaggtaaattgcccagggtctcagaactggtaaatttaagagttaggagtagagtccaggtagaggcactccaggatctgaatcttacctgccctctatagtctaagctttaaccaaacactatgtaacatttatggtatagctgtcctgagcttaagaagtatgtttatctcatttgatccttagaaaatctgcaagataagcagacttcaatcctcaattgaaaggcaaagacaggcttaaagaaaacagagattttccctgagaatccacagcctgtaaatggttgtgatccggcctgaaccaatagcttttagttttaataacatcacaggttctgtgaaaccatgctacttccttagatggtgctccttcaggaaaaggatatcaatgttggtatttttatataaaacattaagagtatgtgtttctgttaatgtacatatacatgtcctgtagcctgttagaacccatttttttcattttcaaaggtcataggaaaaattatattcttacacaataagtctgtacatccacagaatcaaagatatttggtcaaaagtttgtcattatggattctaaaagttgaaagcatatggctgcattttaaaaacctatctatatgatgtgcttatgagtatggtattttgtgtccaaagttaattaataacggctgcaggccagtgttcttgtaggagctctcattttttccaacattgctggtgtctttgaacaagtgaagtgaagccatccagggaaagctatgaatttgcattctttttttttttttttttgaaacctttctaacaatggctgataatcactactgtcaatagtcttctaaaaacttcccagtaatgattagatactatgaatagattattgctttttctcttcaggtctttttcccccaactacatatagaatgttattgaaattcatgtgtcttaatcagttgttctctatgctttttaccatgcctctcttcatttctaagtcttctgacctaaattacaaacctgaaggactgagaagagaagaaaacccattttgagttcctaccctgtgatccatactgtgctaattacttctcactcatctcatccacactaccacaatgcaaagtcagcacgttcataattgttcacagcaaagagaaaactgaggactaagtctcacagggagtaaaagaagtagatttaaacccatgtttgactcttaatgtcatgtgtttgatctccgtacttacagctcttggattcaaattttagtatgtgtttttaaagtccatattgtaaatgtaaccatgatcagaagtaattactattttgcagagcacacacacatgtacacagaatatcaaacataaatatacagagtaaaagaaatgcccgcatgcctgccactcagggcgagatggagccctgccatcatgccacatgagtcccctggtgccttttctgtcatacccgctcttgtctacctaggggaaaatactatcttgactcatggtagtcacttacttgcttttcttttcctcaaaatgtgttttgaggttttttgttattgtgaactaagaaaacgtagttgtatttgtgtgaggggaattgatactcaataggaagatatgccgagatatacttattatatattgtttgctgttctcacactaaaaaggttgggttctataatttggactcaaaagaccatttctaggcctttgagtgcccctaagtggccataatagaaaatacagtattttacaactcttggatgatctctccttccatctaacagctagactttccactgggttcctggcctgacttctgtagtattctgcatcgttttttccattaaacaagggcttccaggactataatttgactctgctaatggaagggcatttgtacagtattaattttaaatgggaaattgctgacacgttaaagtggcatctgtcctgctccccacttgaactccgctttagccctggtcactgcagttgtcagtatcaattggggattaggagggcctgtggcctgagagctgctggccagcaaatgacatcacttttcctccatactcacagagctttgtgtcttaggaagtaagtccatttgctgtggttttgttatgagctgtcacgtcctctatggcacagatggacgtttcgactttgactttcttttgaagctgcttcatggggatcaggctgcctcttaaacacatgaagtttgtggacatatcctgggcacacagaggtgcttttcaaaatagacggaaagtaatttaatatcattaaaagacttgttctcggtgcgagtttatcggttcctctgcttgattcataatcaaggcagaaattatttttttcatatgtttcaatgaagtttcctatgcaatcccaatttttgtaaatgttaaaatgtggattataatttaagtccttattctatatttggaaagacactgtcttttctaacggtaaatttagttcattcacatttccagcaaatatttatggaagaccctattctatttcacagttattgacataaatgaagcaacaagttttctgtcttcttggctcttaacatttgatgatggagaacctggaagtaatgattacgtacacaaataaatttttaagaggcaaatgagatcatttcagataacaggaagtaacaggaagtaaataaaagagggtcatgggatggagtgggaaaaggggagagctatttcagatgggaggatcagagacagcctctttgagaattgagtatttcagctgagtcccaaatgcagagaaggaacaaagaatcaactgcatttgagagagagaaatcaggaaatggaaaatccctgtgccataaatttatattgttgtatctgagtaacagaaatagcagtgagtgaagaagagggtagcaagaaatgaagctggagggtgaagaggaaccaggtctactcgatctctttaggccatgcttggatttcatctgctggcagaggacatcagtggagagtattaaaatcaatctatgatgttctaaataaataaggataacaaattatattttcatttagtgctttttaataaaaactaaaattaagctaaccaggaaaagtttatatgagtttttttacaattgtatagaacataagatgttggctgtatcatactgaaaaaaacacagactaagcagtccaggaagtacattgtaagaattactatttttagattagtatacatgttttaaaaattctttttttcttattgcttttcacatgttccgtgttgtcatatattacagtaataattttcagatttagggtatatcttacaagctagaccattggagttgcaggctcatgcttagctatgtgaatttggtcctaacataattacttgctattatgcccttgactttcttgagggatattctaagatgctgctgggacatttactcttgtatttatgtagaaatgtttttgaagacattatgcactgttttctcatgtggcctctcaggcagatgcactctctactgcagcgtcagggaaaaaaatgtgtttttcctggatagctggtatgttttaatatcaaagacagaacatgttttctctttgccaagaacacaactaaatttatagttcacctcttacttgggacaaggcttactgtgaatgaataacccttaaccttcaccacaagttacttacctatttatttatgtatcctgttgtataaaacacatttccttaaactacctagaatcatttctgcatccaataacacattgtataaataccatacaacttgctcatcctcccgcccatggggcctcgtattctcattacagtttactgctaacaatgacatcacactttctataggcctttgccttccttaaagcagcaggccatgtgtatcccaggagtgatacacacttcctttttaccacaggctctacattgagatccatatctacatgtataccatcgacacacacgcttgacactcactaactctttcctgtatgccaagtaactgtccagaagaaacccaactttctgtgtcttaacagactgtttggttgctaaagatggcgacagatcaaaatagaagcacttagtatttgaaccgtgttacgttggcagcctgagatccgatctaaggaatctacactttcctcatgtttgtaatatttttctcaggccccagaaataatgttaatgaatgggttttcctctaactcatatcgtatcttcttcaaggtcgtttctaaaacaatactttcttttactatcagaaacaaataatgcaataaggagacacttttactaatggaaaaaagttgactttacatgtcaagaacatagacttttttggaaggggatggagtaggaaggcaaggtagactaggaaaattagatgctaggaggtaacagtgtgcctctatatttaaagtaaatatttgtgttttatttttatttttatttttattttttttaaagacagagcagctatccccagagcagcctgcctggcaaaagcaggaatggaagggctgaacgcatcttttatggaagtcagataaatttcatgctctttaacatcgactctgactgcaggcctttcgctgcagtctggctccttccccagtgggaacaaaaaaggaaaagtgattaaagttccctcagtaatagacagcaggaggcagtggtcttggcatcttctacagagacagagagagagtgctttaacaagacttgcgagagttctttgaagaaaagaagttaagactggaagggctggtcgaggtccgctgtaacatttgttcatttcctctacttcatatagcttatttgacttcttggaatagcgtcaccctcttcgttaaaatgtccctgataaaaggaggaaagtgaagttgagctcctggccggggccagggttcagcatgttctactgtgagtaggagtgtttggaacttgattattgtaagacattccaactgatacaaatgataactaaatctctctctctctctttctctttctctgtgtgtgtttgtgtgtgtgtgtgtaaatctctcactctctgtgtgtgtgtgtgcttgtgtgtgtgagagagagagagacagacagacacacaaaatgtgaatgaatgaaggaaggaaggaaggaaggaatacaggagagaaatttttctgtatgttaggtggctgcgattttggctggccaaaactgccttttgccttcggtgaactggctagagctgctcactacaacccctccccatcccctaggacaaaaccactggacctttctctctttttgtctctctctttaaaaagacagaaaggaaaataaggtttgcaatcagtattcagacattcttatgactaataggattaggggcgttacgaagggatttgaacaagataattagtttactgcttagtccacagtgaagcaagaaaaatacttctgagaaaaggcagacaaaataggtcagaaaatgtgtgggaaatgaggtaagacctctcaacaaggaccacgatcaactggaatattatgaaaggactcctgagccttcattcatagctgcagactgtctgcctttttttttttttttttaatacttggccaccagaggtgtgaagcaaagtgacttacttaattttagagttaataggtgttgttcctggaccctgagtatcctgttccaagtgcataaatgctgccttcaaagtatttctcacaacgtgatgtaaggggaatgttttggaaaatctgaagagctcttatcgggcattttacaagctggaaaaaattatacaattaggagaactctttaaaaactaaaattttcttgaatagattcattactttaattgcaaaaataaatcttgaaaacataaatgtgaggggtgtgttctttgcttaattaaagtacttaagtgtttgtgctctaatttgcacagttttcactgcggtagaatatgcttaagaagaatcatttgaattttaaaaattcacaaagatgatatttttttccttcatagccacattacattctcacacttcctcctccacttcctaaaagctagtgctgtcaactgtactgttgctatctgtgagttaaggtatgcttccaaaggaatgctagaaaaaaaaaataccttcaaactctgtgtatgtgtataccacatactttatttagttagcttctgaatcttacagcaaccaccagccagatgaaagccactagaagctgttagaatgcctttggcttggtatgggcactgtgttgacttaagactggtagaggaaacagtcggcatttctgcctaatgaactaccgagtgacacaacagaggtggcctttcattatctatctgtgggtgaaaggttaactgacaagagaacttgttagacacaaaagcaattaaaccctataataacatattgttaacatatgacataatgattaacttaaataaagaagcccagatacatgttttcagattcccggagtgtggtgtgtttatattcctgtctcccatttagaatggtaggctgcacagtgttggacaagatacattgcatattcttttcatgtcacaataaaacgtcatgttattttccttctgtaaatatacgaagctattttttgccattgtatcctgagactgtggtttagttttaggaaacagtttgaaactaacctcttaaaaagggaatagtaattcagggccatgttctgttggtgggcaagttactccctgaacaaaggtgcccaaccagccagtgagtttttaactctggttttccctctgtttgcagaatcatctttgcaatttatctgcctcttcgtaattaactcacacatgctctatatactatggtggattttaagttataggtactcatctttaattactgtgagtgatacatacgtttagagggtcaagttccctaaaagactaattctgacccccccaaatctttctattaatagatggttttagaaagatttttttaaagcttcacttagtgaagactcaggacataaaatttgcttatctaaaattttaattgaattaaaaggttctagactccctttaggataaagctttgtgtcccatttggagaaatactaatatgaataacagtgtttctgatctccagggaatggccgtcatcgggggaaggcaggtaccgaccctaaagggtatgacacagcacaggttgggatgcatgcagggagtgggaagaagtgaaatacgaaaatggggaaggaggctgggcgtggaggctcacacctgtaatcccagcactttgggaggccaaggccagcagatcacgtgaggtcgggagtttgagaccagcctgaccaacatggagaaccctatctctactaaaaatacaaaattagctgggcgtggtggcgcatgcctgtaatcccagctactcaggaggctgaggcaggagaatcacttgaacccgggaggcagaggttgtggtgagccaagatcgcaccactgcacctccagcttgggcaacaagagcgaaactctgtctcaaaaaaagaaaaagaagaagaaaatggggaagggatggcttttatagtgtctcaggaaaattgcacttcaccattaaaacaagaaaagagtcttacgactacaggtagatgagcagaaaatgttgaggggtatggggacagtggaaagtattttcagtaaatggttggaatggatcatagatggaaactggcaagatataagtggaaacgtaggtagatgttttaattgggggctgaaccatagagatttgaagaaataaataggaactagaaagtctgtttagaaagctaatatggtagcccaggggaaatgtgataaggcctgaccaagaggagtgatggttgaaatgcaaagaaatgtatgaaagcaaggtgcatgtcaaagttatctaaattccaaaaattgagaacatatggcatatagaattatcttccacatatttgcttaccactgtaccatgagaatatttccatattattcattatttatagaattattaatttagttactgatggtactgaactacaatctacatatcctatcttctattagtggacatttaacttgttttatacatttattaaaataaaaagtttttttgctcataaaaatgtttggcaacattgctccttattttcttgggctaaattcctgagatcattcattcactttttcactcattagttgtgagaaagtgctgtatgtgcaaccttttgctagggaaaggattataaatgctctctggagtgtaggtggctacaatttctagttggtatgacaaccagtggtccttgcacacagcagatattgattgatcccctgcattcaaggcactatccttaactccactgggagaaaaattaaaaacatatggtcttggacttcaaggagtttgcagtttaataagacagtacaatttaataataaaatgagtatggctaagagaatacatgcttaaggcttttgagattagtgttaaaaaaactgtaattaaatgagtgtagttcaaaggatagtgctgtaagattttagagaagggactaaacatcatggactggagtggttgagaagggccacattgaattggctctggaaaaaacagacatgccttcatttagtacaggacaggaaatttcgtttagtgcaggcgaaggaaatttcatatgaaaagaacatgaataaaatcttaagaaattttcctagaaagtttttatttgaagaataacagggtgttgactctagctagatcagagcattccaaatgaagtcataggtgtaagcaaataggtaaaaatggattgtggcatgcctagaaggtcaggctaaatgttaactttatcctgtcatgaaaagtcgaccaatgtagatattgtgcagataaatttaacttgcatttgtgggatgactaggagtacatgtgaggatttataaaggtctgaattatagagtgaattaaagagttgaatacaagatagtttttgaatgagtgagtgaatgagctgatgtttactgagtgcctgccttgtaccaggctatgtgccatgcttcttacaaagtataatgcactcagttgaacttagtcaattttgttaccttggaatcttcttgaatttggtaaacatccaaaagacaaaagtccagatgttgtaagacttcagttaagtagattatcagaaacaattattttccagagtaaaggattaagaatcaaaataataagattactctccttgcacaaaatctgcagtaacttcccccaaagtcacactacctctttaaacatacaatctaagtaaaaactatatgcttgttaggcaaacagtgcttcagtacatgtacctagcctgcttccttctaccgtatttccatggctaggcctctaatgtatagaaaatctggagtcatcccaggtgagggccaccaggccatgtgttttccggaatttcctagatttgaggatgctctaaattttaagaccactgtaatatgaaatctgtaagcatcaaaacttattacccagagtggcttgcttactggaaaatgttgcactttttagggtatttgtcttcgattttatcaacataaaacatcaaattaattcaaatcacgtatttagattgaggtctacaaactgtaacctaaagtgaaatccagcctttttcctggatttgtaaataaagttaaattggaacacagcaacagtaatttcttcatgagtagttgatgactgctttcaaggtacaaccatgaagcggagaaattgctacaaaaatatggcctgcaaagcctagcatatttactgtctggcccttttcagaaaaactttgctgacctttgatttaggggcaagataattttgttgcactcttttggtcatgatcaataatacttaaattgatgagtaacagcctcctttgtaaaactaggcaaagtccaaaaattagagggaatggaaaatgcaaactattcaatcaccacagagttagttacaaggattaatgagataacatatgtaaaacatttagaaaattgcttggaatgcagtaagcacttaataaatgtaagcattttgtctcattcacttagtgatctcatataatttcttgatttttaattctgtaatgactcccaaatttatctttagtcaggacctgctctctaaaatccagactcatataccattgcctcccccgcatctccatttggatgtctgctcggcagaatctccatcttaacatgtgcaaaactgaatttctggtgccatctcccaagctggcttctcctgcaaatttccttctcatgaatgtcatcctctccttgttgaaggcaaaaaactaggagtcaggtcagatgcagtggctcacacctgtattcttaacactttaggaggccaaggcctgaggatcacttgagcccaggagtttgagaccagcctgggcaacatagggagaccctgtctctacaaaaaaattaaaaattatctgtgtgtcgatgtgtgcctctggggtcccagcacccagagaagctggggtgggaggatcacctaagccaggaaggtagaggctgcagtgagccatgatcacagcactgcatcccagcctgggtgacagagtgagaccttatcttataaaaacccaaaacaggccgagcgtggtggctcatgcctgtaatcccagcactttgggatgctgaggcgggcggatcacgaggtcaggagatcgagactatcctggctaacatggtgaaaccctgtctctactgaaaaatacaaaaaaaattagctgggcatggtggcgggcacctgtagtcccagctacttgggaggttgaggcaggagaatggcgtgaacccaagaggcagagcttgcagtgagctgagatcacgccactgcactccagcctgggtgacagagcgagactccgtctcaaaaaaaaaaaaaaaaaaaaaagtaaaaactaagagttatccttgactcccctctttacctcataccccatgcccaattctgaagctagtcctgaatactctacattcacaatatatccagaatcatttctcaacatctccattgcctgattcaagctacctacagcactcaccccgtttctggaatactctcttttctggtctttctacttccaatttacctcccttcttatgattctccaaacagtatccagggtgatcctgtttaaaacataagttagaccatgttaccactctgctcataactttgcagttgcctctgtattagtccattttcatggtgttgataaagacatatccaacactgggcaatttacacaagaaaggtttattggacttacagttccacatggctggggaggcctcacaatcatggcagaaggcaaggaggagtaagtcacatcttacgtgaatggccacaggcaaagagagagtttgtgtggcgaaattcccatttttaaaaccatcagatctcgtgagacccattcacaatcatgaaaacagtacaggaaagacccactcccatgattcaatcatctcccactggttccctcccataacacatgggaattatgggagctacaagatgagatttgggtggggacacagagccaaaccatatcagccttcaagcagcctactggctcccacaccagcccttaccttgatcttggctcccacagtctccctgaattccccctctgatttcatttcctgctgttaactctctgatctctctgttcaacaacacttgccccctttctgttatcacaacatgtcaggaatatttccaccctggggcctttgcactggccattcgttctgtctagaatattcttccctatgcaatgtgctacctacttaatgcggtttatgtgtcattttccagatgtcatcactgctgacaagtctatataaaattatattccttcaaccccttattttatattcaccttccctgtgtttctctccatagtttcttattgtctgacatactatattgtttacttatctgctgttgtctctcttctctcattagaatgttagctctgtaagggcaagtcttaacagctatttccccaaaaaatagagcagggcgttgcacatgaaatgtacttaataaatatttcttggatgagttattatttcctttgtcattttcaggaagctttaattgaacatttactatgttttaaacacagttccgaggtattaattatatcttacatgtaagacacatagaggtgaaatgccttggtctaggccattgtattactttgctagacgttccataacaaagcacaataagctttgtaacttaaacaaaagaaatttattgtctcacagttctggagtctgaagtccaagatcaaggtgtccacagggttgtctccttctgagggcttggaggaggactctgtcctatgcctctctcttagctgctggtggtttgccagcaatctgtggtcttccttggctcatagaaaaataatttcaatttctgccttcatcttcatgtgatgttctgtctgtggtatctggctctgtgtccgaattatcccattttataaggacaccgataatatcggattaaggcccaccctaatgaccttgttttgacttgattacttctgcaaagacccatttaaataaggagatacggggagagcaagtcaagtgatgtgaattgggaggtgtgaggggagcacaattccatttatcatagccattgacttcattaatggtaggcctttgattcaaacttggattctaaaactcacaatctactaatatctgaacccgtacaaagatttagtaatatgtattaagtgcctgctttgtgctgtgaactccgttaagaaccatagataaatagagttcagctcctgcccttgaggaactcaccacatagcaggagaaaaagacatcatagagttaagacctattgacttaaaagcacacagaaagcagatcacttgccatttttaattatataaagttttccatctattaggtttattttgccaaagccttctaatgaaatagttacaccatttaatttaaatttcagtggggttgccagaagtgcaattaattgttaaaagttccaactatgaaattttgctttggaaagcagtctgccgtatctttatataccattaaatttgatcatatgcttgtcattctggcagaacatcttgatatacttgaagaaacatagttaggggaaataaaaaaaaaattgttggtactacactgtagggtttccaaatacaaatgttagcatgattgggttataccaattcatcattacgttgcatttccctggagttgaaactacatctgggcttggcagggatgcattatcaccagtcagagtggggaccatgtgtcagtctctcaaagaagatatatggtcttgtgtaccattaggattggatatgcttatgttgcagactttaaatcaacttctgaatcctttctacagatgttgactgctgcaggtctgtaaatagcacagtatattctgaacttcagctgatatatacggccctaaaaaaaaagcaacactgagatacacggcaatagaaaacaacgcaatgaataaaaatgggacagctccaaatttgctgaaataatctcatctgtttaatgacattgtttaaacaaaattacctctgaatttgaagttgccattttctcagatcagtgtggaattgtagtaattttaaaattctagaagtttcttttgtaacctttattatttgatatgtattggatttatttgtaagatgtcaatagattccatttcttaaatatccaactagaaagcatttaattgttcttttaacatttgcgagtgtggtgggcataatttttaagagactcacctattgaggagtcatcgtacccaaacactgatgaccaggcctttacaaagcattttggcctttatttacattctgggtacaagatttttcactgcaattaaaactataaccccaacttcactgaattatctttctgttaccaagactttttattcagagccacaacgggattaaatgaaaatgaccgaagcctccaaaaaaaaaaaaaattccttcataaacagcaaacttttaactaatacacaatgtgcttttaatactgactttaaatcctccctcaaccaggaactcgtgaaaacatgtggtcagtgtggcaaaagggaactgctgggtcctgatttagttgacattctctttttttacaacctggattttatatcattcactgatgcctttctttaagctcatacatttcgtgcttgtggcacaggatactgttttcttaacatcaaatctttatggcactggcaaaaaattttcaatctcctacttaaatttggttcaactacacagtttcactatagccaacagtttgtctggataagcttgcttgcccccagtgtggatttgctgcaaaataatgactgcattaagctgaggaacgtgttccctcatccaatctctctctctctctctcgcccccccccacttctgtctctctctctctctctctctctctctctgtctctacccagccatcccagatccaacccgcacttgcaaaaatacatacatacacacagtatgcaaacacatacccatagtcagcaccctttctgtctttctgagttaaggctgtgatggcccttggggtttgctcggaaacagtcacttccaagatccagaaaggctttgtaaacatgggtcctacctgcacacaagtcagactgtgatcattcccttgtagattatcaaacattccatctactatacagcagcccagaactttatactttaaccattttattctcactctatgaggtctataaagtatttttactggggaaaaaacattatctatgtaattatcatgacctatgcaaaatttagcctaataagagagcccaacacatatttttttaaagtaattttaataaaacaagaatatggtagctacaataaaaaacatttaatcaaggtatgaatagattgctgtgtgagaacagaaagaaaaatataaatgttatagttgggggtaggagaggaaaaaggttggggaaaggcaaactgggttcaaatgagatcttggtgagtttctgtttctccaccaatggagaacagattgcggtggtgggcaggaaggcaagggagtgtgtacaaggctccttgccaggtgagggaggcagagtgcgtttagaaagggggactggttggccgggcgcggtggctcacgcctgtaatcccagcactttggaaggccgaggcgggcggatcatgaggtcaggagatcgagaccatcctggctaacatggtgaaaccctgtccctactaaaaatacacacaaaaaaattagctaggtgtggtggcgggcgcctgtagtcccagctacttgggaagctgaggcgggagaatggtgtgagcccaggaggcggagcttgcagtgagctgagatcgcgccactgcgctccagcctgggcgacagagggagactctgtctcaaaaaaaaaaaaaaaaaaaaggggggggagggaccgattttatgaaggttatggaacaaggaggaagctatgatgtgaaactcggaaaggagcgaattgtagactttgaaagcagcataggaatgtcgtgatgttactctcagtgagtaacatggaggatgagttggagagggtgtggactggagcagagttttcgtgttcggtgatgagatttaccttgagagtaaagacgaaagactgggaggccttgctctattgccagcaaactctatggaattttcctttcagttggaaggctaaagtttcacatctacttaatatgtttctacggagtgtttagatgtgttttagattgagagtttttcagatgaggaagatgactaagtaaaataaatgaaagagaaaattttgctatttcatagtgaaatagaaaagggcttttttcccccttttgctagtagtttaaaagtgacgagaataagtcacatgaatacaaatcttaaaactgaatagaattttgtttctcataggtcatatcatgcctgggaaatctccaagttctttatggcaatatatcagggaatgcagtgacattttcagcatatactgttgccattatttgtgtgtgcatatgtgtagctttggtgattagaaagtcttttattaaaagatgaagtgtggggtatggcacaaaggatttactttgcctcataaaaaggctactggaattttgacttacattttactgtgtgcagacacaagcagactggatttaatttctttccacatgagagatagctaacttcttggaacaggcacaggcttacaatatttctctgggacaaaaccttgaggactaaaagttcaagggattggtgctttaggggacaaggcatggaaatgatacattttctcataaactttaaattcattttggcccaagcagataacttttagctcagggcacttgggtttattagtcattcattcattcatcacaagtttattgaaccatagctgaagtatcaagtcaccagctattagcagaggagaaaatctaaaaaaaaaaaaaaaaaaaaaaaaaaagagtaatttggaactagaccaggaatggctttataacaatgattaccttgtatggattgaacacttactaagtaccaagcggtcttaggtgctggaaatatttattttagaaattatcctggaatgtttgagcttaactatagccttgaaagtaaatgagataacttaataacttctgaagagcctcatcatgtaataatttccctggagaagaagaacaagatgttagattgaaatggaccactcagcatggcgtaagaaccaggagacacagccagagattcaaggaggagaaaggagtcaaaatgacagatgctggattgaaaagtctactggtttggcaggtacaataccatttgactagaaaggagaaaagaaatacgagttaaacaaatgctggaaggggtatgtattaatatgcactcaaaggatgttatccttggagaggagggtacctgggacaaagattactgtggatattatagatactaatacagaggtggaaagaaggaaaggctccttcctagagggtttccattttctgagttgagaagacagacttaactttcctagactcgaggctaagcatagattgggacgcttgaaaagaatgataaaatgaagcattgccaccaattgccattgtggcaaatggaaacggataaaaataggctcatttaaggagaattattggggcccagctgaaagtgaacaccctaatgtgtaagaatgtcatcttgttttatttgtattctcctgttttgttgaaggttgtttcttaaaaaaaaaaaaattcaacttaattgatattcaggtgtaactgtcttgtgggttttactgtagttgtggtaggtttcctaataagtgaaattccttgtctccaggcttaggggtcacacaaacctatgttaaaatcctgtcaaaagcagtaacttgggaagcttcatcaactgtaaacagagaacattttgaccgtatcacagtattcattttagaattagtagtaatgcagcagtggatagcccagtgcagtatcggtgcaataaatccttgctattgccactgtcatttttataactttcttttaaaaacatagtgcttgcttttaaattccatttttaagataaaaattctttaaagttttcttggcctgccagtttcacaattctccacctctacctcccactgcattgcaacaccatttaattgtcagatccacctattccaggaagctttctcaaatacttcagggctacagatctctgcatgtgctgcccaatgcctttttctctgttacatactttgcgacttaattgcattctgtctagaaaccctaacccatactttctttgtatttataataatatcagaccttttatttgtatacataataagtgtcttctcaatatctcatgcatcaaatggagccgcaatggggtgattcagctgagccctagctgcactgatcagtcctgtcctgctaacaatcatgtcagtttctgccattcccctcacccctctcctggccattaattcagagaggtctgcacccaaccctgttattaaattatctgctattaaaatgataaattggtttctacttcagtaattgaatgtgcttgcagactattctttccagtcttgtttttatattaatgtgttaccttaaatggagatgtttcttacatgagcatcatattttcaagaattcattattttatgaatttggatccatttaaaaagaatcttaagtgatctttaaaaatcaaatgaattttccacaaatacaaactctgtagggatgctcattaaagaagacgtttaaaaggatatatagagggtcagaaaactgaacgagaattaggcctgtctcctctttgttagacattgtcatttctgcttcagagtattgtttttatgctgtaatcagactcagtttttgctgttatttcttgatccccagcacactttaatacagaggatctattagggctccctactttaggaaccagataaaagcatgtatctaatcttgtgggtatgtgcatgtatatttttccaagaaagtgtccacagatttcaagagtatccaagggttctaagctctcttttttctcttaaaatataagaaacattgcggtagtggaaaggactttttgattctataacattaagctcaaatacaagttttaccaattactacctctgcaactttggacaaatgaagcgactctcttaattatggtttccttgagttcctgagcgtgtcaagtgggctaaaagcggcaaagtatgcaaagccctggcccacagtggatgcataatacatgttactgaggcttcttccttcttgcctaaaagtcatcattcctaccaaagcactgttcatttcctcttgttcattctccatcagagatagaaaccagctgttcccatctctgtgcacaacaactgtctgtgtgcttaaagtacttaagcacacccttgcccccttaactacgggttaattcctttgacctttcttcgaagacagttgtcagatgggaattttctcagtggtttgcccacttaaggcagtttgtctctggaggcaagctgttgaagagggaagctgagaattgttaacaacagagctcagccatgagcttgatttcttctatttttccatgggagcccatattatctctactttgcggtaagggatcagctcaatgtgatgttatatggttcccatccggcctgaacaccacttccacataaaaatggggagtaagtctgagaaatcaccactttttaaacgacagatgatgtagaaaaaagagagaagcagcaatagtaggggaagcttagagaaagtgtttggaattgtatccagattttctagtgtctgtagccaagaaaagccaaaaatcagtatttgagactaacttttcagatgtctcttcccttactatcaaaatgagtcaggcagtgtttaaaagcacaggcttggcaatttcaaaattgcaaattaaggagaaataaaagaaaatatgcatcactgaaaaataaatggctatgtcagagaacatccctctgcatatctctctgttcaaataattaactaagttttaggtacagaatattgcaatcctgagttcaagaccagctattcacattattaactattaactctatgtacagacggataataggaaacttcatcaaaatagatagatgttcagaaaatcccatgtaccccaacttctctgtgttgtagcaaatgagataatgtaaatgatattatatgtttatgaatgaaatgaaattatatttttgtttaggatctgatttattgtgaatattttcactgaacaaaggcagcagagaaagtgaaaggcacaatctaggaatccgtgctatatgtggattgtgagcaggatagaaacgtcacagaagagtggccctgatcaatgcttgcctcgagggtgtaccttgcagaagggagagcgattcttcagcagaccatcctttggatggaaaacatcaaccctcttccttgttagtcacacattatccataagattctgacttcctcaggcaattaataatgaaaacccctaaatctcttggcaacaactttcaagcctaacagttttctttgtcagatgggaaggaagcaggatctgcgaggaccagggcagacagtgaggaattcctgaggctggtgagcaagggacaaggatcacacagatgcattgccttcctagaggaggcagaggttctcactgggctctgcagtgatcagttgtgagggacgccctgagttataatagcaggagtagctttatttcaaaagaggccattgttgaaagtctgttcaaggttacacttattctaacattgctctcctttgaattttaacgtctttttttgatacaaggagaaaaagatgaagttaaaaagtaagaagttatcacaggagcaggctgtagcctgtgtttcatgtaaggaaaacggttgcaaactgtttgagaaggtcatgagacctgcagcctgtctgcaggagaggggatggagtggaagagctcggcatccatattgtctgcgtttgtcaaggcctggctaggttgaagtttcagaaaaaaagtaaaacctaaaagaaccgctctctgtttctcctaaacacacggacacacgcaagtgcccacatgaaaacagtcagtgaatgcaaaagtaattgctttgtgttagcaataaattgagaatcattggagtttttcagctactttactcattggatatttgaggagaaaaaaggaaatgaaaagtagtgttaagaggtattcacagattttcctcagtagaaagatgtggaaactgaatctgaagaaagagaaaagattggttaaaaagaaatggatacttcataggctaggattttaccaagcttgtatctacatggtaatacttggagctcaaaaagtccatgtgtcagtctatttctaactacttaactgtcgttcattgtgtttttgaaacacttaaggaatatatttatttcctaatccttcgagatattaactcatactgatatgctaataatgccctagtttaaaggtactaaatatactgattgtgtgtttaaaagcctgcacttttatatgacccaatggtaatttaaagcatcccaaggtaatattattattatttatgagtttatttttttttgagacagagcctcgctctgtcactcaggccggagtgcagtgcaccaggctggagggcagcagcgcgatcttggctcactgcaaactgtgcttccaggttcaagtgattcttgtgcctcagcctcccaagtggctgggattaccaacatgagcaactacacccagccaatttttgtatttttagtagagatggggttttgccatgttggagaggttggtcttgaattcccgacctcaggtgatccacccacctcagcctcccagagtgctgggattacaggcatgagccactgcagctggccccaaagtattattattatttatttattttattttgtgagacagggtcttgctctgttgccaggctggagtgcagtggcgtgatcttcgctcactgcaacctccacctcccaagttcaagtgattctcctgcttcagcctcccgagtagctgggattacaggcgcacaccaccacacccagctaatttttgtatttttagtagagacagggtttcaccatgttagccaggatggtctcgatctcttgacctcgtgatccacctgcctcagactcccaaagggctgggattacaggcgtgggccacagcgcctggccccaaagtattatttttaagagttacttctacttcaagagtgacaggaaaaaatattccaatcatttctagagggacttacatttttctctattgaattgtgaatgtttgttgcttttcttgaaaattaattttttgttatactattatttcaatattattaaataaataattatactactaccaattaaaaacaattaaatcaattgttttcaattaaagtgattaattttactatgaaaagagtaatagttatatgctcagggactggaagaaatccaggtaggattatttggaaacttagtttcatttttctatttatgcttaccattttttacttatggggacactttgcccatgggaaattattgaatgttttaattgagttagattatttaaaaactggagacaatgtattggttttgttctattccattgttgtttaattgacagagaaaaaacagggtttttgttttgtttcgttttgatttttatgagggagtctcactctgtcgcatagactggagtgcagtggtgcaatctcggctcactgcaacctccgcctcccaggttcaagtgattctcctgcctcagcctcctgagcagctgggattacaggcacacaccaccacgcccagctaatttttgtatttttagtagagacagggtttcaccatgttggtcaggctggtctcaaactcctgacctcgtgatccacccacctcggcctctcaaagtgctgggattacacgcgtgagccaccgcacccggccaaaaaaacattttttttatttttatttgcttaaaaaaatagaacatcaacagtataagtattaactagactattgaggaattaaaactaactgataattagaaactttatggggaaaactcaagaggtatgaaagctggagtacttacattaaaaagtaatactgttgaaactattcgatttataacagttgcaaggaaaattaaaatacagtgtgtaatccactgcaatgatttcaagattgacagctcagtgttttttttttcccagattactgaaaacattatttaaaacatctaacttggcaagagtatagttagtaactaagaacctgcattctttttttcagtgtcattaactttagtttcctagttaaaggaagattacctttgataatgttatgaacttgatcaaaatatagttgaataactttgaatcttcatggtattttgatgatgcttcttttatcttcagacaatcattagagaatcaagcacatttctgtctctccatagtaaaatgagaacagtgttgcatatcctctctaaagctgtgacaagaatgagtattaaatcctattccaactgccttagccatgtggatgccctatggtttggggctacatttttttattgggacattaaaaacagtttttcttatattggaattttgtattttgtcacattatagatatttgcagttccattccattttattccacatgcatttccaatggtatataactttaatatcagaaaaagtcaatccatgattaccattgaagtagaagggacccttacgttctgccagagaacacatgactcactccagatggacaagaccatatcctatttttaaagatctactctactgaaaaactttacctagcaatatttctgatgaaggaaaacttcaatccaactgggtacactatttttaactatgcaggtaatacaaatagtatatctttccaccctcttccaattttagacagcttttctgtgagtcaaaatgctatgaagaattgcataaggtatttattcattaggtgtatttggaaaagccatagtgtaaatccaacacttggtttggagttatatcccttcgtatgtaacacaatgaaagttgtgttgtggtactttacagttaagatctagtcggtcccagcatctgtatccatgtttaggatgaaaaagttaacttgagtaacaaagtaaaaagaaaaaggagaccctaatatctggctcagaatgatctatcttacaacaaatgacaatatgcaaattcagtcaaagcagaaggataagaactttataatatgcaggtttgtgggtatgtctacagccacattgtttttaaacctccactaaggactttatttttcttcaatattataagtcacccagcagccctagccaaggacagaggtcactgttgtcccagttccagctctgatgctctctgagcatcatctccgttacaccttcctgaagttcattccactgtcagtagctgtcactcagtcacacttagtgatgtgaccgatgtgacattttccatgggggataaataaaaactttacatttccctccccaatgttaatgttatgacttctttggagttaatcgactgacttctttttccttcaactttcagtcagttcctactaattccttaaaggatgtctcctttgttccagctaatgcagctaaaaggaatgctataagtcagaaaaggctatattgaattcttttaagatataaaaaaatttccaacccttataaaatgaaatgtattcatatgttgttggttaatttcctactaatgcacacataacatatatgttggagttatttcatcagtgaatatctctcaaaaagatatactgagacagagaactctgttcaaatatgagccttgaatctactggggctaattatcagtgtagaatggctaagtagaatttttgcatatatcattttatgcagtacctttgtaacaaattgatttaagtgcctttttggaacagtagttgggcagaattgatttggtgtctaggagattgacttacacagcaaaactgtgtctaggtttattctggcatctaaatcgagtttcaagcaagtggaagggttggtggtgctggaatgcagttctccaccaatttatattgtgaagtgctatgacatacattattaaaagagattcagtgtaagtatgatgagttaaaatacccattgacagctggcaaaacaaccaaagcatttgcgttacgttaaaaatgttaaaagtaaattttgtctcattgaaatcatatgatctgacatggtcaaggtagaattgatgagatgttttaattgcaaaactttttgttccacaagataaagaagcatttgtgcaaagtggataaatagggatggtgtgttaaatgtgcatattcaatggatttgtactttcttctcattcaaactccaagcatctttttaagccagagcaaatccagcctgtgtcattttgtttagcttcctgagggcagggactttgttctgtctactggcatctccctatacttgttaaatgcttggggcaaatgtgttcatctttctaagcttccatttcctcgtctgtgtgttggagaatcgattacttcttcttagtgttgtgaatattaaatgaataataggtgtaaagcatttaaaaatgtctgagaatagaagcaccttcctactaattatatcagagaaataaaatggacagtttcaaaactctctgctttaaaaaccgtcctcttattccttcttttgcacaagttgttctttgttgtatgttctgcatctgctatcttttttcctcttattccgttcctctctcacttagtccccctttctccccatcaccctttctttctcttttgtcttttgtttcctaggatatggcctgggtatggaaagaaacccttctctttctttcttactccaacacagctttcagccatttctttgatttttcatattgtgttgaatgctctctgcacttcagccattttccttctgcccatcaaggtggtgtgcttgggagagcaggcagcctgcattgagaagcactctctgctgctgtgggaaccgaggcctttctgctgacagagcaggtggcagggatgctggaattgcaggtgctcacccccaagacctctattcatgagggcccacccagggtagcccaccaaatttaaaaccagaagttgcctttcagcttttatatctgtgcccaactctcttttacatacagttcagaaattatgatatcatgaaaatgtgacttcagttccctcaaaatatctgctagctgcataatcaagggtggtttgtgcattttgtggaaagattagcttaagattgcctttcaaaaattataatatgactttttgcattcagaacattatgatacatccggatatgggttttgaacctattatccttctttgtaattcagaaactgtatatgatggatttaaattttctgaatttaagatgtatcttaaaatagcttaatgcttactgggattgtttaaagtatttattgataatgacagcaatataattcacaaatactatgtttaactgtgaaaaagcgttttctattttatcttaaattgtactttgatagatataattggtgtgtaaaattttacctaaattttaatgcatctcccaaaacgttatttgttggtatgtatttccacattaaaatggtaatatgtaacatttattgaatgttattaatatgtgtaaggccctgtgcttaatatctcatataattttcccagcagccctatgaaatgtgttctaaatgttagtcttaatttatagattaggaaattgaagcttagagaagtttaaaagagaaagaaaaactggctcaaggtcataacactaataaatgacacaactgggatgaaattcttatataattaaagcaaaggcccagtcctcaagttatccccaaagtagagggagcaaacagaaatatgcagtattgcacacaggcttggcaagtctagcatctgtcaggcacttattctatgctgagcacttcaccaagcattgtacaagctctagtcgaacatgaggtaggcagttttattatgcccgttttacacatgaagaggtataggtacggagaggttgaatggcttggccagaaagtggcagagccagatgtggattcaggcactctggtttgagtggcatggatcttaaacccacactgtactctctttgttcacaggaaggcatacgatcttaagtcacattgaattaacattgaaatgtactaatttccacccttcataactgtgcttcccctttagttttttagaaatagcttccctgtagggaattctaaaggatagaaagcattgatggtgaacacttctcccaaggcttcaaacctctccccagtcttccctgagtttcatgctgcataacctgtgtggtacctgattattctatgcaagactgtactacgtataactagtctttctcttgaatgaatacaaatatctctcttttatgtgaaactcatttttttctaacacatactgttattaggatcttcaaatacatgaaaataattcttttccctgatatatattatttacctggatataggaacaaaaagagtttcattaagtaaatatacttttaatcaaattaggaatttaatctgtaatgacatttacaagttggcatactcatttaccgtccacatttacatttctttgcttttctaaagttaaaatctggcaaatactcatttatcattactcagtagtttccaaagtactccatggaagtacagatttatgatatttctcagtcagactctaagagaggttaaaccatgaaggaaaataaaattaccagtaattaaatttacaggcaggtttgccatctaaagcaaatttattgcttcacagtgaaacatagtttagacactttcacataaagtgaatccatttttacatgatataggtattatacattgctgtttcaatttatataattaaaattatatcattgcactctaaggttaatgggatactcaactggaaaccatacgtcgtgggcaataaaatagcagcattgcagtattggctcttttgttaaaagctgatgcaatatttcaacaccattacattctaccttttaaaaatctttagaacaaataagaagcaaagacatgccaatttaaaaaaaaaatgctctttttctctgtctttctctctattccccactccacttcttgtcaaacatatagaaacacatacatgtttaggatatatacattatatattatggaaaatgtacattcagctctgttattagcatggatacacatatgtggtgatagacatgacaggaaaatacatcaatacccattttgaaaacagttttttctcaaattcaaaacaaattaaaaggtgttcctatagtctgttcaaattctagcatgatcaaaagaatgtatcatgcattgcagagctgttgtgggtatatggaggtagaattaagggaagaacaatataatctaatgtctagaggtgaaccagaacagacaagacttctaagagaagtgtggtatctaaaaagggttgagacatccaaagtagtaggcattctttgatagccatgctctaataaatggactcttattacactaagaaatattagaccaaatacaaaagagctgcaaaggaaccaaagagaatagtaaatatgctagtccccaacagagatagatattgattttaaaattgctttacagagtctgctgcattcatcagccaagaaataaacaaaaatgtgttatatttatacaatggaatattattgagcgataaaaataaatggagtacagatacatgctacaacctgggggttagaaaagggagaactgctaatgagtacacagcttttttgggggggtaatgaaaatgtcctgagattatggtgatggttgcacaactgcataaataatctaaaaaactatgaattgtacagtttacacaggtaaactttttggtatgttaattatatctcaataaagctgataaagtcatttgcaatattttctgtctctcggccattttcttgtgaagatttgatgttttacagttttatttatgaagtctttatttctaggcattttttcaactgaagttgaacacattttttatcatgatcaagaatcatattttagttgaagtctgtaaattctagaaggaagtcatagtgattggctatatttatagaccacttttacaaagtcagaattgagtatatacatcgacatgaaaaacctgggttcaggggacagaaaacaacaagccttgctgttctcaaacagttagatgttgtgctctagttgttcttgcacaaagattcctaaatcctttgttataataggtcttgtgaatgaagggtcctcttaatttttgctcttattaactgaaaacttcttagtcctctagtcagtgttttagaatcccaacacaacctctttttttccttctaattgttaaatgcagcaaacactattttcttagccctcatccccagcaatgtcacccataacctttgtctcttctttccattgtggtctcctttttagaaataattgtccatttcttcttaccagaccatccccatcactgtccctaagagccagcttaatgccctcctctttgaaaagcacttcctgatttgcatgccacctcactcttgttaaatcccattattttatttacacatgcattccatgcatgtcatcctgggttgatgtctgctctttactcacatatgcatggctgatcttcctcagtatattgcagtcattttgatgagaaaaataggatcacattttttatgtgtcttcataaatgagtaatgcaattcctgacacaaagtcatggagtcaggtgttcaggaaatgattatttcctggttagtatccatgctatgttgactaaatatgaaactcacatatatccctggacacagtattgagagaataaaaggattttaaagtccatcagccaagactgagactgagactatagtttaggctgaataaaggctttcaaagactgtttaccacttaaaattcacggtatttatattaacttacattaacacaactttgacatcacctttatcttacctgatttcattaaagatatttggatcatgaaaaaaaatatctctaccctatcttagggaaccaaagagcaagtcatcattgttttaatttgccaaagtattagatgacattttcatataatattccctaagaaagacaccaagtacctggtaaataggtaattttcttgagaattgtaatgtccataagtataataccaattttctaatcattgatgggcattttaatttcatgttttattgaccacaaccaggcatagcattaggatacaatgatgaattttgcactgttcctagggaaatttcagctcttatgggatatgtcaacaaggcagctaatgattacaatccagtatgctatcagttgagtataatattctaccagggtgcaaggaaggaagactactccagtattaacacatttcaaagaaaattgctagaaaaaagaatgttcaagccccgccccagaggatgagtaggaggattaaccaattaaaagacatcatgtgaatattccaagcagagagagaagcatgtgcaaacccttggcaagaaaaaatgtatagatactaaagatattatatatataaatttaaactctattgcaaggtcttttttgatgatcatctgctgtccccaacacttcaagcagtaacagagtacatttccccctttattatttcaaaactttctatattttcttagtgatttttattttaatcagtgcagtggcataatgatcactttacctatctacttttcctttctggatctgaacttcttgagagcagagactatgctatttttaacttttcatttctaagtgtgttcggcacatactgccttcataaataattcttgaagtgagctaaattgaatgaatggaagtgcagaaagtaagatgggccagtgcctttttgtgctctgatgaagcacttcatagcttcacaaggaatagatcggagcatttgatcttcatgggaaccatgacacaacagtgcttggtattattttttcctagttagagaaaatgaaacatgagtcaaagaatctcagtaacttgactaagatcacttggtcaccagttttaatttttgtggaatggagccaaggatttctattcaaaattacctgttccagacctgtcccagtacacattatgcaaaaaaaaaaaaaaaaaagaggttttagagtgacctctcaaaaagtacggctttgatggtcacacaacagtgtgaacgtacttaacaccagtgaactgtacacttcaaagtgggtgaaatggtaaatttcatgttataaaatagtggactttcttatccagctctctcctttgtccagagagtgtatacactcttcttgcctttaatggggcttcctagtttttattttctgttggcatctacaatttccaactagatgcaaataaacaaatgccatgtttgtaaaccaaacaaaagctagaaggtaccatttatcagaggagttccagtgggttaccaacatggggttcaaagaccatgggcataacagttaccaggcagacttgttaaaaatatagattcctggacctcttccctagcgattctgcctaatatttctggagtggcgctcagaagtctgttttttaaaacaatgtccctaggtattttttatgggtgatcttcaaataacattttgaaaccacagctccagggtgattgaactgtaatatcagagagccagacctctatagaagctacctcttacctcctgtaagaagcaggatagcagtgcttcagaataggaggtttgagaaacaacagagcaagttcaaatcccagctccgctgcttactagctgtatggccacaggtaaataatgtaacctctccaaaccccagttcctcatctccaaaataaaaataggagaatacatcccgacttggttatagaaacaatacaatgtgttccctggaagttagtagttgctcaataaatgttagctttgagtattaccttattttatcagttgtaaattgcatactttttcacacttccatctgtggaattttacagttattgtcagtaagttattgacactttttattaacagcaagaagtgctaggatcaagacatattagagattatatgaaagagattattattactgtgttcaacaaaactgttgctgagaactagaagttcctgagggtttccagtgggagaaaaaaaaaaacagttttggtgtaggaacagtcccaataatccctaaaaaaaacctcattaatacatccaacaaagaaagcccaaagtacttattccatatcgaattttattaagatttgcaagaggaaagacatacatagaagagatgcatataaatcaagaagcaacagtcaaggtggtgataaaaacataccctgaaagaaacagaattatcataaagcaatgatcacatcagatattatgctatcagtaaatgcttttgaatacatgaatgagaaaataggagtgagggtgagaaaagaccacagcagactttctcacttgcaaatattaaaatcttgagtaaactaagcataagtttcttggggataataacctgcaaatctgaaatatattgatgtatatcacctgaaaggagatttatgtatgcagcgtgtagttcagttcccaccatgatacaaagactttaatctgtgtttctgtctctgatccgttcattgagctgtagtctcttatctccaacattttataaaacattgccattctcctctcctgtgttgccttgataccattatgtttaaaagtcctctcagaagtccagttttcttttctaatttccctggttatgtctataatgccagattttgttacttatcaggcctcaaaccacagacttctacttaacaggagtgtcccttgccttacatcttgcaaattgccatgtttggaatttttttttttttttttgagatgggaatcttgctctgtcacccaggctggggtgcagtggcacaattttggctcactgcaacctctgcctcccagtttcaagcgattctcctgcctcagcctcccaagtagctgagattgcaagtacttgccaccatgaccggctaatttttgtatttttagtagagacgagttttcaccatgttggccagtctggtctcgaactcctgacctcaggtgatccacccacctcagcctcccaaaggctgagattacaggcatgagccactgcgcctggccataaatattttttctttttttttccctgcctcccttgcgcaaacatttggcgatggtgtaccacatgccagtaattctgcagaaataagatgagttaacatccctgcctttgtttatcatattgtctaacaggagagaaagttatttaggaaaggaattcaattaaaactattttttcaaatttatttattttaaaaattaacataaatttgtagatattcattgcaaacatgatgttttgaagtatatatgcattgtggaatgtttaagtgagctgattaacaaatcaattcctcacatagtcatcatttctgtactgagaacctaatccactctcttagcgtttgtcaggaatatgatatattgtcattaactatagtcatcctgctgtacaatagatctctggaacttattcctcctgtgtaattgtaaatagctattatttgaccaacgtctccccaacctgcttcaccttaactgccccagccgctggtaggcaccattttaccctctacttctatgagatcaggtaggcaccattttaacctctacttctatgagatcaacttttttagaacctggaggacatcatgttaagtgaaataagccaggtacagaaagacaaattccacatgatctcacttgtatgtggaacctaaaaatgtcaacttaaattacagaattttactaaataacagcacaagtcaccttaagagttcaaaagagggaacaagggactccccaataatgaaaataattctgcaataattttattatctaataatgtaaacactaatttatattgttaatacaaaccttatttataactaggtaaaacaattctaagatatatttaatatgagttcatcttacagataagcaaatggagagagaggcttagtactttgcacagcatcacatagttgataggttatggagattttagcactaggctcagctgaggagttggtctgcgtcttgaacaatgtttaactctccatctcacggtgataggaagtaggtgcttgaggcaaaaagaaaatgtgcaaaagctgaacgatatggaagatcatataaaaggagaattaagagcatgaaattcatgagtgaaggaatgaggtggaaatagaggcacagcagttatcaaggaagatcctgaagtaagagaatgagagtttgcaggtaaccctaaggaggccaatgtggctgaaatagagagaatgaaagaaaggataaaaatagataaggtcaaaaagggtgtgctgatcagattttggggggaatttgtaaacctttatgacactttgagctttcctttgtaatgaggcaagatatctgtagttttcatgagaaatgtgacaagatatggctctaagaaggcaagggcagaagcagagagatggttgggagactattaggtaactcagacaagatgagatggtaggtgcgatcaggggactagacgtgcaggtaggtcagattctggatatattttgaaaacagagctgagaggatttgctagtggtttggacgcagattgtagaagattgtgatatgtcagtgagaactccagagtttttggtctgaatgtcagtatggatggtgtatccttaactgagatgagaaggcttcaggaagatgtgttttgatataaactcaaatttggaaatacaattctggtaccagtgtgggagatgccttggaaggaatcataagtcaaagcagggaaatcagtttggagtctcagtcatccatgaagagtgttgatgaggtttctaccagtgaccatggcagtggagaatggagaaagggacttgactggggacactgctggggtggttttgggaatgaattggatatagtagaagggggagggtctaaaatggtaatctacatggtttcttgactggccagtaagacacttctcagacttggctctgggaggcctgtatctttccaatcggtcaaatactggaaattaacacctttcctatttgaagatgcttacattcaccgttcttcatatcttttctttgggatgagcttcagaatggggaagcctttccagctcccctcatttctctatgatcttaaaaaatgaataaaccaggttttcaagtttaaggtgctcaatatttttaatttctttggaaaattccgtagtgtcatgcctgagcatttgcagtatcctcttaacaaaactaacctagttttcttgtcttcaatcctaactctccaaaatcctgtgcattgttagcatgctcctcttttccaaacagtttttccattgttgtttgcttattcagcaaacttgaatggctgtaagttctccctgagatgaccccatgttaaattccattgaagattttacatttgcaccagatgctaactcctaactttattacgtagtgttctctaaaaacattgcctacttcactggtgacccactgactctctgacacactgataacagctgtctgcccattttccctgtctgctctgaaactcaatttccagattaatcttcctaaaaatcaaccccaatcaagctatttccttcctctgaaacacatttttacactctattacctagtgatataattacaaactcctccatcccactgacacagtagttctgactcattttgctcattccacacaggtcatagaacagtacactcctagaaatgtctcacatcgactacaatgatctttggggaatttagcaggtatactcaggagcacataaaagagtctccaagtagaataattataacatgtatgaaaccatcacctctctagtccctactatgtgccaagtcgtttttgaacattttaaaagtatgaactcattgaatccacctaacaatcctatgaaatataaactattattgtttcattttatagatgaagcaactcaagcacaatgatggtaagcaccgtgacccaaggtcccatgactaataaatggtagaactagaatttaatttcagataatctggccctgaagtcagtgttctcaattgctctgacaagctgcctccctccttcaattcctgccacccaccacctcccacctctttccccagcgttgaaggctgaaaattaccaagcttaatcagttttaaacaagtttcacataagatctcatttgatttggaaggtggcctgggtcaaccaagccgccaatgactgttccttctttgatctgtgtccttgattatctttctcagataccactcataatttacttaccataaactatcttcattgacctcaaactgtgatatatatatatatatatatatatatatatatatatatatatatgtgtgtgtgcgtatatccatatatgtgtgtgtgtgtgtgtgtgtgtgtgtgtgtatatgtatatctcacatctctccaactagatttaaaaaattttcaaggccgggcacggtggttcacgcctgtaatcctagtattttgggaggccgaggcgggtggatcacaaggtcaggagattgagaccatcctggctaacaaggcaaaaccccatctgtactaaaaatacaaaaaaaattagccgggcttggtggcgggtgcctgtagtcccagctacttgggaggctgaggaaggagaatgtcgtgaacccaggaggtggagcttgcagtgagccgagatggcgtcactgcactccagcctgggagacagggcaagactttgtctcaaaaaaaaaaaaaaaaaatttcaaaaccataatcataattagcactccaaattgctcttttgatttcccaacttcattaatggtcctctcatctaacttcagagtgacccctgtgacctctctgtcccttacctaatccatctttacttgcagtctgtttctaagttttggttcttcatgcatccctaatatcactgttagtcttctctattttttctgtttatagtgtggacatgcctcatgcactgtcccagagtaaggaagcaatgaattgatggttgatggttgctttaggttctcattgtcttttcccctgctgtcatataagtctttatctagtcttccaaattcaataaactaaatttgaacctttgaccccatgtatctgtcctaaattccattgccagtttagttaatctaaggaagaacccgtgtcctcctcccgactatcaccttcctctccacatcattgtctgctgaaataaggatgcattccccagttggtatgaaaaaatctgaaactcaatttccagattaatcttccaaaaaatcaactccaatcaagccattttcttcctctgaaacacactgttacactctattacctggtgatataattacagactcctccctcggcagctccatcccactgactcagtagttctgactcattttgctcattccacacagttcacagaacagcacactgctgtcagtaatgtctcactcagcgcaccattgatttgtcctttccaccccttctcctgttattccactgcatacgttgtaccctcttaggaaaccagaccacaaactactggcataaaaaatgcagtgtgtttccacctccattccctgatttttgccgttcctcccctgcccatccgcttttatgtgttgacacattcacataatcttttttttcttattccaagtgctttcttgctttttttgactgtcagtattttttttaattcactttattcatccttctgtttgatattcgcctcatcttctttactcgatttgaaaattcttaaagacaggaaattggccttacccaactcagtagcccttgcaacatagagtagatattaaataacagtatgttggattgcaataactgctaaccttcagttgactatatatagaaaatatagatcattgttcaaacatagtctaatgcatcattttgcaaataacaattaagtcggaggctaggatgagttagggaaaagccttctaaatttcagactataggaaggacatactgagattaagtagctcctggaatcatctttagaaatccctaaatcttggctaaatatttacctatgttttccacatatgtattttaacaatttgtctcattgtttagcatgaacaccaaacatctctgaaactcagtttcctttcctttaaaaccaagaaacagtatctattttacaaggtggttatgaggaataaaggaaataagagtttaagtaagggaataatttctgcttaaaaagcaactattgcatttagtaggtactaaaaatttgttagtttcttcctcctgttgtgggtacacatggcccacttaactgaaggagtctgggatccacaattaatccttggcatcagagctgagaccccatagtgtggcctgtggagccatctactcaggggacaaccacacataaaccattagccttaagagaataaggaggctctgagcaagacactctaacacttttgcaaacaaaaaatttctattatcaggatttagctatttgatgccctaggattctgtcaaggtaatttgaaggactaaaatcaaatttaaaaggaacggcattctgactgtgcatttcacaattttttctacaaaccacctaaaatcatctccctgactttccgcccagcccactctacttccatgactctaagacaaaactgtgcctagggactgagcagaactgaggttataggtggggaatgacatagccccagctgttgggaaggggaaggctgcagagcctaggagcaggtaaagtctggagcaaacacctctgccgtttttattcatctacacactctttgaggcttttttttttttgtctttgaagtggaaaattataagcgattagaaaacatggaattggcgaagacagaatagtagaaacactactaaatggtttttaggaggcattgtaaacagattcaaattttcttgaatgcaaagttttcctcctcatttcttattactttcttatttttgtgtcttctatctctctttgctttctctttgttctgtagccttctctgaacactgtttctgtcatcgaggcttttaaatatatattgttaaatattattaacttgatgtaattaagcaaaggaaggaagtcagtctaaatcaatggcaaactggagaaataagcaattttttaggaaatgaaggattaatactcttagggatatactgaaactattgaaagcagtaacacactacatcactaaggaagtggaaggctgccttaactcctacataagcacattttggaaatttattgtttgaaataatttgttgtgctacagacctttactgtttaaatagactagtatttattttttttacgaattgcttagcaaaaaaacattgaggatattgagatataaatgcaattcttcgttgcttaaaacttggtgctaataaggtcaagaccacacactaaatctccgtatctgccggttctctctctctctgttgcgtggccacaaatgtatgaacaagaaactcagatcataagcagcagtgggggagaggatgtggatgagtctgtccaatatgccttctcatattggaaaatggctctgttttcatctgatatgcacctgtggttagtagcttcgtatttctttgtgagcatcagttatcctagaattttaaagataattttaataccatcattgttgctttaataatttattttatttgctatttcaactctactatgtggtaatattacttaaaactagatgagaattttctgctttcattgatatttcttgcacgtatatttatattcttctcattaaggctaataatactatgtgagctcatagaattggcattggaattctctgaaggaaaaataatgatccatttcatgagatgagcgatttttacaaactgctgtttccagctcagagtgctttgttcagtgattaaaatgtatttctcaattaaattaaaatgcaaatatagacagtctattttatgattataatagaattatttaaagaaggttttatgtaaacctgctattaatattttatgcataaactgttcgttttattgttgggccggttctgccatgttccattttcaagattactagaagtgctatgaaaacttaatcatactgtccaggttttatcagtttttacccactctactctgggaaattaagtaggatgctttcctatatactttataagttatgccaggggtgttggagaaatataaactactaaaacctcagaatcccctgaaactgaattatgaacaatttactattctttaaagaaatgtttttgttacacagatacagtgactcttaaatttacgagtaccatattttatagtttctcatgaaattaaagatctagaagcatacttcaagaagccattattccaactttttaatttatattagaaatataaaatatttatattagaaactgcatataatgctatggatttaattatgatccttttagggttttcttttttctttctggtgtcctataacttctcaaacatttggattaaaataatctttaaataatattttctaacgtgatcctttttgttgttgttgtttttagtgatctcagtgaaaaccaaattcaggcaatcccaaggaaagctttccgtggggcagttgacataaaaaatttgtaagtatctatttttaaatttatagtgttttaagtcattatctattttcaaagtcaagtttatattaaataaagtgtcagaaagaaatggtgaaaaccctgtgtatatttatgcttgcgtaggagaccttgtaacagtaagttgtcaattgttttcacaagctgtttgacgagatgctcatttagaagatgtctggaaacaagccatcattaaattcattctttaatccttgtgattaatcttttgaaacctatgaagtgatttgattcgcagatatttgtgttttttccccactttttctatcagcttacttcagtaactatgtattcagttgctgttggtgtttattagaaacaaaactgttagttttattgttgggccagttctgccatgttccattttcaagattactagaagtgctatgagaatatggactattattttctggaaatagtagataatattttcttcttagagacacctgtagcctagagctacagctttttccagagttttaagatcaccctttgcattaaataccaaaagcatgagaatgacaaaattatgtctttccctttgtgtgagtgtatttcttacactttccctcatatcctcatgaaagaatgtatttatagcatcctttaaaaaaatgaaagtgcatttctgtattttcctttgataaatctttagtctggtgtttcaattataagcattttttaagtgcctttatttctaaggatgcatatcagatttaagatctcagtgacaatcataatatcaatatctctctaaattttaaaatactatattagcttctaaaaatgatggtttttgatagactatgaatcctaggacataaatgtttttcttagcttttacattagtttggaatgtaggggagaaaagcccctgtatgctgagattaactgtcaggaatttaatatttcttagctagtaataaacagggcaggcactttttcaagaattaacttatattcagaattctccatggttggatccaatgcctttttttttttttcagtagcaaaagtaagacagatgttttcccttgtcaaagaagacaactgtttgtaaagccacagattttggcctctatgtgttctccttaatgtaaatgattttttgaacttgcactttctaaatgtacaggtaaagacagacaactacaggcttctaaggtataaatgtataaagccattaaaactatggctgtaaggtttttatgggtgctcaatttaatatgattttatttgctttctttttacttttgctagttagggcttcaagaagtcttcaggtagactcaatgatacacagtgttcaaatctacctggatagaacagtgtgcaagaattcctatgtagcatttacttaagttgccttcacttagctgtaaaaatacggcaatagctgcagttgaccatcccttagtaatgctatttgcagtcttacagtagtattacctctaattccttaaaacaggtggcttttaatcttcttagttaagatattcagggaatccaagtaaaaaagtggccctcctcccacatttaaggatacgcatggaaatagggaccagtcagtcatgatagaattcttctttatatattttatatttatccttaaaacatgtgatttcaaaagtttagcgataacagaagctagtcagtgttctatctaatgggatgttgatttagcaaagttttcaaatcttttctcccccacaggcataattttttctcagaatttaaagattttttattatcatttatgcagttagatgagtttttttaaaattattaatgcagttagttgagtttaagactggagtctcagaatgttttgttattttttggacttgcagatatgagcaaattagtcagcttcattaagccttagtttttacttttttttttttttttttttttgagatggtgtctcgctctctcacccaggctggagtgcagtggtacaatctcagctcactgcaacctccaccccccgggttcaagcgattcttctgcctcagcctcctgaggacctgggattataggcactcgccaccatgcctggccaattttttgtatttagtagagatgggatttcatcatgttggtcaggctggtctcgaactcctgacctcaggtgatccaccctcctcagcctcccaaagtgctgagattacaggtgtgagccactgtgcctggccagtttttacttttataaagtaaacaatagttatttgggtttggtatggttattagggaaagaagatgtatgaaagacctttcgaaacagtaaaatgctatgaaaatacagtatttcatttgcaagtatttgactaatcaaatgctaaaagttaaccctaaaaaatgcatcataaggggagacaggaaagtgtaacatgaaatgattagcaatattgactagaaatgactattctattgtgggtcattttgacatgaagttacaaaatggaaaaagaaaatataatagaaagtgctaaatgaatatgcacaagaccttgatttgtgaacaaggcattaaaggctgtaggtgctgaggaaacagaaaagtatcgcttgaagttatcagggaatggttagattggaagagtaaaaccatagtgcagtggagtctgtgtgtgtgtgtgtgtgtgtgtgtgtgtgtgtgtgtgtgtgtgtgtgtaatgtaagggatggaatgtgcccaaccccagtttgttttttttgttttgttttgttttttgagacacagtctcgctctgtcacccaggctggagtgcagtggcacaatctcagctcactgcaacctctgcctcccaggttcaagcaattctcccacctcagccccctgagtagctgggattatgggtgcccgccaccatacctggctaatttttgtatttttagtagagatggggtttcaccatgttggccaggctggtgttgaactcctgacctcagatgatccacccgcgttggcctcacaaagtgctgggattatgcacctggccatccctgttttttaaaggcaaagcagtatgtgtcttgaatagccgcagtggtaagaattatagggatctgaatatggggggagctgagtattgtggcatctacattatttcaactttggaagcttatgtttctacagaagaaaaggggcttcagaaactatgtggatgatgagtgatgttgatcaaaagaacaatttattcccactattctcattgccttccatgtaacaatgtgaaagacaatgagggaaatattaaaatatcacaatgaatgtataggtttattttatgaattaggatcacagctgcaatattataaaaattttacattaaaaggcattttctaggattaaaaaatagttcaaactacattgttcaagaaaagttccaatctcatggggtttgtatgaagtttaatcatgaaaacttacgaaggctatctggtaaaatatattataactgagggtaaatttaattcctattattgtgaaactggtgaacataagtcatcgtcatggctcaatacatttccattaatattagcattattaatattattagtatttggtgtaagaagaaggtacagtacttcatcccatgtgtcatgctagtatgtccatttacaagttgaaaaaccctgcatgatgccattgtggctactgttcagtgttactcagagagtaaaagagaaaaaaaagaagctgcccaggccatattttgtatagcactatgtaaaagcccagtctgatgcactgtaacaggtttatgggatttggcacattcaggccttagagcaaattccagtgttcacaagattttcactaaaagcatttgctttaatcttgtggattggctaaatatgctcaaggcggtatcccaacaatatgaaattgatgctgtggaaattttgcagattagcagatctcattccccttcctccaggcaagccacactaaaactattctaaacagatggacagttatcttgctcttaaacatctccagggaggacttcccataacttttttgcttctctctattcatttcttaactcgattaaatttttttacattttattttgctaccttattttctccagccacaatttaaactactttttcccttgacattttacacaatgagatatgctgtgagaatagcaaggtcatatgaaaatatcaactaaattatactgtttataatggtcactggtggtacatttctgtaggatttacatttgtgtttttaaactcccaaaacaaatatgaattaagtattgatagcatatcattatcaactgatgctttgccaaaatgtaaccaatatttaggaaaaattgctttagaaatgtgtgtgtgtgtgtatatatatatagatctatatatctatatatagatctatatatagatatatatctatatatatagatatatagatatatagatctatatatagatatatatatctatatatagatctatatatagatatagatatctatatagatatctatatctatatatatgtagatatatagatatagatatctatatatctatatatatagatatctatagatatatatctatatagatatatctatatctatatatagatatatatctatatatagatatatatctatatatagatagatatatatctatatatagatatatctatatctatatatagatatatatctatatatagatatatctatatatagatatatatctatagatatatctatatatatcgatatatctatatatatcgatatatatatttaaaagccttaacactgatgcagtaaagcctttgctgtcttctaaacaaatattgaacagggtcatgttacattgtgccactgatttgttttcaagtatctattaggcatttccattaattgagaatttagaaaaatgttaaaattaaatctcactttactgccaagaattgtgagcttattcttgaagaactaatagtacttagtaagtaccagaatatttcaaaagtcttttgtttttatgataaaacattcttagttatagttatcctaggattaaagaaaaaaggtacaaatatataaactttaaaattacctagatcactagtttttagtcacatcacaaaaacaaaatctaatttactttaccgttggttttttagtgagttcaatatgattacttaaattaattaaattcaaaaaggacatattttaaatgtactatgtgaggtaaaccacacctgctttctgctgctttaattttgcaatacatccacaaagtgcatcctctattccaatcaaactttactattctttcttcataaataaatatatatttttccagtttgcttgcattatctcaattccattaaccctatgtctgtcatgagtcttataatccttttccaggaacaaaatgcttcttggttaaaaaatatgttggggaaaatatttgtatttatccttttttgtacatgcattactttttagacaaggctttaagtcagtagatgattcagtatgattctctttaggtaagcaaaaatatcatttggaaaataaatatatatattcctatgacattttaggaaggaagtcacccaatttggaatacattatttattagcataaaacgatttggcaaacaggatagagagagttcacctatgtgttgttacagagctatttacattagttagaaattttgtttttctgctggaactgtgtcattttcaagttttgtatcgatggctccattagaacccatagaaggaaaactcacagttctatcccagaggcacagagctgcttacatatttcatcatatttttaattttttctcatttcaaatatctgttttctagttttcactgtcatctacataattcctaatgataagagagcaagggttgctcacttgatatagaatcaatatgtaacaaacagagaaaagagggtatgtaaattttaccaggcaaatgcaagacctcattaggtttgtcatataagttaggtcataattgcaaaatgtcttctttaatctgttagtttttctgtttagttcattggattttatttcaaatccattgatatcagattgcagctgtacatgtccgtgcccctagctctttcctagagtattttcagtaaacctgaagctgaagagactgcaaatggtaggttggtttctcatttatagggattgctatccttactcttaaattccagaggtcttcagtgtggtatagaaccttctgaacaaacctgtagggagggctttttacttagatagatagtaaatgaaggtaaggtcttttattgcctttctgaaatgaaacttaccttcatttcctatgtaactaaataaaaaggggttgtctcaggcattcatatatataaaaaaattagtagctcagcagatgtccccatcagtactatgggaactgtccatggttctgtattttgcttggttgcactgcctctgaaagcacaatgaattgtgataatccccaacaactatgacaaagtttgctaccaataacctctccatctttgcatttttctttgtcttcagagtgctttcagcagtttttcttcaataatgcattttgtcatgtaaagatgtaatctaacaatatttcttcataaatgccttctagaacaaaacaaaataacacaaaacacaagatagtctgattcagcaattgggaatccaattcacatacttacaaaatatgaattggcataatcatgccatggctgctgtgtcttcttatgatacagaatggacctttgattttttgcatctttaacactgaacagtacactttctcacctctgaactcttaaaatagcctgctaattgaattttgacctctagtttatattctcattagataattttaacaaggttgccagattttttcccataaaacattgtttattatctattactacagggtttaaaagtattcagtttatttaaaaagttgttttaaagtacctttgttatagacactatggcaaagccctgggaatagagcagaatgttgccagttctatagtgtctatagtatactagatacagaaactctaggactaggcagaatgttgcctagttctacagtatctgtaggaattacagactctttcctgaaagagcagagatgattattaaatgctgtaacatccagtctctttaggcattctgactactcctagcattctgactttgatccaggctcctagctccttcttcccttcaatctgtacagaagctctttgctcaagccagaatggcctctctgttgcagatattcactgtgaacattgtagtgcctctgctcacaactcttctttgatagacccattacctccataggaaatacccactttattttctgtctaattagattctatccattttttgaggatctgaggttttggtttttttttttttttcctttctttcatgactacatcagcctagagtaatctctgtcttttctgacattctatagtgcttttcatctgctggtctcttccatagtaatcattgatttagctgaaacctccatttggagaacaaaaagttcctgagtctttttcctgagtcactatgtattgagagggagttatggcaatacatacatctacattccaatgaaaacttcacagactatttgctacataccatgtataacttattgaacttctgtgagactcatagtctcaaaatccggatgatgctaatttctccttcccaagttatcatgaggaataataagatgacgtatctacagaccctgccatatgctatgaatttattaaacgttagcaattattattatcattttcagtttctaccacttttgattagttcacttacaattcccaggacttaatgtcaatgtagttgtccttccctcaattgatgttaaagcaggttccctccccatctctactactgctatctgttgcttcttccccccaaattgacaaacatataactttataccataggctactcctataaaaactgaaattctttattcctgtgagaaaagcaaattgttgcctgaaatattgtaaaaggattaaattctcacataatgtaaattactttggggtcctcagaatggtccataccttaattgctttctttaccagttttgaagttaatactgatgtgcttttatgcagaggtaaaggatatagttgctgaaacttatgtcaaggatgtacatgtatatggatcaatttttattcttatactctatatcataatttatatctggggctactctttaaaagcatgattggcataaatattgatatatagacatttgtattgacttgaagtttatacacatatggaaagaaggagaagagaccacgctcatatatgtacagcttttttattctttttctcccatgtggtttatatgttttatttggtttctttacaatagtgaaaaattgttattccctcatattgattttagccatttcgatgtgtcttaagtcaactaaatttttggagttttctatcttacaataataataatacgaacataaagtaaactatttctagcactttaaatgaaacaaaacaatacaaaattggagcatagttataataattttgttgagacattgagagatccagattgacttagaaattattaaagattgttatgttctatattgttaagcacattttatgtgtcttctaattcttaccaaaaaaacctattagttataagaacttataacttggatgctgcagtagaacatgaatttgctatgggtaggaacacactaattgaaattactgcagttttatatagttattaacctaagtgttgtatatgtaattcaaactcagtgtgatatccatattttaaaagaataaagcaggaaattctttaagaaaacctaaatgatggactagcatctctgtttcaggatgccaagtaagcaaatgtttaacctttttgtcatttaatatacctatttttaaaacttatatttagcaacattgtatattgtcccccatacctagaataaatcaaaatttgaaactaggataaattatttttagtattaaagagaatcagatgagcttcagaactttttgcacgtgaggcatacagtggtatctcttaatatatggagcccatcgacacactgcattatgtgagactaaatttaccagcgctggtaaaaaccaaaatgaactatctagagttattctagggcatcagaagatatacctcctaccataaaaaaaaaaaaaaagaatgttaataccgagagatcatgattttttttttttttaagacatggagttttgctcttgttgcccaggtgggagtgcaatgtcatgagttgcgattttggcgcgctgcaacctccacctcctgggttcaagcaattatcctgcctcctcccatgtagctgggattacaggtgcccaccgccacgcctggctaatttttgtatttttagtagagatggggtttcaccatgttggccaggctggtctcaaacccctgacctcgggtcatccacctgcctcggcctcccaaggtgctgggattacaggcatgagccaccacgcctagccgaggtcatgaatgttattcttgaccccatcatttccgtgagattaaagcagttcttcaaaacacaaatttacttggacagcaaaggatcacatagagaggtaatttggaatttgaacagaagccaaagggaagattggagtcagcaaataagggagaagacacaaaagtatgtgctaagttaggtcagctgaaggtctgaaataaaccacttatgatacttctgcccttagcatccaactgtctttaatgatctgcaaatttacactatgtcttagtgaatagttggagcataatattttttttgaagaagtgaaaaagtctcctctggctattttcttaattcagaataatttcgtagcacaattgcaaatcacatctgaagaaggccagcctgtcactaaaggtatggcagagaacagatcctttcctgtttacagaagccagaagtacccagggcttgaaaggtagtggagaagggagtgagcagggtgaaacaaaaagagtgcagctaagtagtccagaaaccctgaaataaattacattgttgcatagttttgacactgtttatcttgaaccatatacagacaaatgaaggtctgttgggagagattttctcatgagcagtgataccagcacaacactttatgtaaaccttcctttgaatatcaaaaaattgacaggttaatgaaagaattattcacttgtttaacttggattgccccttcatatgagtaacctcatgaaataccttcatgttcaggaaatatgtggactcagatataacagtattcagagaacttttaaggaaaacctcagtcctatggaaaccaaacattcttaatgttttagcaccaataagggcttagatttctgttaagaatatgaagaagcgtataaccatgagcaatattaaagaacaatgaaattaccaaagtttccagcagcatctcaacttctgctcctgtaaggaaagtagttggccttccattccttgtaggacaaggtttgcttgagtgctttctggcatgctggaggttcccctttgtgtattgtgtgcatgatttagaagaagctgtgtcagcattgatttatacattgacagctaaggataataagatatgggcaaacatacagctcacccttttacagattaacctggagactgcattaggcaaatttgatagcattaaaagattttgccgatttgtctggaaacaatttctcttttgtagtgtgtcaggggtaacacttcatgccattgtactaatttaaatggctttgataaattgttcaagaggttagagaatagtagtgtagatatatatatagcactttaaaataaaaaaggctattaacttaattgttaaatgaatttaatctgtaaaaatcaaaagtgctcaagaatgtaagtgttttcttggaaccacagcagccatattacatcatgagactttaaatgtcttcttcgaaaataaaatacttctgcattatgtcttaataagtagaaattatttaggctattataatagcatggatgttagctatgatttggggaaaactttagttttataaactaaggcttatacaggcaataaaattgtatcttctttggggtgcacctttgttaatagtgcacgtcctaaattgtaccatttgcatgacatcaaggtagccttgtgtatgattgtgtcccctagagaacttcttataaatgagatgtgtatttcatgagacattgtctatatacataatttctaaagtaaggaacttgaagaggcccatctgaaagtcactggattaaatcattgcacctttattcagtagtcttgtgggagaaacagctattttatagaaatgttcaaacggttctttatgaacagacctcaaatatgaattagccctttcagtgaatgctgaacttgaaacgaggacaggatgcatttgtattacgatcataatcttactcctgttcatccacattctctcacccagtgcgtgcagagctgaaaactcgcctcttccatgaaacattttgtttctatctcaagtgaaacgtcaaaatacttttttaactgaaataatagcatctctaatattcaagctactgtatttaaacaactgcttgttcagaaaaaaaaaaagagtgtggtacagatacaatatagtacttcactgttaatttcaaccaagtagaaggctcaatatgaacaagaaaattttaattctagaacaagcagcaggaaaagcagacataaccaagtttggagcattctttttttgtactatgaattttaacaaataagtgcttaagatattggagaagattcatttacttcaattatgcattatttagaatttcactgatacagcttttaggctttttaccatagatacatgtagtgtttttatgatgtgcctgtagtatatgtttcttagtggctttaaccaaaattagcatctttttaaaaagcaaaattgttatttaatacttaaaaacctattttctggagagcgatataattctggaagttccttaactcaaaagtatgctgtatttacaatgcagagcatttgcatataatgataaagaatgtgaattagtaggatagtgacacttaatatagaacaaatactagctttctaaagtgtatttctggttgggaataagagcaagctatatgggacatcagttccctttctcgatttggagtccttgaaggaaaactgcttttaaaagaaggaaacctaaaagtagtcttgctctctcatgccaaggatagtgaaattaacatgcagctgggcttctctgataaatggattctgttaggtcactgagggggtgcatgtgacattaagtgatttacagtcctttaccttaatgaaattgtttcagcaagatgacgctgaaagctcttaatggatagcttttcttgatctaatgaaattgcattcctatggcatttaatataaggtgcagttattatttactggagctttccaagggctgctatttgcacagacagttcagaacaaaaagatttcagtggcggcatagaggcgagaatggcttatgacattcgtaagcagatgagtgtgtttgtgagggcacttcagtgagtgtgtccagggtatcatagacccttcaggaaacttctcatcacctaccccagctactgtccatcccttctacatatattcttctaatctttttaacaggcaactggattacaaccagatcagctgtattgaagatggggcattcagggctctccgggacctggaagtgctgtaagtactgctatttctcttgctcttttaacgggggctttgtgtctggacaggactaatgtggaagcttatctgctagcttaaaaccttgttgtcaaaatagtctctcaagagataccttaaataactcatggtgaatacagagaagagtctaaatgtgtgtgtgcaaaaccttgcgtaccatatctgtatatttaggtaaaattgtgtaaggtcactcaaatgttctccttataaatgtttttatgagattcatagaatttgtcattgctaaatattgagataaaatcaactttataggaaaaataacataaaaaaaaacctcttagtagctgatatcttggaataatttgtcgttgttaggcaatggaaacacagtttctcattaaaaaaataaattttttaaccagctgatttaacattatttttgtaagaatactttgaaatctgcttcctaaggttaataagccacccattagatccattttcaagtcttcaccactgactttgtaatgtacaacacgcagacttgaattataattggcaacctcctttcctccctgggtaggcatgactgacaaaattggttagaggcaactaagtaacctctattgaccaatgacttagtaattttaatgaaattacaaattttaatgaaaactgtggttactaaagcattatatgccgcctatacatttttcgaattttttcagccaaaattcacatttgtaggttttttaatacacttacaattcctccaccaattaaaatatttttctctgctttatttcatccttgagaaaatttagtcagaaatctataattgaattaaatgttagggtgtttttagtcaatttattaaaagttatcgagaaatcataaaatccttccttttccccacaaaaaaggaattcattactttataaatctagtttcaggaatggaatatcattctgaaaaattaatctttcagctaaaatggcttattttatcagtatttttatatggttttggttttaattgcaagaaaatagaatttccagctgtgtaatgtactgttattaattattttaaaagattgtatgaatgaattgattgggataaaatgtgaaatataaaaatatagactactctctaacaacaggagaggccacctttgtttctattgataatggtctaagtttctatcggaaaaatattcaaagtgcttatcatatacattttagctttaagaccactatttaaattgtataccagaaccatttttaatatacgaaactcactgatggtatctcagagtcagaataattagaatgatttcacagtagtggtttcatggcaaaaccatagtcagtgtcactaaaattcatagatgaggagactaccaaatttaatcaaacagctgatcaagccaaaaatgtattattaaaccagtgttcctaactagaaatatgaatgataccaatcattttatgcaaagtttgctatcttggatgaattaaatcccataaattaccttgttattaagttttcagatgtagttcttcactgtatttattcaatatatgtatatatacacataaatgtatcgaatacctactgtgtatattttacaaggtagagtgaacactatgctaggcactgaaatcttttacccacaaatacaataactacatttgattattttctataaactaatatcgttgtcttcagaagcagtacgtttatgaaaacacaatcatctcatacattttgatcgtcatgattaatcaaaatatctaaaaagtgactttagcaagaatgaggcaacacaccaaagggtgacattttatggttcatggaattaaaatagaaatccaaaatcttggaaactcttttgaggaccttaatatatacatcttatagaagtatatattggtcagagtttgtttgttgaagaaataataaaaattagcatatgatagaagacaatgtaaatttcttctaaaaagattgaaatattttatattaaaattttataaagttgatcagacattactttaaatgtttttttttcaatcctcatactttaaacaacccctagaaaaatcagttgataaataacttaaggcaaaattggagcactgaaaagacgataatttatgaagcccaaatcacttgtgaaatacaacaaaagtttacctattacaaatgtttggtcaagagcttaagagaggttgcatgaagaagggttctagaaagatgactgtctgttttgcttatttttaccattcgtgactctttaggatgtactgtcttatgtggaaataatgaaggaacattaacttacacattgccttaaatttcagattccaagggttttagattttttaaaattttaattccttgagccatttgtgaatgtatgactatactgaagctagatgggagaaaatgaggtaatggcccttggtcattgatgaaaagtatcaaattaggatatatatgagcgtacaaagagtgaacagagtccaagaagtcaagtgaaaatctaaggtggatgaaagcaaggaagcagtttaacacttgcacgttcacggagaactggtttattgtcagattctgatttgtagaacttagaagtaactgcatattttcttaatatttagataccatctcaaaaataacattggaaactaaatcttgatcagtattttcccttctttggacactggcctcagaaatgaaatatatcccttgaattgctgcttttacatgtttatttttctttttcacagaatgaacataatttagtgtaatttaattgtagtgattcatatccactaaataccaaactctgccaaacgatatgcatggtggtaagggaataagatgactaaatcaacatacaagtgtgagaggtgctccatgattatacaggctaatatttatacatcaagatgtcttttgtattagaatactcattacaaagaaaatcttgaagttgagcacagaaatagacttacacatgggagaaaatgttcacaactaaataattacaatatataaatttccattatttcagaatggaagttgaccataaccataacatacacaagtaatcatacttaacacttatatttattattaattttaaaaataattttgttggttctgcatatttttcagtcattgagtatcagtatcagtacttctttccagcatcagtacagaataaaatactaagataatgtattcctttagttgcattatgtgaactaacattttgagaaaagacttcaaattgataactgaagtttttggcattcaatgaaagttttcctttgcatggagatataagaaactatagttcaaaattaatgcatgtctgctctctgtgtagtacttaaaacaatttattcccaaagtcatatttcagaatgctatatactataaagattttagccatattaagtcagcataaattttgaggatgggaaaagggatcatttgaaagcaaatcccattgagaagtttaacctttgcattcaaacatcaggatatattttaatggcatttgaaaaagacatctcatttcacctgcacataggaaaatgctaaaagctcttaggtaaactgagccaacaaatccagtgctctgtaggtcccccataaagtggtttattttttgtgacttaattcaaatgacttagaatagttcttatataattcaatacattgcaaaacaaggtggtaaagagggtccatgcatgatctgggtctctagctgacatgccctgttttactgaaaagtttttgtcaatctcttgacctctgaacgcaccatcaataaccgcagccaccaactggcccagagtggcctcaaaaatatattttgtgtagctcaaacataagcggtctacagactgtttgaaatgttttaattagttgccactatttaaacattagaaagatctaaaaatttttatctctagcttcccttggaaaatctgattgtttgacagccctcccttacagcaggtcagtagtccattggagctggagattatctgccacaagagagactatcattgctagcttaccatattcttcacattccccaaatgtctgctttcttccatctctcttgcccatcattgtatatttttgcacgtggcctgcttcgctcatttctgttctctgctcaggccctgcagtgaacttgcaacccctaattcaaatccttgtccagtatcaacttcatccaacaggaccactgatgctctttctcctacctccttcagaggaacttgccttctttagtcaacacctcaatgtgtacctttagtctctcccagtcttagaattgctttccatgtctacactttacttgtataccccccgggataacttctaccactttcttatcacaaccagatttttctgaagggtgatgaaagctcatatgttagccttattagtttttgtaatttgtccaatcatctccccagctggactgtatgctatcttaggacagagtatatgcctgatttatttttataatactccatgttaccataaaataatagccatttgggaaatatttgatgaatgaatgagtagtaatagaagtagtaataatcaataataataataataaaactaacaaagttgcactgggggaaaagtaaggatgttatttattttcacaataactcttcaccacacatattcctggatctgctacctcaagaaagcatgactgctgccacacagcagtaaacaaaggtgaatatgctactgcaactaaaaaccattagaatggattaatcttttaacacggtgctacagcaagttacttcatccccacctggtgcaagtaccagatgtagatatagctgtttccactcaaatttcagcagtggctgatgtctgcggtaaataatagttatcaggactctgttccaaagcctgacacgaatgattctgtattgttgctatgagaaatcagtaaaagaatattaattcaaatacgttcattgactcatggacactaattacacataatgccactctacggaaatgtaattgggcatattttccaactgtaactatcccgtgtttatttcttaaccaatatcctaaatagacatgcatgcacaaggtacataaagtagaatgtaaatagtcaaacatgctatgaatgaagccataaatttgtagtaaatgttgaataaaacaaaatgtacagtaatatgttaaattatgaaattatttatcaacttgtctatagagtagtgcattctctatgtcatctctaccaggtagctgtcctgcataagcatagtacaagacgttttctctatgttaatatataaaatgatcaatcaattttgtatctaaaaattctaacttttctttttaattctacagcactctcaacaataacaacattactagactttctgtggcaagtttcaaccatatgcctaaacttaggactttgtaagtagtcacaatatatgtaaaagtcatattaatcaattaaagcttccccttaaatagcatgttcagtaagcaaaggacaggaccactggtttacaaggtagacaaggaaaacccaactttggaaaagactagatatgatatttgtgggaatgagctattattctagaaactggaaagatttcttttaactgatatgcattatggaaactttggagttaaaaaaaaacaacatttactttgagctattgtggaggtcacatttcattaagaaatggaagactccttgattggctgtcagaaatgataaatgggaaatctttatgattttattactgtactgcaagcagacctaataaagctaaactggttcttcaacattccttataacgtgaaattatagcatcaccctctagtacttctataattaagattgtgtcagcatttatatttaaaaatatctttctgggttacagatggacattaagatatttttggtctaataaagtattgactacagctgtttcttttctcttgaagaaaaagtaatccttaaagcccagagtagcctttaaaatctttaaagcccagggtggactttaagttatagaatatcagaggtaaatctcatttgaactgaatttcagaatcaccttgacctaaaaaaatatattacatataacgtgtaggacatgattggaagcaaaaccaaagcatcaaacttcttgaaaaaaaagtgtttttaagttgggtaaatatattttgattagattttcaaaatactcctcattttctgatagcttgtaactggaaaatattaattttattttcttaataaaaattttgaattaccatctttttaatgaactaggtaataccaattttaatgtcatttttttcttactgaaatccaactctgtacataataacacatcattataatttccttggaatattatttagcaaaataaaggaattctacaagtatacagacatagctaaattttgcattcttggggctatcagaataagactaatctgacagaattaacagcctagttcactcaaaactataatttcccagtaacttcaggtattttttttaaaaagaaattgattcaagctttcaatctttgcaaaaacaaagccaatgaaattgtaaaaacattcatctgaatttttgacagtgtcccttattttcttgtagaaattcgtgagtttgtcttactaatcaggtttttccatttttacattcttttctcatttcaagttcctaattggaatttttataatgtgcttggtttagacggaaatatttagagtacaaggatatggaatgtgcctctgtggcttccaaaggccagaacttcaacttccaagcaaaccgagcaagaggtcacccatctttcccaaaatgtagctttttgttctgtggtacgccttctagttgtgaagcaaaacattgtgttccttatctataagctcaaggagaatgcaaagcagccattttacttgaaattcctttgctttggttgggtcattattctatagtatcattgctacttaaaaattccatttttatagcctaattatctttctggactgagttccatgttttaatatccattactgttattgggttagaattgaacacatcagcttaaaaggactaaaatggtattactgtgtcatagatggttctgggaatggtgctttgatttatagctttggatgtccttttctttagtttgagaaaacataaaagccagtttgaagtcatttacctaatttagtggatacatttgtctgatattttattaatggagaagtgctatttgccacttggaagcaatccatgatcttgtgtggatcctgccaacatagagcgactcacttaattccttcactcccagacatttgtgccttttaatttcagtccctgctctttgaggctaggtctccaggagccaaaggagctaatcccttttctgtgattaaacaacaaaagaaggaaatgagaataagggtgtgaaaaaagtgttttatattgaattattattctgtcttgttcagcaaaaaatgcaagtgtcctgctgcaaaggttttataagcggtttctatagagactcataatggcaggaattattgatatttcaaactgggagccacaacttttactaacttgcccctcgcccagtctccccattctcccaccccacccccattggctctcaggatgttggaactgtggagcaatttgcattggacttatttttttctctttcctcttttaaatgaacgtaagtgaaatatgttcgtttaaaacataattttatggacatattcaagcttctataaattgctcagttcagactaaatgaagagagacttgattctgtgattgtacatcagtttaatttttaggaaaaataattatattggaatctgcttagctttatctacttctatgttaagaaatacaggtatatattaatgaaataacgactttctgttttcttgctttacacttctttttttctcatttagtcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtaagggagaaggaagagtgatgttattgtgtttattgtatcctgttatgtaacagaatgtgagggctgcatgcgtcaaaggtttcagtattgttcactaatgttcaattgtgcactaatcactctacagagatcctctttttcagtgaaaatatgttctgagacctcactatatcggttggcaagtactggttacttgtatctaaattatgataaaacacttttcagttttcactccaggggaaaatatggaaaatcgctaaatgatgattctacttttgattttttattttcccattaagtaacaatttatagctacttttatgttaacaattgaaaaaaaatgattagctaatcctggatccctgctatgaaattcaaagagcaattcagccatagttgcaaagtaacaaaatacttttcatgcatacatgtatactaatggttcagttttacttaaaacaaatattaaatgaccagctttaataacaaacatctaaaaacaaaaataagacatagggtcaggcactgtggcccacgcctgtaatcccagcattttgggaggcagaggtgggcagatctccagaggtcaagagttccagaccagcctgaccaacatggcaaaaccccgtcctttctaaaaatacaaaaactagctgggcatggtggtgcatgcctgtaattctagctacttgggaggctgaggcaggagaatcacttgaatctgggaggcggagattgcagtgagctgagatcacaccagtgcactccagcatgggtgacaagagagaaactccatttcaaaaaataaaaataaaaaataggccggggtgtggtggctcacgcctgtaatcccagcactttgggaggctgaggcgggcggatcacaaggtcaggagattgagaccatcctgggtaacatggtgaaaccctgtctctattaaaaatacaaaaaattagccaggcatggtggtgggcgcctgtagtcccagctactcgggaggctgaggcaggagaatggcgtgaaccccggaggtggagcttgcagtgagccgagatcgcgccattgcgctccagcctgggcaacagagtgagactctgtctcaaaaaataaataaatcaataaaataaataaataaataaataagacataggctgtgtctaatatcaatcaatagctaacgtttactgagttttttaatatgcttaagcaccaacctaagtatttcacatatatttacctcacttcacctcccttataacaactgtatgagaaatgtaatattatctctatatttggagattcaaatgctgtgaaaaagaatatccttgccaaagtttatgtagttgagtccagggatctcaatagaagtggtttgattacatatatacacacacacgtgcatgcacacacacacccccatacatagtatcttatttgtatatgtgtatatatatgtgtgggtgtgtgtgtatatatatatatgtatggttggttctgcttcagcttcagaagtatctgttcaaaatacaacaaaacaaaattttaagaaacgtataatgcatcgtaagtagttcacagatttttaaaggcagggtagggagacatgactagtacttgatgctattaaatggttatattttagacccttgtttgtgttttttcacatgttttataacctaagaaaaatttttgtataatatcatggaatgttctcaatatgtctgattgcttttttaaaaaattaaataatgaaatgactaacagttcgttactaaccacttttttctctcttcactttttcctttctgttttctagatgaggaagaaggcaagttcacatttcttttttagaccgaggatatttttgtagtttaagagcttgtttagagggatagaattagcagctggcttgcagcctcttcctggcacgtcaccaccactagggccctttcctggcaggttggaaagggcagtccccactgtcttccagaaaccatgcatgtccagatgcttatttaatacaactgtgctgatattctgttgctcacctttcaaccattaatgtctcatttaaaaattgttccaaatattgagtaataaaagtacacacaggaagggagctacttataccaaaatttaaaattacccaaagcccccaaaagaataattttttattaacaataagatgactttatacaaattattattatgatttcagataaattgataattttgaacctatcaagacatcaaattctggcttatctaatttttccccacatttattggcatatgattatttaatttgagcaacaattatcttctgatggaagtactactgttttgttttcttttttaaaagaaattacaaagtaaataaagctgcatgaatttgataaagaccaagctctatttaatcttattaggaatgaagataaattagtctgaagttgctgggcttttggaaattagaatagttttgaatgtaattctgattttaaaactgaatttagcttttctcacaagttttaaaaattagcagtcttatgaccagtttttagaatctcatttacttcctctcatttgctttattgacctgaatatataaatgcatgcctcctaaaatatattttagaaatataggaccattttatcatcatgtatttaaagagatttatttatgtgaaatgctttgttacttgagctaagtttgtctgtttcacaattatgatattcaggaggaaaaatataattcctgtttatttcttttttaggtcaccagtcatttatggctccttcttgtagtgttttgcactgccctgccgcctgtacctgtagcaacaatatcgtagactgtcgtgggaaaggtctcactgagatccccacaaatcttccagagaccatcacagaaatgtatgtgcctgaaattctttcttatctccccaccttcccggtgaaccaaactttgattttctttgggaaattctgagtttatcgaaggcacatctgatcaattggcttagacaaatgttctcttcagaaatgtattgattcttactctgattgtttaaaaacataccatgttaaagtggctgtgatgttttttcttccacagatagaattaaaaggaatacattttttaggaaaaacaaggcaaacaggattgtttatacctggttccaccctttgggcctgtacatctgtggttgtccatttctcagtttggagcagtaggaatataaaaagggaccaagctggggttagtaaaccacagaaacaatacagttaggtgatgctctgcctcctcgagagctcatgttttaaaaggcagtttcactgttttgtttgaattgatagttcaatgcaaagtgaagaaaggataacataaagtcaaatgtaaagattttttatatagtgcatgttttagcctatttgaagcagtgtctacctccattaaaagttaaattcttatgacaaactattgcacacgtattttgtatgcagctgctgaatgcatttctatgtcctcaccaaatataagtcatgtggataaaacaaggtcacataagatgtaaaatggaatgcttttaccatcttgaaaagtaagcactagggaaaattgttacctcaatattcattgacaaaaccccttttaaccacccagcccattatattattatgttataggccaattctaaattgtaactaaataaattatcttggatttttggttgaaataataggaacaacttcttagaataggcctacatagtatgcgaaaaagttgtttttaaagcgctcatttttaaccaatttatttaattatgataataaagtaacttatctaatgtaccttatatgagaataattttagttcacaggactcactgccattagtttaaagtatctaccatgtgcttaataatgtgcttagagctttgcagtataagacatgaacctctgcaggaattctagactctgtgaagatttgacactgaataacatataaacataataatatcattctcatcaaaattttaattgatagaacattactttacctctagaagacatcttttagtattttttggctgaaccttgaaagaagaataagttataacttgggaagagacagatgacattactgaaaaagaaacattggcagcaaagaacagaggtggcagtaagcattgtttgagagattgtagttgaacctaattagaataacaggataatgttgaggcatcgtgaaatataatgccctaaagaatacatctccatttgattttaaaactacagattactgaagatgttgacacttgatgggaagatattagatgtgataaagtaaagagtagaacgaaatactaaattttctcataagggaactatatagtcatctatgcaggcacaaacatttattaagtgactatttactacctaaaggcaccattaattttcctgagatcatccatcaagtggttagcaaatgtgacatgcaaattgaaaactattaaatgagatacacagtgaaaaacataataagagatgaacacatcaagttcaaggtcttacaaagggcatgaagttgagggcaaggtacgatggttaactagagtcagaaagttttagttggaaccccaggtttacctatcatttactatttgtgagaccatggacaagttacttatcctctgagaccctgtatcccatctaaaactaagggcggttgtcagtttgatgtgaaataattaacacacatagagctatgtgtgctttgcatatagtaatcattccagaaatgataactcaagcatagaagtctttgtgtagaaataacactgagctagagcttgaaagatgggtagtgaatgaaactacagagatgaggacaaggctttcagaattaatgcaacatcatgagctaggcagtaggaatgaaagtacaagatgtaatcaaataggaattcagcttgcctgatacatgagatagtaccaggaaacaagttgtaaatatacattggagtcagttcatggatggtcatgttgatataaggatcttggattttatttggaatgcatttgagcataggagttttaatctgacttttctagaataattggtctgatggctgtgtgccagtgatttgacaaaaggagagaatgcaaggcagaaggcctcttcggaggctatttctttggtccagtggagatgtcagaagagtaggagctagtcagtgacagtaggaatggtgatatggaaacagctatgatagcaaacatagtagcagaattcatgggatttggcatttgatgagataaaggagtaatggagaaaaataaaccagactctgccagagtttcaagtatgagtgatgcggaggttgtggttacatcattgtgtataagaaagtgagaagcgggaccaaaactggaaaggaagatgacagtgaactcaatttgtgaaatactaaaggaccagtgacacatttataagtacaaaaattgggctgggtgcagtggctcacgcctgtaatcccagcactttgggaggccgaggcaggcagatcatgaggtcaggagatccagaccatcctggctaacacagtgaaaccctgtctctactaaaaaatacaacaaaaattagccgggcgtggtcgtggatgcctgtagtctcatctactcgggaggctgaggcaggagaatggcatgaacccggggacaatgcttgtagtgagccgagatagcgccactgcactccagcctgggtgacagagctagactccgtctcaaaaaaaaaaaaaaagtactaaaataatacagactataataattttggagcaagcaagacaaggacttgaggcaaaaattttggagtaattaacataatagaaaacagtcaatatttgaaaccatcaactgtctaatgaaaaggagagtaagagaggagaagctcaagaacctaaataaaaacagcagagggctctaataagtaagggaggaagagacttctaggaaaaatgatctccggaggcaaatactgctgccagttaaccaagctggggtctgagagaaggtcttggaatttgacctgcatattgttcttagaaggttccattttgatagagtggtaggtcaatgagccacctttcagactgtaaagaaaagaagtattgattaatattcaagagagtagataagccgcagtttgaatagtttggctgagaaaggattttttgaaaaagacaattgttgctctgtaatggacaaatttgggttaattctaagatgcagaaacctgtcatcattagaaagtcagaatgagtttagagagaaacgagagtgtgagagttatataagatacatgtgggagcaagatcagtctggacacaggagcgaattggtcaaatccagatcatagggaaggggaacaaaaagctgttacaggttgataaaaggagaagagtaagatggagacataacatattcatatagcaatatgaaacatttaaaatgattttcttatgtagtctattttatttcttatgatcgtgattttcttctactttgtatgtgctatagattttgtataatggtgggatttagttgcattaaagttatactaaataatatgtcccgtggactttgcctaaattgagaaggtggtgtatcaggtaaagctacaataaattaaatttatgaggagagatgaaaacgtgtgaaactgcttgtgaattttacttccctgattattacattatcagctttatcagtagagcatctggtaataaataatattgatcctcaactcaacaagataattccattttcattcattatagtggcataacttactagcttagtaatttatttcttttattactcttttattttttataagaacaaagaacatcactaagattattaaatgtggaaatatctttatagatggcaggtttttattccatgatgaactgaaaattataaactctccccattttattcaaatatattttcatatctgaattttaccataaattgttggttgagtttctttattgcaagttatgagatatttcattcaataattttgacttgattctccactgtgtgatatgtctttattcttacaactgtctcatgatataattctaatgaaaagaaagtatatgtatgccatatatgagtgatcaactgcctataaatctaagtagaaaataatgactcattttttctgctttctgtttccaactacaaattcatacttctgctatttggtaacttcaattatttgttaagcaatagaaggaaaatattcctttaaagtcagaattagaataatttggagaaggaataatagaaagagactgacatttattaaatacttgcaatgttggattgcagttggatcgcaatgttggcttgtgcacatttgatcttctcattgacctggtgatggggatatttatgaaattaaataaaatagtaaaactaatgcagaagcacaggtcagataaaggctggtggttttctccaacaggcctcattatactgatcatgttaccacagtgcagaagctcccctcttgtttacaggttagaatctgcttttgactgtccctaattatcgtattttgtaattatatactattgtgtgtttatttttaaatatctatctcttctactgaagtaaacgttctatgaaggcaggaaccagttctgttcttatcactactgatgacccagcaaaaaatctagtaccttggcacatagtaggcacttgataaatatttattgggtaaatggaataatttaaaaattaatcagacatttggaacagatttgtctctgaaaagatgaagctgtattaaccaaatttgataaatagaaccagaggaacagcctattatctccctgtagacaaactggtaatttttaagcataaaatcagcaagagaaaaagtaaatgcatagaatttttaatagcatgggccaaaatgggtctagaatgctaaaaattcattaaatttccctgttctgcatacttacttggatttccactctttaaatatttctgagattttttttttttctattctcggctgaccaactcagcatttaataggtaccctattatggagctatattaatttaatcatcttacagatgtcttagacatctttctctacagtcatattccctctctaatgaagcctgtagacatttaactcaaatctttcaaagactgagaactttgttgtttaaaaaaaacttgggaaaaaaaaaaacaggctcaaaaaacttagaaattttgtaaaaaccttcaattgtgaagtggctaaaatggcttcaatcatacatttgcttgactctcaagcccatggtcctaacttgatcaagctataaaagaggtaggcatagcttggtcttgttggaatgtcattaaaggaaaaattttcaaaatcatgaagagagaatgactaatactccgacaaaaaggacaagagaaattttaagaaacttacctatgaagagaacgtagacaaggcattaagatacaggattgtttgcaaaactaagagctgttttatattactttatatctgtaactattacaatgtcatctttcctattctccgttaaatgttctcttatttccccgaatcttctccacacagcacttaccacagtttaacttgttatttgaaaatgaaaaactctcctattaaactgcagactgggtaaaggtagaccatgactttccctcaccatttctgccccaatacttagcataccatgggtggggaagacagtgttgggagcaggggaaggagatcttggacacacaatctagagagcttgcaggcctccattctttatactaaaacaaaacaaaacaaaacaaaaaacgggcgtgctggatcacgcctgtaatctcagcacttttagaggccgaggcgggcagatcacgaggtcaagagatcaacaccatcctggccaaaatggtgaaaccctgtctctactaaaaatacaaaaaattagccaggcgtggcagtgcgtgcctgtagtcccagctacttgggaggctgaggcaggagaattgcttgaacctgggaggcggaggcagcagtcagccgagatggcgccactggactccagcctgggcaacagagcgaggctccgtctcaaaaataaataaataaaataaaaaataaaatgtgacaaagcagtgtggactaatgaagaaaatatagaaggggaaaaagtagaacatataatgtaagctaaacctagctgtaaaagggaaagctgtttgctgccttggggtcatcccagcactttgctgcgttgaactatgctagttgaaaaccttattcttcaatagttgcaatgcctcctgtgagtctgtacatgatctggtctatggcaacacaatcattaatagcaaattgattctgactatcaaatcttaagaattaattacttagatcaccttttgaggtatacaattttgaatgtgatgtgatagattgctatgaagttagtatttagttctcttcaatctagttatagatttcctgtggcatattgccttttcaaaccattatacagaaatttcataaatcatggagaatatttagtaagaatgtaagttataacaatttggtttgttgtgtttgctcctatgtcctcctgcctttactctttgctgcctttttcaggggctccagctccatccatgttgctggagaggacatgatttcattcatttttatggctgtatattctaccgtgtcacatatgttccacattttctttattcagtcaaccattgatggacacttaggttagttccatggctttgctattgtgaatactgctacgataaacatatgagtgaaagtgtcttatataatgatttcttttcctttgggtagatacccagtagtaggattgataggtcaaataatagttttattttttgttctttgagaaatctctgtactgtcttccatagaggttgaatgttgaactaacttgcattcctaccaacagtgtataagcattcccttttctctgcatccacaccatcatcttacacaagtcagaatggctgttattaacaattgctattatttatctgatgattagtaatgttgagcatttttttgtttgttggctgcttacatgtcttcttttgagaaatacttgttcatatcatttgcacacattttaatgggattgtttattttttcttgttgagttgttagagttccttgtagattctggatattagttctttgttgtaggtatatgttgcaaatacaattttaaaagtgtctttttctgttcatttctgtttagataactacctcccatatacgcttaaactttttgcttgctatttctgcatttgtcccactcaaaatattgaatccttaatttattaaataatactcaattttgaatccacatatttcaaagtcatctgactttgttttttgtttgtttgtttgtttttgagacagagtctcgctctgtcatccaggctggagtgcagtggcaccttcttggcttactgcaaggtccgcctcctgggttcacgccattctcctgctcagcctcctgagtagctgggactacaggcgccccccagcatacccagctagttctttgtatttttagtagagatggggtttcactgtgttagccaggatggtctggatctcctgacctcgtgatctgcctgcctcagcctcccaaagtgctgggattacagggacatcacgccatgcccagagtcatctgactttttatatgtaaagatatgcaagttagatttgaccaacttgccttgagcctattatgtactggctgatttaaaataattataagtactcatcaaagtatgaatttttgattgattagcatgtatttagtaatatttcaatcagcagaatatctatcatgctatgcaagtagtttattttaaatatgctaaatgttaaaaaatacagtacaaaacttgactaatttttttacagcacatatggatgaacttgactactattcagacaatattgataaaataagtaaggcaaatgataccattttttaaatgtaacatggtatgaaagaaatagtcaatattctgagtttgccttgttaaataacaagtaggttggcaatttcaaagtgcaattgttttcactttgacagaactttattgtttcattgtgaaaatattttaaaacataaacatattcaacttaaggataataaaatgtaatggaaatcggcataatttagaaaatgttataaaagttaaaatttgagcaattctactttagttcataattttattagagcacttcttaacacatggagcatttgttagcattttgcagttttacacattcctgatattattgctacttcaaatccactcacaaattagctagcctacaacattactttcacttcacattttatgtttttataactttgtgcttttcaggcaagctaatatgaaaacaccctcaatattttatgcctgttagaaatatagatgacatagtactcttaaaaagtgtcttgtatcatacataataaaaaccttctttatgataaaaaaaattttcaaaaatgttaaattatttatttcacttaattcccatggaaacactatgtaggaaactatacgtctcctaaaggttaggaaaattcttttaatttttttgtagtgtagaaaatagttttgttagtttttaaagtgaaaacctggtttgagataagaagctatcatgccgatgcaggcaattagaattgcgttctcaaattttcttctgagatcctcacaatagcagaaactacatatgtatctcctatgtactatgaaagtactagtttttcctctatcaaatacaacttgcctagaaatgtcattaaataaacaatcctatgattaaacaagtcagtattattttatctctgattctgtgctaatatatatatggttagaaaaacaaaatgcaatgattcttctctagattatttttatgtgagtttagtagtcttaatgtcattgtatgtgaattttttatgtaaacatcattcattattatttttattttcttgtgtttttggattatattttcccaagttttcatattatgatttcatcaggtaatcccagaaaaagaaaatattttggcttcctacagacacagagcacctcattactcagcatacaaaatagtgttctacaatgtgtttccacagaagaagcttctcatgttaattttttttggggggaggaggttgagatctcactctgtcacctaggctggagtgcagtggcgtgatctcggctcactgcaacctccgcctccagggctcaagcaatcctcccacctcagcctcccatgtagctgggactacaagtgcatgccaccacacccggcttttttgtcttttgggtagaagtggggtttcaccttgttgcctgggttggtcttgaactcctgagctccagtgatctgcctgcctcggcctctcaaagtgctggaattacaagtgtgactcaccacacccggcagattctcatgttaattcttagttatcattagccacactcagtgtactccttatagcaactttgatagctccacagcaaaacagtgtaaaaagaattatgtaaaatacatttatagatgaaaccatgcatgtagttccgcaggccattattgagttcactattaatcatttgagtgttttcatctatattttggtaaaattcctaattgtatatgcgtatcttgagcagcctttaattgtcattgaaagaataattgaagagaaagaattatactattgaaagaatagtagaaaaattatcttcaaaaggcttcatatatccactatgtgcagagaaaccattttcatgaagactttgtgttcatgataagaaaattcttcatttatattttttttttgcaacttatttctttcttgtacctaatttcccaagaagttatttaggtaacatacatgttatacatacatatactcacacacacacaaatgttgtacatgtgtttttgttaaatcgtgtgataacttaagcagaaaactatataatgcctttctcaaaagaaaaatgtagaagatagaatcaaacttttgtaatattagttgagaagtaaaactgaatataataacattataaataaattggagaaaaagaaatattaaaataagcacagagattaaaatggtaaggacagacagaaactccaactggtttctcttcaaaagtccaaggaatctagtgagtactattgcaacacaagaagcacatgcagaaaagtggcgttttaaaaaagtacttctacatactcaacaaagatttctgagtgcttgctctgcatcaggcattatggatgaaaggggacagtctcaaccttcaaaatgtttgcagtgcagagaattgaagctttacacaaacagaattttaaacatgagataaatagtaaaatatgtgtgcacaaaaaacaaagagagagggctaccttgatctgccttggagaatcaaataatcttcaggaattaggatgtgttttgcaggtagagaacttgagggcttttttagacataagaagctgcatgtgcagagtcccaggaaaatgatagagtagtgtgtttttggaaaaattaaaatttgcagttgttagaatataaagtggaagtcaaatcttgaagaagagactgtcccgatggcgatagaatatgagggaaattttctagcaaggtagtagcatgattagatttccatgatagaaaaatcactaacatggaatggagggtggtttgaaagaaaggagcccactgagaatgcactagcagcagactctataggggataatgaaggcaggcctagcagcagatagtgatgggaagttattccaagaggtggctctagtgctcatgcagttcattcccctaaaacttctatgggaaaaaaatgcaggccccctcaaatgtaaaataagactcatgtagcctctaacataagactgaagacatctggggcatagtcacaatgttatttattctcataattggtaaaagtgtcatttgcattttagcaattatgttatagattgatgattaatcagctagaatgacaggtgaaaaattatgtagttcatattttactagtgatcagcattatttaaattttaggaaaaagatgttatacaatgtggagaataactcagtgcaggggtggagaataatgagaactactgtctgcttattgaataatactgttaaacaagtgatacgaaagatgatttttgtaattttttaaaactaaaataattagcaagctggagagttagctcagtgtctaattcatagtaagtgtctaaaatttttgttattaatgagaaataaaacaacaaaacttctaagtgtttttctttcttgggttgatttaaaaatatatatatgaaaacataatgatagtgacatattctctccccctgaaatctgtgggccatgtgcctaagcccattttttttccccgagtctacaccatttggttgcatctattgagtgtatctttgtatttgaatatgtgtccttgtgaatatatgcatgaaaattttaacacttagtcaaaaggtgcacacatagatatttttgtcttgccttaaatgcttaaagaccaaatggaaaatgaggcgtttctctcctataaaaacaccaattgaatttacactcgggaatgtattttagaatgacatcacaaaatgtaaaataaaatttaaaaatgagtacttttgaggaacaagaaatcccaagacagaaactgatgagaatcaattagtattgacacaatcctaaggcaaaacttctagctgtatgcccagaagtatcactctagggctaatattcattaagctgctgaagatatttattaaatttgcaaagttctggaaactgcaattataaaacaaataatgctgtaggctaaaatatgttggatcattttatgtagaaatatatgaaagattttaatgacatgatttactgctaaagttggaagtagcattccaaaaatagaaagtacttactttacaattatatgtaataggcaagataatccttaacatcaaagaaaaggaatattgtcttcctccttttcaaatgatgggccaatcttacctatgaggagaatgtgttggctacagtggacaacttaagattcagaagctagtcattctgcctccccttcccttaccccattaagactatgctctattctgtggcagctgcttttgccatttacgttaaaagcagatggagaaaacgcgaagaagtgtcagttttattgccatgtataatcagcatctgggctgtatgttacagacacaatcaatccaaagacatattttactgggtattataaaaactttttgtgtttctgaggcagtccccaaattacagatagtgctatattttaatcctgttgatcacagagattgcagccagttatgttgtttcagcttcaatgtgaatgatgtatgtgtgtatgtgtttattatacagttacggagttatctgcaaaactgtactgctaatttgtttaaaaacatgatttgggaccatatatatttatttcacactagaaatcaaatcatgtgtgagatttatatatacacatataattttatagtgtatgtgtgggggtgtgtgggtgacgttgcaatagtcccccctcttccacagttttgctctacatggtttccgttacccatggtcaacctcagtctgaaaatattaatgtattttgagagagaccacattcacataacatttattatagtatattgtaataattgttgtattttattattattgttaatctctttaaacttgatcacaggcatataggaaaaaaaagtgtatatagggttcagtacaatctgtggtttcagacattcagggggtcttggaatgcatcccctgtgggtaaggggagtctaccatatatgctgtagactttttattatttaatatattgtgctatatattctatttttgattgcatatacatatttttattacttcactatttttgtataagaaataaaataccatatttttttctacatctcatgtaatttttagaaaacatttatggtaagttctattctccccatttttcaggaagagaaactgagacacagcgaaagaaaatagcttttgtaaggtccagagagctaatcagctgcagatccagaatttagtccatgtctatataagtgcaaagctcatacttttaattgctaagtgacacaccttgaaaaattctatgtatgtctataaaatgtagaaatatctcttgaggagggctattgaagatttggcatgtggatgttattttatatagtttgtcaaaataacacgattttaaaacattgaaaataatgtctacgaattgaacgctagagagctgaaaatgtcatttaaagtgctaatactgtttaatatcttgtaaatgtctttagaactagttttttaattgcccagtcatacacactgcatgttgtgtagtctacttatgtaagatctgctcaccaaaaccattagtttattttatgtgttacagagcccatcagtccacaagtggcagaattagacttcattgagctaaaagatagctgcacataattaacatattctaagggtcttgtgttttaaagcagagggatatttcaccattttttattttctataatttttgaaatagacaccagaacgtgttatatattgttggtagttcattctttaagagctttaaagtcgtgaagacatgtataatgaggtagcagtaattagagagcaagagaaaaaaattgtagaagtggagacagaatgggaagaagttttttattggataaacatacttttgagttatttttattagtgcagttagaaaactgtcttcatcttctcatatactgagcatgtaactaaaatttccttctacatttgaaagagtagtaacagccattgctttggtttcatgtgtgtgtatatgtaaacacacaaacacatacagtgataaaatgttatgcaatcatttacataagttatgtggagaaaaaggtgttggctccttttacatggaaaagtctttcttgtagtatgtgatttacagtactttcttcccctaatcactttctaaatctatttttactttgaaactcaagatattgaattttctccgaaggactgacatttgaaaatctcttaattatggtggattttatccatggcatgcaaatatatcttagcgattatactatctatttttggaatcccagaatgtttttaattaggttctttatggaacaatggattcaaatttgcactctataaaattcagcagcttctatgctattaaagcacagattacaggacagcaatgctagaaaatgtaaattttatttgccctttctttttacctcaacctgaaaactttattatttcacttctttattttttataatctgatttaaatatgttttcctctttttgtaggacaaaggacatcatttgagatgtgtgttgggtttagtttatcaaatatattctaaaattcttacaatgaaaaggaaaacccctttattctaaagacccaaaagtttgcaataagtacacattagtttattgtttctccactaaataagagagaacagacattttataatatattaaaatttattgtttgacatctgtccatggtagaatattttcctgcttgagaatctgtccctctgaatgaaggatgcaattacgttttgccttaatgaactgctgagacagtgcaataaaaaccagttcgctgctgagtcagtgtgaataacaacataaactctgtttcaaatactttttttggaacaagattgaaaatagataaatgaataaaagtaaacaagtccatggtacatgtcattgtacagctttctgtggtacatgtaaatgcaatagtttgcaatgtgaagatcaggtccttggtacattgcaataacagatgattcatgcagcatgactcaagtgtgtctgaaatattgtttttgcatataaaaatataatgccattttatcatgactcttctttgttttataactttctgagtatgcagcattttcaaaaaacaaggccttatttattgtataatttgggtttttttggtgacaatcattgaaattagttgtagattaattacagaaattatcataacatatatttgagtgtcattagaaaaattagtgatcattacgagtattctagtttgagactttaaaataataaatgaattttaaattttccagggaaaatcttcagttatattaaattatagaattagtttggtcacatttgtgagttaaggttattgacatttcagaagtctctatgctgaatatagcatttaaaaatacttacattggagaaattcattttgaaatctaactgcaaaataagattatttatcaataaaactttcacaaatgtatgaacatctctgttttttgattatcattgaattccagttatacagcttaatattttgtacagagtagacattaaatatttatagggtgaatgaatgaattaatgattattggtttctttagattattttcaagaacctgaaataatatctatgaaaagtagtatatgaactagctttgcattactattaaaagaaatctactagtcactgagagctattaattttttctcatcatagcactacgttattgtgagcaaatctttaatacattgaaataatacttaattgaccaagacatgaagaatcttccagcgaatcaatattatttcatctatagctcgtattctctgtatttttattgattacattttaagcttaaaattttactataagaatgagtaaaggccaaaaagaattactcttaactgtcaatcaaaacattctaatcaataaagtaacaggcaaatgatttacatgtccttcactctatttagagcttttgaaaaaaaactccctttcttatgacctagataaataatacagaagacaaattcatatttccatcatacagtttatttactgtcttctggagtaaatccacctattaggagccaaaaacccagttagcagggatatgtgaaaacgaatagaatatagtggaataagaacagaggagttaagaggatgtccttgggtatgtaggaaaaggcacaacttattatacctaagaaaataaggaaaggatttaaaaggaggccatgctttcactgtcttaaaataactaagcattgttaatatcaatactagtataaaagtatcactaatatatacatgtccaataataagaaagaattaaggaaatagggtatttttcaacagtggaatattatgaaggcattaaaagtaatgtcttacaaaatgttaaatgatatagcaatacatgtatgatatgttattggatgtaaagacaatacacccaattctatttgtagtaatacctcaattacataaaatatgctcaaaattctatatgcagtaatacctcaattatataaaataaatatgcataaataaatatgcaagcaaaaaaacactaaagtaaaactccctgatctgagtagggcattatggatttagttcttttaatcatatttttactttttccaagtacagtgagcaccaaggagatagagtgtctcatcaaagggaaaaaagattgttagtaatatcaaatgttacagtgagttcaagagcaacgaaaactgaggaaacccattgaatggtgaaataaagaggtcagagaatgaaccctgatactgttgaagaaaaaccgtagcaccatgagaagggctttgaaatcagaaaagaccaaaattttggcaatttcatttaatgtcctagggataatttgttttgattttatttccattaaatgttacgcgtgtgtgtgtgcatgtgtgtgtgtgtgtatgcgttaaagtattaccaacgttcaataaaaatgaattaatgtatatgacacatatatggtcagtatgttgtcatgatatttattcatatttaaatatatacacatatgtatacatacatatatatataatatatatgcatatattttttcaaatccgggcgggaaagtggagctcatgccagttgagctttattttcctattgaaagtgaactctatttttctgttgaaaaacagagggatttaatgtagagaatagactgaacagttgaaggaaggtaacagggaaaaaactgctaccaacccagggctataaggacagaagaagctggtattttataaaattaggaggtggcaccaacagaaagtaaaattaggaaggagatgagaccactgctgtggacatcccctgagacagagaagggaagaaatatcctggcttcttctccccgccaacctttcaccaccctcccagtgtctgtcactggcaaatctcacagtagcctgttggcaaatgagcctgggatatatggttcactggagtcagctctttgggagacagagcagaacagaggagaaggggatgggaaatgatcataacgatgtttgtttggagtgaaaggaggctgagaagcaacatttttttgatagactaaaatatgtaccaaaagacttcatgcaatctacttatttgtgcgtttcataactaggtgggtaaaatcttgtctttctctgttagcaggaccatagaatagatgatatcagttattttcaactctgtgattttagtataccataaaaatacttcagttgtgctcaaatgcactttgctgcagtggtttttatgtgaaatattcacaaaatgaatccacagagtctagactgtcttactgaaaatatctgtagcatatatggatttataatttaacattttgcctcataagaagcttcaaaattaattttgtgagtataaaattattttttaaccgatcatatgctttccatagaggaaataaaaggcttataaaatttaatattcaacagtaatcttctttgtggaagagttatgattgtatctaaaatatgtaatagatctattcagtatttctacctatttctctaacttatattaagttaattaaaatgtactcctaagttagtttcttaaaggtattatttcttttgtacaaagtccagacttaaatattgatggatatgtagtacttaaaaatctgaatattttaattatgtttataattgcttagtttttaatcccaatttgcttcacatttagggacagaaaaattaaatttagtacttatttttcaggaaaaaaatatatcactcatgaagaacatcaactttacttcttgacatgaatcctgagcttgaattaaacatgtccgaaggttcacatttccatttaaaagttgaattttttttcattgcagacgtttggaacagaacacaatcaaagtcatccctcctggagctttctcaccatataaaaagcttagacgaatgtgagtgaacaatattctacaatatatgtaattttaaaaattatagaggtcatgagaccatgcaaagaaacttaagtatgagtatataagtgtttgacagcttaaatattaagtgatgtgactgtctgattactagctctgtaataatattttaatcttaatatctaaactatgtaatttttaaaggtctgtaatttagcatattgattcatacaaatgtgaatgtttatggtcaatatattttgcatatgaacatatgttcaggtgttctattgtcaaaaataagacatagcatcttatatgggaaagtagacaatggttattttaaaaagtatgatttcttttttaaatttctgatccttcagatgttcaatgttgcacgttttggacatgtcttgataagtacaaaaccaacatttaaaagccatacatagctttttccgcagtaaatctcactgacatttgattgaatgtaacctaaccctatttctaatcttagtgacctgagcaataatcagatctctgaacttgcaccagatgctttccaaggactacgctctctgaattcactgtaagtattcactgtgtcactgaaggaaaagagaagccacaacaaagagtggctaccttttttaaattggggtttaaaaaatgctctcaggtttttattatgaataatgaattattaataatgttaattattattaaccacttctgggtcccattatttttatggaggactgctacccatcactaaaattagccaatttttaggggtgtatattttatagtttgatcattttgctgttaggagagcaagagttagatcccctttttgaccatttttttatttctttttttttttttttttttgagacggagtcttgctctgtcgcccagactggagtgcagtggcgccatctcggctcactgcaagcttcacctcctgggttcatgccattctcctgcctcagcctcccggtagctgggactacaggcgcctgccaccacatccagctaattttttttttttttttatttttggtagagatggaatttcacaatgttagccaggatggtctggatctcctgacctcgtgatccgcccgtctcggcctcccaaagtgctgggattacaggcatgagccaccgtgcccggcccatttttttatttctaaaagaaaaagaaaatatttattttggaaagcatgtagctagtatctggagacaatatcagtctcctttgaaatgctaggcaaaatcttgctgagaacacttgaagatgaccactgagaggaaacctccactctttttcatcaccttaatactttcctaaaagaataagcttttaatctctcaaagaacaaagattttaaaatatgacagctttttaatgtcaagagaaccttcgaaagatagctatgtaaattaaagaagtttaaaaataaatgtatagcagctgttattaatattacttcacacttgtaaaaaaatcttcagaagtccaccaagtaacctttagatcagatttaaatattcgaaagtggaagtcggcacatttttattttttaagagccgaaactcagagaagggttcttattgatgtcaattcctgccaaaatatttcagatatcagaggtcaggggtagccaatgagaatgccaagatacacatgtgcgagacccagataaacccctggagtttgtggaacaacttgctggcactctttccaaggggagaactagatcggagtgctcatctgggcacatgagtgttccagttgctatgttagtctgtttaaaaacaaaaacaaaaacaaaaaacactacagttttctttaaaaaggaaaatggaaaactgttacttaaatggcagtatctgcttgggttcacttttgcttctttttgacttggagggttttgactagaagaagcacgagattaaaggaacaattgttggcagaaaatatagcgtgtagtcatgtattgctctcaggctgtactgtcaggttctaaagtaactaggttcagtgtaaaactcagatcacccagtcagattgtccataaagtactgttagcaccattctgaacagtaatactatccagagtaaacattgacaaactccctgtcatacagaaggacaaaaggcaaatcagcatgtcagttcctgattctccacaattttggtcctcaaagataaccattaaatgtcaagaagaagagaaatcagtgggaaattcttatttatatcggcttgcttgcagagtttgatattaagctcttcccttaataatgttaattgacacttctgtggttgtgagaattaaaagaaaatatataaagatatttacaagtaaattataaatagaacagtttattataatttgttacttctttcaataaattacattatgtttgttgataaacagggttcctgtaattaatgattataaattatgtaatctaataaacaataaaatagtgtgttgtcactccttttgctatttgctaacacatgtaaaataacatgcttgctacattgaaatctaaggcctcatgatgagagcactcacgcacacagttgttttagaaggccgtagaaaagctttatctttacttgcagataaagtaaactgcagttaagtcagggagttaagtcactggggtttttccagttcaaaatgtagcaacgtgtggaagatcacaaactgtttgccaaaagtggaatacctgcataatactgtaaaacagataaactggaaaagaatcaaataactgagttattttagagaaagcccacgtgttataacacgtatcattttcctggtcacgttcacagtttgagttcactttccaaagattaagttattttcccctccataaaatatataactacacacatttgcaatagctcttttcttcattgaaccacagttaatatgttcaaaagaaatgtattgggcccgattatgtactaggccctagtagagggtctagagatgcagagtgaccagaacacaaaaatccctgcctcatggaggagaccagtgataaactggcaaatgtatagtatacataaaatttacctatatttatagtattacatctatctgtagatgaaaatgctatgaataaaaattacagaacaagggataaggatagctgtggttggcggggggaagctaaaaccttaaataagatgatcaacaaagacctgaagatttgagctatgggagtgaactgtgtagataatgcagatatatagaggaaaggcattcaagacagagggaacggttaagtactaaggacgtttagcaggagtatgctagatgtttcaagaattagcaaaaaatatcactgctactggagagtagtgggtgcttgaaactgaaatgatgaagagaatgcaattgtaactacaggtctgagacactataattagggtgggagaggaaagccagtgaaagctagatttgcagagaagaattgtgctggagatcatgatagtgaccaggagttaaaatcttccagaagggagcagagtacttgggagtatgtagtttactacaaaaaccatgcaagtacaaggcaacacctctttttatttaaataaaaattttgcttacaagttttgcttacacctgatattttaataccatgtctttctagaactgtactcaagaatatagccagattaatataatcactacaattgctaaataaataaaactatttaaaggtgatatgatgccaagcacctctactgcattctacttaaaaaataaaaatttcagccaggcgtggtggctcatgcctgtaattccagcactttgggaggcctaggcaggcggatcacttgaagtcaggagttcaagactggcctggccaacatggtgaaaccccgtctctactgaaaatacaaaaattagtcagtcagacatggtggtgcatgcctgtaatcccagctactcggagagttgaggcacgagaatctcttgaacccgggagacgaatgttgtagtgagccaagattgcaccactgcactccagcctgggcaaccaagtgagtctctgtctcaaaaaaataaataaataaaaatttcaagttattagatcaccaaatttcatctcttagagataagtggacttgatttacctaatgttttttaaggcctctcctactaagaaatcctatacttttttttattaacattatcatttatttttattacgtattatataaaattataatgttatactaatatattgttacatagtataatatgcaatatattaacaaaacaaaaaacattcatgtcgttttcagggattttaaaatttctttcaatgtgacatcaacaagatttctataatatttagtaacaatttcttaagaattcagcatactagtatttttagcattgtctgtaaacagtttttattgttttctgcttattacttggaaacttccttctatagtaacaaaacgttttaagtgtagtatcattgtagcatactgctaagcatatgacctttaggacactaggtggctgtgttcaaatcctggctctagtacttactagttagaggctgagctagttactaaattccctgggtattagttcttccatctctaaaatgaggataaagttacttccctgctggctttgttacggagtaaacatcaagaaataatatgtatggccatggcaaattcatctcttgatagaaagcaatttgtatgtttctggatctcaattatcccagagaatctttctttatgccaaaggtcctcaatatatgatttttctcttttcccattcttttcattagccctttgtaaactattttaattcacttactctaatttccttatttccttaactagctcccaaattccacaggggtctacagtggaagactttaacactgtacttaaatttctggcaaccttttcctaaactgctgttaactctcctgcccagtatcttgcattttactataggttttcaatgaaaattaaaaggtagcacctctgttttgtcctctgctttatctttactgtactcttctaaaaatcactgaagagttataattttcaaatgtatacatttaaaaaaatttataagtataatttccttgacatttttttgaataataaagtatctgcccataacacctttttcatgatagtcatcttataggttgctgttttggacattttttttctcttcagtaggagttgtcttctgccagctttcttttttgagacggagtctcgcactgtcaccgaggctggagtacaatggcgcaatctcggctcactgcaacctccgcctcccagatgcaactgattctcctgcctcagcctctcatgtagctgggattacaggcgcctgctaccacactcggctaattttttgtatttttagtagagacagggtttcactgcgttggccaggctggtcttgaactcctgacctggtgatccggccgcctgggcctcccaaagtgctgggactacaggcgtgagccactgcgcctggcctctgccaactttcaataagagcacaagagctcaaacactggtcaccagctattgctgcctcttactgtcctaatgctgaaactcacaagggctaaattgtgtttaacgttcttggccttccttatagcagcaggtacaagagctaccttaaaatttccctattgttcaaaaagactagcaacaacaacaacaaaaaaatctctatcagagtatatgtatattgtacacatataatagtacgtatgtatatactatctatgtggtatgctgaacataagtcatgtataagaaactgtagaaaagatactcaattagtcattcttggtatttggatgatattatccacatccctcatgtattgattttcttttcagctgataccacttttttctttcagtttcttttaaaaatttcttttcctccaacagtgtaggacaaattctcactggccttctcttagtttatatctttatgtgatgatatttctttccctcatttttatagattttggccctatttcctgggctgtcatccaacttctctatcctggtctttggattttggtatattttaactaattttccttgctgtcattttgatctcattgctatgtaaaatactgtacccagccctagtcctgctaaacctttctggagaaatgtcattcccattacattgagtatttctttattatttttatggttgatactccatatagcaataattcctatacacatagatttcctgtatcctagtgtaatttcctccttttttgccgtttacccactttgtctcattaacaatagcatctgttactttttaacatggtcttaaagaaagcagtgatttattgaaaaaaataattacacaatataaatacgatgcatctcctagcttgttctcctttcatgctatttgggccaaccttcaaagcagaagtctcaagtgaacaacctactaaattgtccaccccttgatactcatgcaggtcctccacaatttatatacatctttgttcctttctaaattgcagtggattcacaatatcagactctttgactattcaaaattactcttttggattgccctttgaagccataccttctttatctcagtcatatcagtgcctgagacatgggcagatgatgggcattcaaaaatgacagactcaattgaattgagcaccaaccttagaatctggcaaagttacaggcacatagtaagtgcacaatctctattgttgaatgaatgaattgaaagatattgaattgaatatcccagactggtgccatcttaatctactcatttgtgtttcctaatgccctctcttctcttaatcttgacctcaaaatatatatttattcatgccttatcttttctaattccctttctaccttgttctggacaatatagaatcctctcttttgttctttgatttttaaaatggtttcttctctaattgatgtacttttctaaagaaatctatgttttctacaaacaaaatttcatgttctattttatagttatatcatggaatctaaagagacaaatggaatatctctttacactataatagcacccggctttatttattcctttgaggattttcttcacattttataatataccttacctctctctgacatcttgaaagaggaacagcttttctctcacgtattcatctctcttgtatagttattttcttccttttcaaaaagagattatatactgctgccaaacgtatcaattatttagattcacatttcagctttttctttatatgttatggcagccatttgtttatttcccaaaagaatatatctctgatctttgaaaatgatatatgcttattttagagatatattaaaatacacaaaaatatgtagatgtaagttcaaatcacctctggatggcaaatcatctgccatctaaatatgtttcccttttattttgtgcatatatgtgtgtgtatatatatatacacacacatatatatacatatacatatatatacatatacatatatttatatatatacatatacatacatatacatatatttatatatatacatatacatacatatacatatatttatatatatatacatatatatgtgtgtgtgtatatatatatatatatttttttttttttttgagacagagtctcgctctgtcgcccaagctggagtgcagtggcgcgatctcggctcattgcaagctccgcctccctggttcatgccattctcctgcctcagcctcccaagtagctgggactacaggtgcccaccaccatgcctggctaattttttgtatttttagtagagatggggtttcactgtgttagccaggatgatctcgatctcctgacctcgtgatccgccggcctcggcctcccaaagtgctgggattacaggcatgagccactgtgcccagcctatatgtatatatatatatatatatatatatatatatttttttttttttttttttttttttttttttttttgagacggagtctcgctctgtcgcccaggctggagtgcagtggcgcgatctcggctcactgcaagctccgcctcccgggttcacgccattctcctgcctcagcctcccgcgcagctgggactacaggcgcccgccaccacgcccggctaatttttttgtgttttttagtagagacggggtttcactgtgttagccaggatggtctcgatctcctgacctcgtgatccgcccgcctcggcctcccaaagtgctgggattacaggcgtgagccaccgcgcccggccatgtatatatttttaaaacaaaactaacataatactttaacatgcttcttttttacttaatgttgtatcttgaggacttttatgtcactgtatactcttctatacttgattctacacttagcattcttctttgtcatatatagtgtgctctcattacatatgaactgtgtatgcgtgtgagtagaaaaacaacttaaaaggaaacatttctatgaaacggcaatgcaagtggaaatgatatatacatatataaaatgttctttatttttctgttttccaaatgttctacagtaagcatatatctgatctgtaatcaggcaaaagacatttgcaaatggagtttgtttactcagctataacttttatgatgtattgattgcctactagcttcctgtatgcctgagtaaatatgtattagatgaatttgttatgcaggtttggtgtctaatttttttcatttaaaatatttttttcagtgtcctctatggaaataaaatcacagaactccccaaaagtttatttgaaggactgttttccttacagctcctgtaagtatttgattgttttggatctctcgagcctaataatatatattagccattttgttgtctcatatttttatggaggccttggaaaaatttgactcaaaatgatacagtttaacaaaatagaaaagagtagtccagtcaagctagtattcgtgattatttacttgaagacacaactttttggaatagtccccaaaccaattttatctacactatcatgaatgtatgcattctggcttctctatcatttaaagcttctacaatccctgtctttgtaaaacatctctgttttaatgtaaccagtagttggaaccgagaaaaatatggtgatcactttgggaggccgaggcaggtggatcacgaggtcaggagatccagaccatcctggctaacacggtgaaaccccatctctactaacaaacaaaaaattagccgggcgtggtggtggtgggcccctgtagtcccagctactcaggaggctgaggcaggagaatggcgtgaaccagggaggtggagcttgcaatgagcagagatcgcgccactgcactccagcccgggcgacagagtgagactccgtctcaaaaaaaaaaaaaaaaaaaaaaaaagatatggtgatatactcagcaacttttgtccagagaatctgcaggagcgacagtgctgcaataatttcctcaaacggatggtgtgcggtgagctgtaacacacaatagtcctcagactaaacctttagagagataattacctgtaaatcaaagaccactctgattagacaatagatactactcatttgtctcaaaagaagtatttaccatacatatttgcaaaaaggagatttaacaccatgtgttttaatgcatgcccatatgaaaagtaaagttggaaaaaaatgcaaatattaaaacttggtggttaatcatcaaattctattcatatcatcagaggacctcatttggggcacacactggcctatatgctttagatacaaagataattgtgttgtaatttttttcttagtaaatctcccttaaaatccttacgcatacaatgttattttccctctggagtgtatttatttcttggcatttatttggtaacgatttattcctaatcccacaatcttcatgtatatatataaatatattcctgaatttataaacttacgttcttaagtacatcctattatccatgtcttaaactttttcaccattatgcagaaatgtattttacattacaccttagcacacacacacccaaacaaatgaaacaaaatgttaatgaaacaataatgaaccttattatatgtagtgctctcttttctgttcatccccaccccaattctctctttattttctcagtgctacataacccagtaaatttattttacaatagaccaatgagtcatgagaaatactgattttgtaacttaatgactttatttgggtttcagatttttctaagctttccatttctgttattaaatattgctactaatttgataaaattatgctattcacagcctagatgtctgtacccattgtagatatagcttgatgctgtaaccaagtattgcctacttgtgactcacctctctgccattcttccacattcccctagacttactctccatgccagttattcacaatcactctatcactgccctatctactacaaatacgtgaagtgtcaccttctttttctttccatccacacttattggtagttgatgtaacacacatgctaataaaatatggagatctatatagataaaccttacttctaaagccatctttataaagtttcatttctacactaaggctcattcttaagcctgccagagggaaagaacggcatgattatctctttacagctagctgagaacttggtaaaattaagtgtcttagttttggttggtcagagattagagagaagaggcagggaaataaaagaaacaaaacagattgttgtttaatatttatttactgttccttgggccacactgagttaaagtgagtacaaactgcatagatgcaagatgatgcaaaacaacatctttcagtttcctcaggctccacacaatttcattgtccttgtttgctctctaactgcttcactcaattagattattaagtaaagaacaggtcagcattacttgagttgtggcccagggaggagaggtgtggggttaatcagcccctgtcacccaccatttcttgaaggcttttaagaaggtattacatataccggagggaagatgaagcttcagctcctgatggggaatcaaagagcacagccaattgagtcaccgtgagaaagtcatcactttgcatgttgctgatgtagcacctttaaaaaaaaatcaagtaaaatggaaataacccatgttaacatagagattgttttattgtcaaaggagaaaatattttttagtatgttagataatgaggcatacccaaaccacattacacatattttttgagctgttacaaatttgttaaaagttctaagtatcaaagcactgaactaaatatagctagatatagcttgatgctgtatccaagtattgcctacagtttctccctcttaaggcgggaatttaaaaaaatttctccattcctatggagaaaaatattctttctctccttatataataacacgcttcagaccatcaccaaagggaccttttcacctcttcgggccattcaaactatgtatgtataagtgatttggatcacagttgatgacattgtttccactctgaatgtaagagttgagtccattgcaactcatctataaaactgtcctgtatgtgtttccaaaggcattaggcccagcacccctttatttgtgactgccatctcaagtggccagtggattatctccataccaaccctattgagaccagtggtgcctgttagggatggagaaaaagaatattatttaaaaaaattgtccttcctgaagagggagaaactgtcattggacaaataagcaggtctgcataaaacagttgacaagactgcatagcatggaatgacattttgaggaacccagagggaggagtactctgttgggtgaaagttgagttcagaagatggttgaggaaagtagagagcagagtacatgctgaagaataaacctaagctcacacacagtcacatcaccgagaatgatgtttgccaaagtataatccataaactacagttccacagaatattgatataatacataggggaaaaaggagtttgtggggaattatgttaaaaagttaaacaggtatttataatataagactacagcctatactaatgtaccatgtgactctccaagagggttgtaaagtattcattcaacaactgatatttattgagctcccagtatgtgctgggcagtctgggaaaggaagggaaatgaaatagacatatggatgatttactgtgggggtagggaggcaggcatatagatgacagtcagcagtaacatagtaagttgtgtagcagaaaaaaaatgtatatattttagaaaatagaaatagatcaaagtaaaaggaattgagagtgctaggggttgggaaggggtcaaagacagcctgcatgtattaaggagaggggtgcgggaggctggattgagaaggcagtattagagcaggcttgacatctgggagatgaacatttcagacaaagaataggagagcctggtgtgtttaagaaaggcaaggagatcagtgattggagctcaaacagccaggaggagagaactgggaagattgcagagttctgaagagtgggctacaggtcaggctgttgtgacgacttaggtttctgctcagagccaattgggagctgtcgcatggttctgagaaaggggtgacatgatctattccatgtttagaaggatcacactagctactgttttgagaatagcctgaactacttttgcacagagtgtcctgagggattaatgatgtcttagagcatttttatggtgtccttgccagtggaggctgggtctcacccacctttgtgtactatcccacctttgtatcttccagaggaaatggttaataatgtgtattgaatacatgtataaataccactagatttaggttcatttgatcacatgacttttgttatgtggtaaaaccccacatctctagcctctaattcctaaattattaaagttaaaatgttagtgttgaggtgaaaagaaatatatttcttgactgggtttccttaaaaagcacaaaatcttgcaggtgagttaataagatgctacactttaattctacaactatttaatcaaacagattattgaatgccaacaagataaactgccttcgggtagatgcttttcaggatctccacaacttgaaccttctctccctatatgacaacaagcttcagaccatcgccaaggggaccttttcacctcttcgggccattcaaactatgtatgtataagtgatttggatcacttttgatgacattgtttcctctctgaatgtaagagctgagtccattgcaagtcatctataaaactgttctgtatgtgtttccaaaggcatttggcccagaacccctttatttgtgactgccatctcaagtggctagcggattatctccataccaacccgattgagaccagtggtgcccgttgcaccagcccccgccgcctggcaaacaaaagaattggacagatcaaaagcaagaaattccgttgttcaggtaatttcttcacgtgttatttcccctgtgaccaacaacaatggttacatgagacctaacaaaagcagctggccttcggctgattagtgaacactgtagaatcatatttctttttcttctgcccatgaataataaaataaagaggactgtagacccaattcaaataatacttctatatgtaacattttaacaccatatacagcagaagaaataggcaattgaccaagttaaaaagatgcctagatacttcatagtacctttccaaaattcaaacttaaccagagccttatagctaactcagaatacctttaaagtatgttaagtctcatgtttgttgaattgaccagcctcaagtaattaactgtgttttcatttcttcagaaagtgaattgagacttggttacatgatttgtttgggctcagaagtacaggggcgccaggagggactccagatcccttgcttcttactctgaatgcactttctcagtttgcattctcttattttgcatacaaccgtgaggatgcgttttttccaaaagctatttttaaaaatattgtgggaatattgcatttatttgtaaaaagctaaatatgaatgcattgtattgatattaaatgaaaggctgccatcattcaaatttactgtttgctttgatctaatattttccttttttatgatagaatattttatgtctttttggtactatgctacctaactattccaggcgtatttcacattcggcagttaatttcatactaaaaagctaatataagaaccaagctggttattgtccataattatagatgcatttactactcactgtacattattgtacttcagtcacagctgtgaatatacatttttcacttaattgcagtaactttagtccattcttaatctaatataactcatatctctgcttgctgacattcaggtgcatcttctattttttgtctctttttttatttagctaaagaacagtatttcattccaggtaggttttgctcggtagtaggactaactacagacaccctttcctcaccttataaaatatagcttctaaaactgatatgcatgcttctgaaagtacagtggatactctatagatagattgacttatgcatatatcacttgtagctgtttcctgaaatcctgacctttgcatgcagcttctgatgttaaacatatattattaaactccaccttttcttctctttcttttactttggcgcattatctaaaatttctcacagtagctaaaatgtttgaagctatggctttctacttaaatcattttctctccttacattgtatatctgatcttccaacctgtttttaaaatatagctaattgagctggttttaaagacagagatctttctgatgtcaaagagctagttctacatgaaatcagttacacacagaatttcattttcaatcatgaaaattacttttttatagattcttatatttaaaaactgtacttattgctttacttttgcttcactgtttatagaaaaacagcaactccctgctgaattatatgcagttgtttcttatttgtttatgactttacattcttctatatccagaattacaatataactccataaaaaagaatatttatgtgtgatgtgaaagcatcagaagttcatgggcacaaaatgccttgaataatttaggcagatggataaaatgtttctaagaaaagtaatcgcaatgttttaccacttcaatcgtaacactatcaagactgatgattctagaactagctctttaaaatacgtttctttacttatttttccttgcctgccaattgtgtaaaatgcctcttgacttgtttgttttaaaccattatgttaagtatcgattggccacattcaccgtctcttgggtatattctagactataaaaaattttaagagctatagattaaaagatatttctacagcgttagtgtacagagttagtctaactttccatattttcttaagaagaactctgggtttagtctctattttaaggagatatttgttagcttgccattattgaattacaatttgtataattttatggatttagtagatttggtgatatgacttattttgagcttgaatgatcaatagcattgtatattattatactggctgcataacaagtaacatgttgaaaagaacagttgattggccttcattgacaatgtttaatattaattactttacccaattaagtggaaagtaatctgatagctattatttaaccagaaaaagccatattctaaacaccagactacctatagaataaaacattaatatgatttaaatcctaaaattatggcagtaatgtaattggtatcaaattattcaaactatttcatttaaatatacttaattaataattggtaagtttaatatttccaattcactaaataaagaacaaaagtcaggttgttttcatatattctgatatagtttttccctgttactgacagcagccaaaataggatttggaaattatcttttatatcaaatatcatgtcttaagtttcaatttatgataatttaatttacattctttaaacatgataattgtagaagccaggactcaaaaggatcatttgggcttcctccccttttttccaaaaattttaattaaaatttgagtccacctaacaagccaccataaaataagcattattactgttccgttgaatgcagattatttgaattgcaagatatccagtgtacctgtcacttagactttgtgcactcttatttcattttggagtgaagcataaatcataagacaccagatcctcagtaaatatcatggcattaactgccaaatgtaatgaaacgattatatttaccatcgcaaacttcttatgagattctgattccatttccactaagacacattatttataagttgaaaagttcattaaaaagtgtacatcacaacataaggattaatccaaatgttgtaatgattgtccttgaggatctccatgattagtttttcattcacttttacgtgtgtacctcgctactaccattttatatggcactctacatattacagtgataaaagaaaatctgtcttgcagagagttcatctttttttttttggagatggagtctcgctgtctcccaggctggagtgcagtggcatgatctcggctcactgcaagttccgcctcccgagttcatgccattctcctgcctcagcctcaccgagtagctgggactacaggcgcccgcaaccatgcccagctaattttttgtatttttactggagatgggttttcacccgtcaggtgaaatggtcttgacttcctgaccttgtgatccgcccgccttggcctcccgaagtgctagtattacaggcgtgagccaccacacccggccttgagagttcatcttttaaaggaatcaagaacttaatttgcactatgcatcttttattacattggttttcttgtgagaccaccgtgcttcaaaatattatttataaaattttacaaagcatgacaattcccatcacatcatgctattttttcaataattcccataataaagaaagaaggaagagagcttagttttataaatatgtatattaatcttaattgggattactctttctttccttcttggtgatctttacttttgcaggaattcaccattttggctgtaagtaaaagtgtctgatctgaaacataataccctcccttttcaatcctgatgtaccttcttctagtcttggtctttggcacctttttttcaagaagaaaccacagatcttttgagcttctctgttgtccttgtagctcaccttcaacttcttcctggatgttgttcccgaaagctgttgtttccattctgcagttctgaggaatggtggaggcaccttttccatatagccccttctttgtgtttccaggaaatcatcggtagtaatactcttactgtggtcataaacattctgcgggaagaatgcatgtcatgtaaacagtattacgtttccagaacgtctgtagcttttctcctccttccctccattttcctcttggtcttacctttggcctagtggttggtgtagtgataatgtagcgagattttctgttgtgcttgatctaaccatgtggttgcgaggtatgagtaaaacatggttccgtcaagcaccatggaacgtcacgcagctttctacagcatgacaagctgctgaggcttaaatcaggattttcctgtctctttctacaaaatcaaaatgaaaaaagagggctttttaggcatctccgagattatgtgagagggagagaatagtaaaaagtccatagaaaatttaaaagcctgagtatatctatttgccttgaaagccctaatttacaatgagatataggatcatgtttattactggatatattttcaattcttgactccgagaaaaaaaataaactttttaataattaatatccattgtgtgactagctgtgaagtaggctagaatgactcagaattggatcagcagaaagtacagctgtgaaaagctcaactttattaatgttttcctgtcatgtgaatctggtcactcttttttccagaaaattccaagcctttcttttaacctttctcctgacatccattgaccaaaataccccaagttgtctccctgctacataatctatagttatcttacttttttcttcctacaaactaataaattttctaacctttagactcagtatcttttttttggtttgaattctcaataggtacagaagattatcgatcaaaattaagtggagactgctttgcggatctggcttgccctgaaaagtgtcgctgtgaaggaaccacagtagattgctctaatcaaaagctcaacaaaatcccggagcacattccccagtacactgcagagttgtaagttcatcccccaacaaaattctggttgggatggagggaatgaaagcattaaagcataagaatgtttgtcttgccatttttattattaataattgcattaattttaattaatatgcattacattggcataactctattttgtacaagaatatattagaggctaccttcattcatctttctagccaaccatacgattaagtacagaaactaatttatctctcaaaattcagtaagcacttcatactaataacaatggtatttatttgatgcttatttattgggtattatttattcccaatttgttttctaagtacttagtttttaacgtatttaattcttatagcaactaaataaagtagtttgagagcctccattttcaatctctgtaaactatcaatagattcaaggagtctgtcttacctaatttactacttcattgacttacgggcagaaggattcagtggttatcaagtattaaagtagaaaggatagctttttctgaacaatgcaagaaaagctgaaaaggcagaatatgatggtatttacacttaacagccttaacataggaccttgcacatactaagtgctaaggtgtttgttggagcacttacagattctatgcccatgcatggtttgcctttactgactttatttataagaagaggacctttaatgttagtgttctaacaattcagggaaaaaactagcaaaacctcatcattctctaaacatcttagccatgtttatatatagcaccatctggtatttgtcatttactgctttgcaaagttcgttgtctgtttgtttgtatataatccttccatctttaactagattatagctccttgatgacagggattgtgtgttattgtttatctctcactgtgcctatactcatgcctgtacttaattaatttttagcaatttgaataactaaaaataaagtaatgcctttcaaagagttgacagaaacccactatcttgtagttatagtgatttttttttttttactcctattagttgatgaagctatttcacagctccaggaattttagaaatgcatggagtccatgcaaccaaggccctgaactttattttttatagacatatagggatttatgcttattacctataatactacaaacaagtgataccttccagcacaatagtactttttttttttttgagacagagtctcactatctcacccaggcaggagtgcagtggcacaatcacagctccctgtagccttggcctcctgggcgcaagggatcctcccacctcagtcccccacccccatctccccaagaagctgggacctcaggcatgcaccaccacacccagctaattttgtactttttgtagagatgggattttgccctgttgtccaggctggtcttgaactcctgagctcaagcaatcctcctgcctctgcctctcaaagtgccagggttacaggcatgagacactgcccctggcctagcactttaaataagtttgtttgtcatggaggaattatagtggaaactagcctccaatttagacttcagcaaatgtgtgtaatgtaagagatttataatttttttaattatataataaaatcagtactgagaataaaatatttgcaagtcatgtatctaataaggcacataattcagaatatatacagaactcttataatttagattaaaaggtattttactcagctaatgaatggttaaattattcatattgacctttctccaaagaacatatacaaatgtccaataaacacatgaaaaactgctcaatatcattagttattagggacattccaatcaaaaccacaatgagataccattttagacccactggaatggctaaaaaaaaaaaacaaaaacaaaaagggagagtaacatagtggaagaaattgaaaccctcatacattgctggtctgaatgtaaagcttctatggaaatcttttttgctatttctcaaagagttaatcacgatttaccatgtgatccagcaatgcccctcctatgtatatgtccaaaaaacgacaacatatatccaggcagaaacgtgcacaccatgttcatagcagcattatttatagccatcaaagaatggaagcaacacaaatgcctcctaactgataaatggataaacaaatgtgtcatgcctgtgtaatgaaatatcattcagtcttaaaaaataatgaagcactgccatatgctacaacaggaataagacattacacaaagcaaaagaagccagacagaaaaggctacatcttacatgattccgtttatgcaaaatgcccagactaggaaaattagtaaaagcaaaaagtaacctagtggttgccaaggactgtgggggaacagccaccaggagtgactggtagtaagtatggggtttcttttgggggtaatgaaaatgttctggaattagatagcaaagatggttccacaactgaattgtatgacttttaaagggtaaatgttctggcatgtggtttgcattctaataaagctgtaatttttgttccaattgtgaagcaaacgattagggaaaaaacagtctagaaatcctttttagtggggacgatagtggaaaaaattagagaaaatttgttctagagattactgagagctggttttgatctttgtgtttttttttttttactgtgtgcttcctaacattttattttgatgattaaaatttgaataaaatgagaaaaaatatcagtatgttccacaaatcttctgtgatttatgtatttccttttattttcctggtatcattaaataatgttagaattcattttgagaaatcaaatttaatcctttcctaactattggtaataaaacttctctattccttcttttttcttcaggcgtctcaataataatgaatttaccgtgttggaagccacaggaatctttaagaaacttcctcaattacgtaaaatgtaagtcacttgttagctattttttttatttctgtagcattttttgggtgttcatttcagttaagtttcttagaaaattagaaaatactaaaaatcctgggaaatttccctatgatgatgacctgtaacatgaatttagggtaatctctgcaagggacttttctgtgtgttcagcagtgtcaatcacattttctgtagcagagcctaagcatcttactttaactcagacagctggtctgttatgtggccacagcaggaatccagcaatctaagcacattaaaatgggttcagtaatgttttgtaacttcctttactattccccaaaccatgctgttattttttttttcatgtcaactattggacttttttgcttcattaaactttcattagaagatagtcaaaattaatgattggtaaactggcttgatagctcatctgtgttactacatgtccacaactcatattttaaaataagttcataagctcagcagtttcagcaacactcagtgggttactccatgcccctggggaggtgtgacggggagacaggacataggtcaatagcatgggaccaatggagcgccctcacacatgcagaaacatcagcatcagctcactttagctgtgtgtccatatatgtaactggcccatagtcacatagactgtaagttaccgaacagactacttgtacagatggcatccatattagcctacctcccaaatggtttctgatatcttaattgccctcctttttcactgttatgaaatgtactttctttttagccataagatgatttcccatgcaacaaatatttattaagaagctactgtgtgcaattctctcagagaaattaaaatatgcataaaaatgatccttgtttgggagacactcctggtcttggagtgatcagtgagaaagagaaagaaaaagcctataaacagttgacctcaactagatactcttgccttctggcaagcattgtagtagttggtatcatacgtagtactgacagttaatttggttgtttcaacacattattacatgagacattcttctgggaataaacccatattcaaatacattcctgatgctatatataaaacactaacacattttagcccatctatctccacctagttgccttcttttagtcattaacatttgacaattttaatcagggactttttttgaaaagtttcttgttaggttttatagatggcataaaggtttgtgtaacccaatacctgacctcaagaattttatactcctggagacccttggagagtatgacatgagtcacgctggcattttttaccacagacattccctgttagtattattgtccctttgtcttgatggtgtaaggaagtggaatcttttcagagccctggcagtgctgggcagtgaaaagttggaaaacttggatcattagaagaaaattatcaactatgtttcaattcccaccttgttagaaattatttaaaacctttgttccaacaatttttatttagaaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgtaagtatttgtacttgcattgcagttcttctaccaaaggattgcagctcattgttcattataatcctgggagagagaaacacctacttttacccaccccactccctctatctctttcacattctctgttacacacacatacacaccgctacacacacacacatgtattgtgaattcagatggtcccttaccccaatattcctgccttcgatgtgtgttacacacacacacacacacacacgtattgtgaatgcaaatggtcctttaccccaatattcctgccttcgatgtgttcatagcagatgatcaggagcgtcccccatggcttctgtctcttctacaaaatagatcatccttgttccagtgcttatatggatctgactaccctgtcctgcctcaaaatggtcattttatttctttgtcttcaaacacctctctatactatacttcttcttggcccaatgactgtaagctttagaatccccttgaatctctgcagtagaataattctaacagcttatctggagactactgttttttgcccctgcaaggtctcagtgtaaaagaaagacaggctggtgatacatcttccactgttttttcaaagaaaacatgctaagagttatgtctacttgctcaggggtagggtgtttgggggaaaaaattatatatgtttccaaagagttgttgtccaagaaatatggggattagattgaggtatttcaatcaaacatacttacaacacttttgtattacttgaatttttcatgtggcatacaaacacgcatatacacacatatacattgtatctaaaaagtatataattatgtttgacaaaagtggtagcctaaaaattggaagaaagacaaaccaaactctgaagcctttagaaggcagaaaggaaaatatttgtaaccaagaagcagtccttggtgattgtagtggggagtctgtctccctcaaacccacgatcctgccccgcacagcctgtgagagccatgtatgaccagtgggctgaaggctgagtccattgtctgctctttatcagatacggagggagaagggcattcccacagccagcaagatgtgtttatagcatcccaaattcaaatccccacccgcaaagccctccctgcacctaagagcagaagtgcattccttgagttttgcaggaatagcctgaaacctgaccacccagcaggaccagtctgggacctgctgacccatcccaagggctaacttggtgccctttcaaaatgataggcaaacattcactcagccttgtgatgaaagagatactgaggactgggcgcggtggctcatgcctgtaatcccagcactttgggaggccaaggtgggcagatcacgaggtcaggagttcaagaccagcctggccaatatgatgacatccggtctctactacaaatacaaaaattagccagtcatggtggtacatgcctgtagtcccagctactcgggaggctgaggcagaagaatcgcttgatcccgggaggcggagattgcagtgagccgagattgctccactacactccagcctgggtgacatagtgagattctgtctcataaaaaagaaaagaaaagaaagatactgaggaatgtgtaggaagaggatagaaaagagaccacaggcggctgcatctaaccttttccagagttgtctcaggtaaaatacaaatattataacaagcagaaggctcccttttcaaacagcagttaaaaggctttcttgatactggaaccttctcctggcagggaagtaccttggagtgggaggaaggcggtaggctgtaactccacctgtatgcatgtcttcaggcggccataatgagcttccacagactggattgcttacacaacagaaactgattttctcatcattctggaggctagaagttcaagatggaagtgctgacagggtgggtttctgatgaggcctcgcttctgggcttgtaaacagtcaccttctcactgtttcttcaaatgagttttcttctatctgctcatagggagagagaatgagctgcctggtatcattttcttcttgtaaggatggcagtccgtcaggatgggatccacacaatctcactcaacctcaatcacctccctaaagtccctctttccaaatatacgtatgttctgataaatgtgtcattaggcaacgttgccattgtgcgaacatcctagagtggacttacacaaacctagatgatatggcctaccacatacctaggctatatggcacagcctattgctcctgggctacaaacctgtgcagcatgttactgtactgaatactgtaggcaattgttactaacacaatgtaaagtatttgtgtatctaaacatactaaacagaaaagagcaataaaaaagatggtacaaaatatttaaaatacttcacctgtgtagggcacttaacaagaatggagcttgcagaactggaagtttctctgggtgagtgaatgagtgagtggtgagtgaacgtgagggcataagacattactgtacactaacataggctttataaacactgtacacggcctggcacggaggctcacacctgtaattccagcactttgggaggccaaggcgggtggattacttgaggtcaggagttccaggaccagcctggccaatatggtgaaaccccatctctactaaaaaatacaaaaattagccgggcatagtggcaggcacttgtaatcccagctacttgggaggctgagacagaagaattgcttgaacccgggaggcggaggttgcagtgagcagagatcgcaccattgccctccagcctgggtgacaagagtgaaactctgtcgcaaaaaaaaaaaaaaaaaaaaacaaaaaccactgtacaactgtacacttaggcttcactaaatttattttttaaatgtatttcttcagtaataaattaaggttagcttactgtgacttttttactttatgaactttttaatgttttaactttttttactcttttgtaataacacttagcttaaacacattgttcagctgtataaatttttttactcttatatttatataagaattttttattttctattattcttttctttattcttttctgttttttaaattgtttgatttacttacttttgcatttttaaactgttttgttaaaaactaagaaacaaacacatacattagcctaggcctgcccagtgtcaggataatcaatatatcaatattactgtcatctccctccacaccttgtcccagtggaaggtcttcaggggcaataacatgcaaggagctatcatctcctaggatagcaataccttcttctggaatacctccggaaggacctgcctgaggctgttttatagttaactttttgttaataagtagaagtacactctaaaataacaatagtatagtaaatacataaaccaataatatagttgtttattgtcattatggagtattatgtgctgtacataagtgtttgctatacttttatacaactggcagcacggtaggtttatttacaccagtatcaccacaaacatgagtagtgtgttgggctatggcattatgatggccatgacatctcgaggcaataggaaattttcagcttccttgcaatcttattggacaacttttgtatagctctgcttgaccaaaatattgttctatggtgcatgactgtacagtcacatttgggggttagggcttcaaaatacgaatttgagggggacacagttgaacccgaaacaccacctcaaggaacttatatcaaagtatttcttcttgttttgtttttcattcacaggactctccctgtgaaaagttatctaaattccactttctcctttcattgtatttctgtggatgtttttgaagtgcttacattttagcacctgagacagatattcacggactccctccttaatctagttaggtttcaacaagcgtcatagagcattttagaaccaaactcagggtagttaatcctagaatagttttatctgaacatacctattcttggtgtcttttgtcttggagctatgaagattttgagagcacatttccattccccctaggcttcttaaccctaataggccacttactaattcatatacatatttcagccagtcattgaattccttgacattgcaggtgaaatttgtgcatatgtgtgcttatggatttttctagcaacagagatcaaacttttctcttttttaaaatttttatctatttatttatttatttgagacggagtctcgctctgtcgcccaggctggagtgctgtgatgctatctcagctcactgcaagctccacctcccgggttcacgccagtctcctgcctcagcctcctgagtagctgggactacaggtgcccgccaccacgctaggctaatttttttgtatttttagtagagaccaggtttcactgtgttagccaggatggtcttgatctcctgacctcgtgatccgcccgcctcggcctcccaaagtcctgggattacaggcatgagccactggacctggcgctcaaacttgtcttcaacttcccccaggggcatgtgactccagcaagattaagacccagtgctcttcatcatttatgacaaaggaaagcactgataggaatgcttttctgtagtgcatttgttttctaacataaaacgatcccttcataaggagagcatcatcttatctgtgacttcgcagaatgcaaacgtttatatttcttatttattatagggcaacctagaattttaaagtgacactttgtttctttatttttacctctctttttcacattcttcaatattttagtagccaacttatgtttagaaaaattaaggaataatttaatttttcaggaattctgaatacgatttatggcaactattcatatactcataactattttcacatgggactttgagctttttgttcagtttttaagccagacaaataaataattagcaaagaattgataattgagccaaaactttagcagtaacaaggaaatgacaatagtgttaatcctataatgacaatgactaaaaaaaaaaaaaaaaaggtattttttcatggtaaaccttttaaaactttattgtggatatgggatctgttaccgttgcctctttttaagttctcaatttaaaacaatgagctaattttcataaataaaattattcgtgtagtctttgtggatattctgtccattttggcgcccctggaccatgtttgacattgactcagtgtgtaagtccctgagatgccctcagttcttcatctgcagtggctattgattcttttctgcctcccttctgttcaacctcaaatgtaatactaccctgaatacacaaatcacagggctccgaggactcagagagctgtaggtgaattaggacattatgcaatcacgcaaacataattgtagcatcaaaggaaaacattcttccctcatcatgggattataaatccatgcctagactcaccgtgccttttgtaactgagattaatcattggcaactcaaagcattttattcttgcaagatattcccagtatatattcatagcaatatctaatagcaagagaacatttttaaaaagtagtaatgaatgctacatatttgcaaggatcatttcgatcctcagataggcaaaattgattgcctgatgctttgtctccataacaatgtcctttttttcccctcaggatgttgagaagcaatcgaataacctgtgtggggaatgacagtttcataggactcagttctgtgcgtttgctttctttgtatgataatcaaattactacagttgcaccaggggcatttgatactctccattctttatctactctgtaagtatgaaaaatagcccttatgtattacttgagccatttattatatttgttaatgtatttaatatattattaagcatttcattaaaatgtgatcaagggttttaggacttaaaaaaggacaaacttgttcacatcaaatttatttaaattttttaaaaaatattacctactatcttagattaaattttaacaaaaaattatagtattgttcagtgaattatttttcatagtgatatgatcaataatgtagcttaattccaaattttagaattattataacttgatagtgctgcatataaaagaaatgttatagatttttgccagtgttctcacattggagtattttcagtataagtattataaaaggagaattgatagagttattgccaacaaacttgctcaaaaggatcagctgggcacagtggctcacgtctgtaattccagcactttgggaggttgaggcgggcggattacttgatcaaggtcaggcgttcgagaccagcctggccaacatggcgaatccctgtgtttactaaaaatacaaaaaaaaattaaccaggcatggtgacaggtgcctgtagtcccagctactcgggagggtgaggcaggagaattgcttgaactggggaggcggaggtggcagtgatccaagatcgcatcactgcactccagcctgtatgacagagcgagactccatctcaaggaaaaaaaaaaaaagaatcatttgaaatgacagtagatatattaggatgaccagatcaaaaataaaagctgtttactagagggggtctactatgatattagcaaaatattgaagaaataggttgagctgatccaagagaatattttttgtagacagcttaaaaataaagagtatttgtaggcctatagacagaattcaagaaaagtaaataaataaataaataaaatttaaaagtaaaaaaagccacacacctccaaacaatgtatttcaggtctcttatatgtcagtatctaaaaagcagcatttgaaattattaattatctaactgataagatttctcagtaacggtggcatgcaaatctactaatctaacttaaaaggaggggaataaagatagagaaaaaagttcatagctcaagtcagtgaagaaataatttgagagaagcatccatccatcaggaaagtacttaatcctctttttgcataaaatgtgacattttacatcgagtggctaatttgcacatattaaagatggcatgtttataaataatgagattgtcaataggtttatgctgaagtggtgagatgccagaagtattgaaatttgtagaagtaaattcatttttataactggcatttaatcaactcagctgtcagtttagatgggaaacctattctctagagcaaataagagatggaaatcttgagatgacaaattaatgaattagctgttgtcaggttaaactcaataatataaggtaatcagccttcatctttatattaaattactgcattatcagtgcgaagtttgacagcaagtcagatttctgacaagtttaaattatttctaaatgaaatatctatcaggatccactgtataaaccccaaattctaccttaccttattttttgcatgaaatcatgtgaagaattaccttatgtaaaagtgttgttactgcttaagttccaagcataaatattttatcaaaaaaaaaatgcatctcatatactgcatgtgattctgagtaagaatggggacagggaatgcaaagaagaaggaatcattccagcggaaatagcgtggagaagggtagctggggtttagagaaggaagaagatgaaaccccaggctaaactgtgcatcgtttgcctgtggctcttagaaacctcttggccaatccttttaactgtaactgctacctggcttggttgggagagtggctgagaaagaagagaattgtcacgggaaatcctagatgtcaaaaaccatacttcctgaaagaaatacccatccaggatgtggccattcaggacttcacttgtgatgacggtaagaaatacttatcaactctttgattgtcaggcattcacatgcctgttctgatgcagctttgcacaaatctacagcatagttcagctcagcaaataatgatcgtgtatcttttgctttgtcgtttgggttttgttttagtgccaggacacttactttcttagacttgccttccacatttgagtctacttgatgtgcatttctgaatgttttagattttctagtttccaacttgtggttggtcttacttatatagcttcattttaacttttctttattaccctaggcatgttttttagtacctaccattttcaaaggagaaaagaaattaacttacagaagttttagtaaatctgacaaaaatactagttgtcactttttaatgctctttctatatcatcacatttgattctcatatagccctatcaggtacatagaacaagttctattattattgccaatgaacagagagctaatttgagctttataaatgaggaacctaaacttttaagttaatatattcccttatgtctcttcatatctgtttccgtgccgtttctctgtaattcactttgcatttacatattgtaattaaaaatataatttgtacaaataactattttccattgtattggtaattgtaattacagtttacaaattgcaagccattttccagaattcttccctaggcagtctgaaaacagtgctatatagaacttacggtatcaattagtaaatactgaatgtcccgcaaataaatgattatgtagcttaagactcttgtgtttgttaagttaatttaaaggcataaaatcccttctagcaccttcaagaccacaaatcttggttttcctgtatttcctctgcgatttaggaaatgatgacaatagttgctccccactttctcgctgtcctactgaatgtacttgcttggatacagtcgtccgatgtagcaacaagggtttgaaggtcttgccgaaaggtattccaagagatgtcacagagttgtaagtagagcttgtctttcttttcttttctttttccttgatgataaatgtttcatacacccagaggaatggacaaaaatctttacaatcttctttacaaatcatattctaaggccagttaattattatcctgtaaaatggtaaataagtaatgcaaaagctactttagaggcccttgggaattgctgtgtgtgtgtgtgtgtgtgtgtgtgtgtgtgtgtgtgtgtgtgtgtgtgcgctataagatttctcagtgcctttactatgctaaagtgtactatgactcttcaagaaacaatggtaaaatataaggtatctttcacatttatttgttcctataccccttttctcatggagcatcttacaagactaatggcccatggaatgcactttgggaaatgctttatatttcatttacttacagtctaggatattctgtacaggaaacttttttttttacctctgtgacccctaggagaaaattttaccacatgggataaataactatctggtatatggaagaaactagcataatctcttcccttaagaagagatgctgcttttggaggcttgaatcaaagtcctttagatcctaaagggtatgggaccaattatccttgacattttcataactgatatttaaccacaaattatatggccaggatatacacatctcgaccttcttctgcactgcccacgctcccttggctgcctcatgctacagttgcagaatggaattcattagagaatatgctgccagaataatgatgcttccatgccccattcattccattcctttgtctctaaactgtcatattctggatatgcttgttctgaatacaattgagtcactttgcctgtttattttttatctatgtggaactatggatcaataatgatttaaacccaaatgtaatttatgcagatgtgtatcagttatttgtgcagatgcacacacatattccaaatgagcaggtttgacaaacttttgacagtgtgcaacataggtaatgaggttcaagggcatgtcatttcaatttttaaggatcttattttcaaatcacatgcaattctttaaaccctaagtttgatcctgaatagaacacttagaggaaaaaggcacaaacttagcacatgtgcttagaacacggctcttagatttgaactgctgttaagtgcttaggtcctctctcactaccaatcacattggttaatcaactggaaggactattttatatgtatatgtgtgtaattaaatatttaattcttatagtaatgttttttatttcagaagatcacatagggatattccgaaaccctcctctgtgggaaagctagatgcctatagaatattctgtgtccacaggatggggaacatcacacaccggggcctgtcttggtgtggggggatgggggagggatagcattaggagaaatacctaatgtaaatggcaagttagtgggtgcagcaaaccagcatggcacatgtatacatacgtaacaaacctgcatgttgtgcacatgtaccctagaatttaaagtatagtaaaaaaataaaatataaagcagagatagttaaaataaaaaataaaaaaagaatattctgtgtccaaagcattaattttaggagtacaccaatgaagaacttacactcagaccacctttgatgctaaatcccttcttctacaattttaactggactatgtattggtcactttactctattcccattaaataactttaaacatttcttactaagctccattggacatcctgcttggtgcataccctgtgctatctacagcatatttcaactattcaaaaagttgaattttcaatctattttactacaaattattaaaaagtagtctttttttccaaagaaagtttgtcatagagatgagaaaaatattagcttatctgttttgaattcaagttttaccccctggagagcttattcttgtaaccttaccaagtcagcagaatccttcttagcagtaacatatatgcatgtattagaagaatttcatatgtgtattacattaaataattaaagactttggcaaaaattagtattattggtggactagttttaacaaatggtatccattatttttaatcagttccatataacttccgccttagattattttacatataaacattcatagcgcacattctgaatcttgaccttctgctgtgttttctggaataaagggagagtgctgaactatatagggtgatgcttccctctagtggtatcaagaaaaacttaggtagaggaaagaaaaaaatggagaggggtcgaagaagaaatatcaagtcagaaaatttaggtagacatgatgagtcataacatagacccaattatttatcaaacattaattatattttctgataactggtgccttttatatcattgtttttattttgaaatattgggaataaattatcatcttagacaacttctcagctatttctatatccagaaaaaataccaacttcaacctggaatcttgaaatggaccacaacattggggtaggaacggccacatgtttaatgtcccagaagtgtctgtgggcacatgtatagccagatggccccagtttctgaatgacatttgcacccttcaccatctacgttctaggaaaaacagccttggaaggagatgaaatttattttccttattgtgacataatagatataacttcaggcattcgattatctctctgtcctgccagttagcccaaaacctattttctgattattcttctgactctaataagaagggaaagtttacttatatatggttatttgattattgctgttacatatatatatatatatatatttatacacttcatcaatttatattctataaaatctcctaatgttatcatcaccaagaagatatatgctggttacaactatttttaaacttaaacctaatatgttcaaatccgcaaatatgcctttaatgtgtccattgttattcactaagtgtattgacacatattaaggcagcaatgagtggtcttggccacagcagcaaggttttgttactagttaatgaatttcatggtattgtgtccacataaacacaagcaaactgaaggctgactaaaagtacggttaattgaatgaatctccttgcttgcacacagatggctaaatgctgggcttgccttgttagataaaccacaaagaactggactcgtggacaactctgctttttttttttctttacttctcttaaataataatccatgcttggaacacgacatcttaaagcaaaaattgccaaggggttccttgcctcagttaagagtgaagtactgtttacttattttattcaaggccaccattactttgtaagaagataatattgttccattgtttttaggtatctggatggaaaccaatttacactggttcccaaggaactctccaactacaaacatttaacacttatgtgagtaacatattgcacttttctttgacttactctatttccagaaaatggggatggcaagggacagaagatttagtgaaccttccagataatacaaatcattcacagttagatgcttccctccttgctcattgcggttctggacccctggctacatcttcattgaatatcgatcaggcgatggagtgtcttagcaagaggtcctcctctattcaaaaaagcacaaatacaacgaagtctgagtagtcagagaattatgaaaatgtataaacctgcagatttttattgataatgaatatgggttattttatgacaaactaaggaaggaaagatagaaaacgatgcctttattcttgactttaagcgaaagatggtaggtggtaatgactttcccaaaaatgtaaatgtagtttattatgtttgtttcttatacaaagcattgttaaataagttatgggtttccagtattaaaatgtattttagaaaatccatatatattcatgtagtgtttaagtaaacttgacaaagatactaacattttgagtataaatttcaaaattttgattttttagcttaaaataacatctctttttttattaatgtaaacaacctttgacaacccttaagttgtaaatacaagaagatatttaaatatacaaacatttgatctagttacatgcacaatgtttaaaaattgatataatcttttacatataatactatacttttaaagtagccttattggtaattgagaaaacttttcagaacacaaaaaatcaggaaaaagatagtagatattaatagaaagtaccgtatcatttgtttaagtctatctaattttagagtaaatattactagcgtaagaagcagattactggttaacgaattagaaggtttatttctaagtgaattctacaaacctaagtagcaaaaaatattacatgccccaatgtaaactaggtacattgaagctagttaaaattgctgctgatcactttccttgaaagtatgggtaaatcaaacactttatagaaagtaaataggagtatttaaatgacaaatgattaaacaatggaaaaagatatcctctaagatgtcttgttctgcttctagttatttatttgatagcagcaagaactgattacatacattttgttctgttaaataaaccattaaattgctgcaatttccaaagggtcactttagcagaattgggtcatttgtgggacagcatgtgattactttcaagccagctcgaaatgacaaatgaggatttgtggatccaaaaatggttttactagtgactcatgatacaactctaggcaagttacttctgctaatacagatacttttatttttaaaatttaggaatagttcttcagcagttaaaaatatgagtataaagctcctctcagattcttaacattttcacaatttcatgggtccattttactgacattttgatattttaataaaggaatagattatcctcggtttttctgaatcttccatttattcatatattttgcattttgcttcagaaaaaaattagtgaatatatttagttattataaatggtgaatatatattagtattacatattgtatatatattttaatatattttttacatatatagtgtgtgtatatatacactatatatataatgagaataagatcaagttcatgaaatgtaaattacgacccatagtacaaactatacatataagtagccatttaacattggtaaaaattcaacgtctctcccatttacttaacattcattaaacaaatatttattgaggacctactgtgtgaccatgactcagccaggggcaggagcacagacgtttttattgatgacattttgaatgtaattaatcaggggttctttcagtgatcaaatttgagtctgtgtatcagtgaacatatgtatcaatgagggtaaagtatgtgtatctgataggacttttgaagataagggtttatttcccaccggcaaaattttgtctatcgcaagtcacctccaaggaagctccctgtaaaatatcaaaagccttatggagatgggcgcagagggataagggcaaataaactctgctctgaagctgctgctttgaagtgaaccaaccccttgcacgtacactacattggctaaagcaatgcatatatatataatcactcctaatttcaaaacagtgaggtgtaaataatcatgaataacattgcaatctactccagtgggtcgttcactgttttattgttttcagataacagctgaatgctaacaatactgctatgactataagaagacccttctccttctaagaatcactaatattttcatttctgtggttaatagtgtactccatttctttttctcttttagagacttaagtaacaacagaataagcacgctttctaatcagagcttcagcaacatgacccagctcctcaccttgtgagtgtgaaagtgtggtactgagtattcattaattcaatggacaaaaggcagtctctagatgctggacattgctattgaacaagacagtctctaccctcaaggaatgtttctattgggagaaacagacaaaaccacgatacgtgaacaatgtagacattaggaaaagtattgcgttctattaaaaaaaacaaagaataatttgtgtttgtggggggcttaggggagatccctaagatagggaaaatccaccttagggaagggacggctgacgcaccaaagttgggcaggagtaggcagcgggaagcattctaggttgtatttaggaaataagtatgttgtgttagggagacaacacacaaaaaataacaatatattgtgtgttaacactatcagttaataagatgctttaataagccttaactgctttatttttggaagtatttggccatttttggatttctgaataaaacaaattgacatatgtatgctttcagaattcttagttacaaccgtctgagatgtattcctcctcgcacctttgatggattaaagtctcttcgattactgtaagcatcttgtgttcaacagaatatctcttttctcagagatctgagtttggggttgtctttttaaggatgtaactgctttgttgattcttggtgcttgaagatacatgcattaggatttattataaattaggaaatagaaaaatcatttcttacagtatcattgtccaacagctttgctttggacaatataacttcctttttagtaatactgattgttgttatagtcatttatttgattatatgtaacattaagacatatggtttatagagtttcaattaactttgaaagaaactttcaaaattgagaaactttcaaaattaatttctttagaaattacatagtatatgaaaacatttttactgtgaaatgtcctttaaaatatgtgaaataaaacatgatccttgatcctactctcctgcctcagaatttacagtttgatgtgctctctggtcctttttcagatgcatttttttctattctaatagatgtaggcccatggctatatagcttttaaaagccacagatattaataggatctgtttttgttctgccattgtctatttttgtttaacatatgcttttgaatatttcaagtctatcatatatatgaataaaaatatatatataagaatggaatagatatatatttatacatatatataactcaactgtttaactggtagagactgttgtattggtgggaggaaccagaactgattcaatcatcttcatctttactgtgatttggtttaatttcaaattttaatgagtactatacagtactctaatgaacatcctatacattcctcttggtgcaaatgtgctggcatttcagcaagaatttagggtgtgtgggaaggtactgtcaagtatattggaaggattccaaaagtaactgtcttgttattccccagacaagactttgtccatttagaagttaatttttccaccaactatttaagagtacctttttcaaaacactcttgcaaacactgaatattatttattcttttatttttgtccatatgacagattcaaagttattctgcgttcctgtcttaatttgcacttccaattagtagagcatttgaatatattttatttgtttactaagcactcgtgctttttattctaatgagcttgatctatcatttccccattttctgttgggtactttatattttccttattaatgtagatatctttatgcatatactactttactctatgcttgcaggggttttttttaaatgaaagaattaatccttatatcttatataagttgcaaatatatattattctatttcttatatggaatattttattgtttggatatattttatgttgtcaaaaatttctccctcttttccttgatggtttctggatgttataactgagcctgtgaaagccttcctcactccacatttataaaaggaagatcttctttattttcttttaatacatttttatttttacatttaattcttcattctggaatttattttgtacacataatgtgaggtggaagccatttgctttctcaggtatccagttgtaccaaaactgtttattttatagaccgtcttttctgcactcatttaaaatgcttattataaactaaagtctcggaatttctctggagtctatgagttcagaaatataggaagtttaatttttctttttctttcttttagttctctacatggaaatgacatttctgttgtgcctgaaggtgctttcaatgatctttctgcattatcacatctgtgagtacctagtttatgaatataggtttagggtcaaacacttcctaatgagtgacttggaacattcctctgccagttattttactgtaacatcataagatgtaattggtttcatctttaaagaaaatgtgaagattttcaaactggatatgatgccttctgcaagatggctttaattttcccttctggctcttattttccagtagtcgaattatctttgcttagctaaacatgtctcttctacaaatatggctctccaactttactagcctatgctttttctctcattattatctgattctagaacatcagctcccttttaattatctatcctaaccctgcttttctaagtcacatctcaagtatcaccttctctatgaagcctctcctgatttgctcaaagtggatttacttattcagcatcaactgtggcaccacacaaaaataaattcaacatggttcgagactatagtttggaagtaagacacagccaaatacttagattgggtgaaatggcttttcctttatgttttctctgatcacaacttgtttgtacctccatagtttttggaagtacagtataaccatttgaaaatatgtgataagtgtggtccaaaaaactcatttgggtcaaattccatgattttattattactaggtgtaatgttaagatcatggcaaacctagaaggaagttcagccagcagccttaggatccaaagcctccttggctgatgctgagttgggtgcttggtggcaactatctatttaactatgcctaaacagcaatgtcagttgtgccccagtttcctagaagagattgcctgccatatcctctcctggttttgcacttctctcgaaaacccacaaactccaagaagatacgattttacaaaattgagaaaggaataatcatttttcactccaaaaatatacatatgattggaattttaaaatttgccacccaaaagtctacgcttttacatcttctttgaattgaattgaagatccaatgttcaatcacattatgtctgcatttgccttatagagtctgtgttatcaattgatgttttgtacatcagtctatcagactggtgcctattaatattccttccactaaactactaggtccaggaaggcagagcctttacattttcgtgtttgagccaagaacctacctctaagtcactcctttacaaactccatggctgccacgtgcatgagctgcaatatgaaggaagctactagctcagagatgcagggctgtggtgccctcaggcagagaatgcaggctgaatgaggaggtagccgttctgctagtgttatggtcaggcatcagaaaaggcttcacaggaaaggtgctgcttgagctgagcggaacttcccttcatgttaccagcctcctcccgcaacagtgagagcaagtagagtcttccttgttctgtgccctgctctgccttgcatttctttttttttttttctttatatatataaagaaattttatattttatattttattatactttaagttctagtgtacatgtgcacaacgtgcaggtttgtttgtgccttgtcttttaccccctagatcataaagagctctgctttttcacttttcccacttcctcccctgtcacatcaaggacttaaatgttgatagagatgagatcaaatgactaaaaaacatcattttgctcatttttaatttggaagggtttgaatctgacatacatatgcaggtaacattcactacattctgattcttaaacggggcattaaaacttccacagtatcgagtattatgattctacacatatatttcaggggctacctaaaaaaaataagataactatcctgacggtagacctagtaggattactagttagaagctaattgtaaatcagaagtaagcagtttttaaatgccattgtatgcatctacggcttcaatccaacctttataaggttatgagtccaggtctcagtttcttaatctgtaaagtcaattattaattaaatggaccttataaagttactatttaggataaaatgaagtaattcttataaatggcttatcccagctcctgcatatagtaatagtgcaataaatgttagctattaccttgattactttcctgtcactacttctaatgaacaaccgtaaaatgaacgatcttgaaaagtgacagacagcacccagtgcaggtccagctcagctctggtgagctagctctagacatcttcagtattttatgttctttctttgtacttacctgtcctttatctgtatcattattcccaacctttctttctacttaactctaactatcctacacagcttagactttcttaaccaccagcctcccagaaaagttaatctgtttgttcaccatcatcttgtaaatacttctcctacatcacttctaatgaaacttctttgcatctgtgagtatatcccaatgctaatgctaatctcctctgcagcaggggttctttggaggtaagaataatgcattatttatatttgggtcctcagaaccttgcattgtgacttaagtcatcagtaaataattggtgaatgaaatagtaatgcactcggtgtgtttacactcaatataaacacgtctctgaaaatattaggagaccttctaaagcaacatgagtgttgacaccagtgacaactcactaaatcccagtgcacatcattcaggaaaatggggaatccccagtgtctctatttttttgctaaattgttatcctcaataaatctatggggattttctgctgagcatcactttgaattcttttgcccttaggaaataacaatacttccatacttgtgtgtgtgtgtgtgtgtgtatgtgtgtgtgtgtatgtgtgtgtgcttctgtggtgttgtttttccagagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtatggtttttaatcatttgtatttcttttaagaattactatattaagtaaaaaagaaaaagacaaccaattgtcaatccaaaggtatggttgaaatgcccagtaaatgattattttttcagcccatgcttggacaagacagagcagttacctgaggtgcccaagtaaagaattaggcttttcaaataaatctcagaaatagtccattggtaatgaccaagttttcttgaaagtgtatcaaaaaacgtagagttcacaatttctggaaattcctttcatagcctctaacaagtcaaatgttttgcttttgccctgtctgaacatgtgccctgctcctagggctgccagggccctgtggcttcctcataccaggtaaggagaaacaggccctccccagtgttcagcccaaaccttctgactcgccttatgtgctgcagccttcctgtgttgatgttcttgtttcttgcttgtttgtatccctttcttttccctttgtttgatgtatttgtgaatctaaatattgtcagaataacaaatattattttcctttttattacaagaataatacatgcccctaaatagaaaaatatgaataataagaaacaatttattttctgcaagaagaaataaaattaaccattagtcagcatacctggagataacgactactaaagttattgtgtaaatatttccactgatggtagtcaactatatggatttaggttccttataaaaagtgggataaagtttactattattcttagattgtggggttttgggggggcttttgttttgttttttttttgtttgtttgagacagagtttccctctgtagcccaggctggagtgcagtggcacgatctcagctcactgcaacctccacctcccgggtcccggctcaagcaattctcctgcctcagcctcccgagtagctgggattacaggcatgtgccaacatacccagctaatttttgtatttttagtagagacggggtttcaccatgttggccaggctggtcttgaactcctgacctcatgatccacacccccttggcctcccaaagtgctgggattacaggtgtgagccaccacgcctggccagattgtgtgtattttaagaaggtcactcatcattattagatggaggagagaaattcttgaaaatgttaaatgtctaatcagaaaatattgattaagcatgttttatgtgcaaaactcaatcctaggtgttatggagcatagagaacttcatggtatggccttgccttccatgatttgaaaacctaactaaaaagataagctttcaacatttgaatatttatggaggaaaaacgtacttaagtaggtaatgctgtgcggtgggttgcagtgtgagctctgaagcccagcctggctggagccaaattccagcttcactttttggtaagagttaactgtagtttaattactttactagtctgtgcctcggtttcctcattgtaagcaaaggtggtgatggttacagtctgaaaggattttgttaagattagataatatagataaaagactgcctcaaacacagaaacattcaatatgttagctgctgattgtattgttataacatttcaaaacaccaaaaaaaggtgatgtaggacacttcatggtttattaataaaaaagtaattttcaaatcctatacataccctcaacgtttttaatttggcctctaatctatttcatggtggtaaatgtttgcaaaaggtaatttgcaccacattgtaaatattgacattttaaaacaaaactcatctgagattttttttaaatgtatctggtggaatctaaatatcagagctaattttataaaaggaaaaaaacaagatcccccttaatatattgcattgtttttttcttaaactgtattttctccttgaattcctattttcaataccccagaaaattgtgtcatttttttgctccaaaaactatgtatacaattgaaattttaaaatttcctgccaccaaaaggctgtaagtttttacatcttctttgaattgaattattgctgttaatattagtgcatcactgattgaaactacataattatttatcaatattttattttatttaaagttgaaagtgaaattttattgcagtgcctctctgggattatgtgcattgattgcaagaatttttgcaataatctttcctttacgatcctagatctttattgggacagtgtcctgtgataagtttctggtgggctgagaagtatatcattattttgtaaagtgagagagagatgattgtcaaaggggaggaaaggaaggtgaaactggcataaaaccttctactcagcacattatcaggcaaatttcatggggaagttgacaaactgcaaactgattctgttacacctttctgtgcccagcgatactcatactttattttcaataatgctaatgcttatctgtatttcttaaagtttataattccctacaggtatttcttgaaaaaaaattataacacaaatctgaaaaaagttgcatatttgtactccactcttagagcatcacagtttacactaatttgtgaaatgctcttggaagtccaagataagtcccctgtctctctctctctctttcaccttgggaatcccaattctctgagacccaacaatactgaaattaggccagacataacactacagtggtctctaagtgttcaagtgaaagaaagagtctcatatctctcacattaaatcaaaagctagaaattattaacaacaacaacaacaacaaaaatgtagcaaggaaggccacgttgaaagccgagagagacccaaagctaagcctcttgtgccaaacagttagccaagttgtgaatacaaagcaaaagttcttgaaggaaattaaaagtgttattccagcaaacagaccaatgataagaaaatgaaacagccttattgctgatatggagaaagtgttagtgatccaaatggaagaccaaaccagccacaaaattcctttaaacaaaaccctaacctaaagcaaggccccaactctctttatttttatgaaggctcagagaagtgaggaagctgtagaagaaaagttggaagctagcagaggttgattcttgaggtttaaggaaacaagccttctctgtcacatgaaagtgcaaggtgaagctccaagtactgatgtagaagctacagcaagttacccagaagatctaagataattgatgaaggtggtgacactgttaaacaacagattttcaatgtagatgaaacagactttattggaagcagatgtcatctaggattttcatagctaaagagaagtcagtgcctggcttcaaagtttcagaggacaggctgactgtcttgttaggggctaagaagttgaagccaatgctcatttaccattccgaaaatcctagagcccttgataattacggtaaatctactctgcttatgctctataaatggaacaacagagcctagatgagagtacacctgtttacagcatggtttcctgaataatttaagcccattcttgagacttgttgctcagaatgatttgtttcataatattactgcttcttcacagtgcacctagtcacccaagagctctgatggaaatacacaaggagaatgatgtttatatgcctgctgatgcaatatccattctgcagcccatggataaaggaataattttgattttcaagtcttatttcagaaatacattttataaggctacagcagctgtacatagtggttcttctgatggatttgggcatagtaaattgaaatccttctggaaaagattcaccattctagatgacattaagaacatttgtgattcatgggaggagagcaaaatatccatattaacaggagtttggaagaagttgattccaatctgcatagatgactttgaagagttgaaaacttcaatagagtaggtaactacacatgtggtagaaatagcaagagattagaattagaagtggagcctgaagatgtgactgaattgctgcagtctcatgataaaacttcaatgaataaggagatgcttcttacggatgagcaaacaaagtggtttattgagatgaagtccactcctggtgaagatgctgtgaacattgttgaaatagccacaaaggatttagaatattatataaacttagttgataacacaatggcagagtttgagaggattgactccaattttgaaaaaatgttctactgtggataaaaggctatcaaacagcatcacatactacagagaaatatctggtgaaaggaagagtcaattgaggcagcaaaattcattgttgtcttattttaagaaattgctacagccaccccaaccttcagcaaccattaccctgatcagtctcaccagccactaactccaaggagacaaccttggctagcagaaagattacaactaactgaaggctcagatgatcattcacattttttagcaataaaatattttataattaaggtattgcattttaagacacatttaacatataatagtatagttaaaaataacttttatatgcactggcaaaccaaaaaatttgtttgactgtctttattgcaatattcactttattgcggtagtctggaaccaaacccacaatatctccaaggtctgcctgtacatacattcatacctacgtacatctttgtgtaactcagtatttatctgactaacttgagctttttttacatttaatgactatagaatctcatatacttaatgtagcatgaatggaaatatgtttcagggaaaattagcacttttcagcactgcccaatacaactttctatagtaatagaaatgttccaaatctgcactattcaatgtggtagccactagttacataggattatagagcacttacaatatggctaatgcaattgagaaaaataattgttattttattttatttacctttaaactgaaatatacatgcatgtctagtggctaccatagtggatagtgtagttgctacaagaactcagagggataatttgtgtaaaagaaggagggctgtgaaagatgtaatgacataagtggacaagcagacaagtgtgaggataatgctacaggtgggcataactgtgggagcagagcttgcacgtaggaaacttctggacctgttccagggccaccaaaaacagttgagctaaaacttgttaattgtcagatgatgtaaagcctaaatttatcatttcaactgtggaagttcagtttaatattcactaaactataagatcaatagattgcacgtatttcaaagtataccttaaatagcaaacagcatgcgtgtaagccagttggcaagcagagtagacattcaagactcaatcaatatagttgcagttgcgtttagaagacttaagagtttactcagtttttctgtaactgaattttagagtgataggcactgaaacttacagtgccctttgccagcatttgtctcagcatttgtcaagctattttgaagtttcattgtcctattaatgaagactctgctagttcaaggtttatgacagtttagactggatagttgccaatactactaccactacaaataataataacaataatagctaagttctattgaatagtttacctaatgctgagtactttacatagatttttatctcttttaatctttccgccattcttatagtgaaaactatcatttccccatttgagatatgaaaatattgtattttagagttattaagcaatttttaaaaatcactcagctgccgactggagtcagaatttgaaccttgactctgattccaaagcttactgcttaagtttattttaaagtttttaataaaagtattttcaaaataaattttcagtgtaaataagattgccaccctattattgaaacatacttagaaaatgaaaattctgaactaccctcaaaagctttactagaaatatttacttgtaaaaatggattggtagaaggccaagtattttaatctattaattaaaataattcattcaaggaaatccactgagtactatactattaagcatatatgctttttgagttttaaagcagcaaagtcatgtttctttaaatgttttataattgaggtttacatattttaacttaactttccctctagttatgccagtctaatgtatttttattttattcatgaaaattatgtaagtacaaactctcaatattaaggtttgtcaatgtataatttcaaaatatagcaggaagacaaatatttttaattgaatgcatgtttacatagctatatttaaatacaatttaaatgtttttttctgctaaaggatgccatgctgttattttgagtcattaactattttaataaagacaaaagtgttttctttatggtaaactctcatcattttgatgcataacagaaataaatgaacaggaagaaattgattatcagatcatatttaattaatacccagatagagcatccctgagtgggaagcagatggccatgacttgtctttataacccaaatgtcctgacctcatcttttaaatataagatgacgttagagtgattaagcagtctgcaataaaacagtttttgtcctctccagatagtcattgagaaagtcagtgtggaaagtggaacattgttaatttctaatattccctttatttctcttggttcaggaagttttagctatggaggcaactaaattatttttttatttgaaagacatttattaaataattacatatgctaatgagtgaacaatctaatggagatgacttacatgtgctgaagagtgaacagactcatggagatgaatgatatgtttattcattaattaaacaaatattattcaagttcgtacaatgttcaaggcactgtgtctaggtgataagaatacaacaataaacaattcagagtaaaacctctgtcctcatggacctgatactctactgatagatacttttaaatagataattctaaaaaatggtatggaagtctggtgatagaaatatgtgtaagatgctaataatatatctataccagatgactatggaattgtaactgatactgtcaggtccaagaggccaacaggaaattcttcttttgaatcaaatggagtataacacaaagaggggaggaggcccaaaaggggaggggtctggtagccatgagctcaaaagaaaggccaggatacgatgctgaatgtacctcattacttcatttgtaaaggccagctgaaggatcaaagaaacctgaaacattggcataacccatgataatcaacatttagcatgctgtggttgatctcttcctctaattttatatgttaggaatcctctagattctggaattcctgtgaaaaacttcacaattctcagcaataacattgtaatattattgtttttcttagcaagttgatgttttccattttggacgagtttttgataggcttgagtgggagcttttgttctgtgtcttaaaattattgatattgtcgttagtcgttgaattaagcatgaaggtgattaaataattgagcccaacctaaagcaatgaaaaattcagttttgaagcattatttagatcagttttgaagcattatttagaataataattattcaaaactgatcagttagatcagttttgaagcattatttagaacttggtcaaatcttttttacattttcagatttagtattactagtacatagttgtatcttggaaattaccttagattttggaggttttgatttgcttattggctaaagagaacattcaggtttggatatggtagtatgctaaacgtaccatttaaaaaagggggggctcttttattatactttttaaaacttaaaacactgggaaaaacttaacagatatttattttaataggtaaagagaactagcaattaatgctctgttcttatatgttttacatccatattctctccaatgcaaagattttataaaataattattgccctttccatgtaattttggctcaggaagttcatttagtggcccaaagtcacatgtaggtgttgcgaatggccaagcctggtaatccaaaaggtgtagtaatttagcctttgtgtttttagctaacgatttttacaatgcaaatttacaggattttaacctctgtcatctggagatcatctccacccctccactgaaactagaacaccagtatcttctatcttgccaatttagtggcttctttttacttatctttatttgctgtctttacatcttcgacattggtggccacttctccttcctctacaatctcttggcttcctcattccttttattttttcacccactttttcatgtagacatgtagcattctatctttagccctatcaaattctcagtagatttcaatccatgcctttaaatttctagccatggcttttcttaagaacttcacattcatatttccattcacttagtggattcttctcccttgatggcttgcagaaacttgaaacacatattctaagacatgcattctcattccccacatccactctctaattgatacatgtatgtctctcctgctaaactgtaagttttttcagaaattcaggcatttcacttgtctttggtctctgaaaatctggcctagtccctggcacaatgtagatgctcagtaaatatttgataaattaatgatggaatgttgttaacaaatatgcatttggtattattaataaaacttgagaaatgccataatgtaattgcaagtggagcgtaaaagcattggttttaaataaaaaccttcttttagttaattatacccaacatcaaatatccccaggatgttttcctgagttgcctttgatgtacctctggcttgatagaagggcagtgctagaggattttgttatttgacccatgtttccaagggatgccagaatgaaggcagattctagaatatagctagaagtttttgtctggagcttttggtaataaatcaaaatgagatacagtactcactgggtagcaatagtggtgtcaggtgcgtaactagtgattttagtcaagtaagctagtctgcctacaggctttaatggaatcgaggtccaacagttcttccattaaagattaaagtaactgacagagacagattgttaaccaaactttcttctcattttctctttgaattattaagctaaccacacctccacccatatagctaatgctatagtgctctcttaatcaaaaccaaatcttaaatcaatccagttcacctcgactgttctccttcattttagtgatgttagtaaagatctttatccctgaagctacgtttcctttcccctccgtggcacacatctcatgaaagctaatttgttaataatatgttaacatttcttggaaccagttagctttagaaaggagaaaagcttaaagattgcagttctttaccaagcagcaatgaaagaacaaagagaacctcttctgtttcttaaaggtgtactattatttctggtgcttgtccacacctaatttgtaaatcacagttgctttccctaacagcttaaagtcattaactctcagtgttgtacccggtgcccacttctatttcccatgggtttcctaatagtccctgtagtttccccaaatttgagcagctcctagcatatatagaaggctctcagggagactgtgatgaatagataaacagcaagatctaatttgcctttgtctgtgttgaaatttggacaaacaagaaaatgactgcttttctccttttaaataaaacactttttgttcctcctacctattccaactctctggaagtctaagaaagagtgtcagtacttgccgtaattttgtatttgatctcactaggttccctccttgacattcattgacatcttaaaacaacctattggaatggctgccattatcctaataccacacacttaagtagtaaatctgggtttaacttgggttggtggatttcagatcctatgcccaagattgctacatattatggacatcttttcacctaggactgatcaagtgtggaaaattctgccaagtgttggcttgctcgtggagaggtgtgcttcttccctcattttatgactttatttggcatctctttttagctctgatattatctccttattgtataaacagattaaagttgtcattctccttgattaagaagatttcaggagaggtgctctgagaaagtgtagtggatagaaaatgaatcacaagttgaatgcaaacagaagacagaagatggacttagaagggcaaaatatggacagggagatgaatgggaggagagccagatgcaaagaatattatttcaagagattagactatagaaacaagtggatttagataaaccaggtagatgtaaaaatcacattctgaaaaggatttttggttaaggagaattacaagctacataaaataggaaaagaaattatatcatatttagacctttagagatatgagaggaggctgctatgtggaatttgtttgacttacaaacatcttttgtattacccttcactcaaactcaagtgctagaaataagaaatgattgttgaataactgggttttaaaagatatgaaaaacaagaagcaaatagaatgatagctaactttaccattttggtaaagttggtagtcatgagctttaccaacctgaagaagttggaactcagtattttgctatattcccaaaccctatgccacaatcagttcagcaggtttaagaaattgttaaaagagtcctgagtgtatgagaatgcttgttatcttgattttttttttttagctaaactgaacatatatgaggaggcaacaatctcccataacaaattccagatatgaaaataattcagcataattatcgctgtggaaaaccaaatttggtctggaataaaatgcaaagaaattagatagtgattattaatcagatatggtccggtggacatttattaaataaatccccactacgtggtaaaatgaacatgaactacttcagccaggcaatgatgctgccagtatactcgattaaattcttcaaagtgtattccattttcttccctaagacaatctctttaatttctcatctaattactcaaacataatttttggaacatgtcacattccacaggatgaacttacaaactgccaaccccaaactccttttatttaaaccacagccttacaaggttgaaagcacagtaacaggccaaaagacattttttctcgaggccgtgggatgtggccagataaatgcttatagtcgttgcatttgctgacttgctgttttgctggcatacgttcttcaccgttccatcctacgcctttgttctgagttaggttctttcctgtaaactattaagggatctgctagcaatgagctattttctttcctcttgctgactcatatataactttagcaaactcaaaaccatttattgttaggtattatgctaatttaactaactgctttcactgtcaccattcatttctgcagtgtgctgaacagctaagttttttgcccttaattgataaataaattggggagggcggagagaaattaaatttctatggagcttactttacttcagaattaatgccagcagtttcccagctgtaatttgatatagagactcctttagttattgtagttaccaagacaaaatgtaagggacattagcactggcacagtctctcctagtgactgaggcatcactagaagaagtaagcaccacctctttcccttaatacggtcatcctaggaacagttaattttctcctaatggttaaaaacaaacaaacaaaaaacaatttctatgtggatacatttcaagagttttttaatcgataggaaagctaaacactacaggacactatcattttcatggattttaattcaatactgttacttgaatatgtgctagtatttcccagggtaaaggatatgaagagatacaatgaatctctgtggccaccatatttattcatgttctcttacatacatgagtttctttcagtagatcaacaacgcaagcgtgggctgtaatctgtagaataatttgatgcaggtagtttatgtgagtagaagttatatagctttttggtgaaggcaccttagaaggttagagcagtaacggtgggggtgcagagctgctctgtaattatccacataactttgctagaaattgcttgtgataaaatgttcaattagaattattgctgcttgttccagtgaagataaagaactacagagaaatactacagagtgaaatataattaatgttgacagtaagaaatgtatgtgttttatgtataaagatgtcagtgtccttttcagacacatttgccaaaaggccttgtggtgagctctcacacagaatgcacaaagtatcataggtggaacatacttttattgaggacagtacaatttccacattgttagtcatttgtccaataagtatttgtgaacaaaggaaaatggctgtggctaaatatgcatttaatcgagaccttacagctcttgaagtcttttaaagatgtctcccaaaacatgattttgcaagtaaagatcgtttcaaagatgttttctttttggagaggaagatacagaaacatcacccatcacatattgtgcaaatgaaccaacaaataaaccgaatcaaaaggaaatgagggagatgataatgaaggttacacttttggtttatttctatatgcataaagtggcactgttttgtatctcctatatgaaagtcgtactactgagtcaatgttacctgggcaggtgcattgtattgtgtatttaattacagtgttaaatttctacttatttctaaaatttgctcaccccacaccacacccacacacgtagtcttctctgggactgacaataggcatgtccatgaagcaggaggaggttaaagtacagacaatgaccaagaaacacatccacataaactagtcagcccatgaggggactctgtgacactggcaccattaacatcagataccaactcagagtcccacactgacttcagagaggctcacagtacatccaattgagaaggcctcctgttgcattcttgaacatcatcggaggatgctgatttctggcttgtcatggatgagagacacatatagatatgtgaccaataataattttatatgaaatttaccattacattaaggcatacaagtaattaaaagtaaactggaagagcgtcagttgcttatatttttgaattaattttcaggtcctgtggatgtcaatattctagctaagtgtaacccctgcctatcaaatccgtgtaaaaatgatggcacatgtaatagtgatccagttgacttttaccgatgcacctgtccatatggtttcaaggtaagtaaaagcactttaagagtcacagtttgagagcataacttttcttggtgtgcctttattattctactgtgctttctgtatgtgccaagaactacttcactcgactatacttgccccttcttctccaggggcaggactgtgatgtcccaattcatgcctgcatcagtaacccatgtaaacatggaggaacttgccacttaaaggaaggagaagaagatggattctggtaggtcattagtctatgaccatctgtgtctgaagtattggagcaaagataactaagccaacatacattttccttttcaaatcaaaggacagtatttttcaaagaatttgagagaaatggcaatatgtattggtccctctcgtagatattgcaatataaaaaataaatggagacactacagcattctcagcacaggatgctacaaaaccaaaactaatttacaaacatacacatgtgcacattatggttaatcaggtcagattagggcaagacaaagtattaatattggctccattatactaattaatagccaactagtcccctactgctagtcatatattcatctgttgttttgcttattgctttaacagacagtgtgtaatgacaagatataggtcccactgaaacagaaaattaacgatttatttccaagacacaatgtaagtagacagacttgctgtgaacgattttaatctggagttatttaatcatatggtacaattacttcagatgtacttcatgaattatgaactggagctctttattaaatgacactaataatgtcacataagaatgctaatatactactaaaacttgttagaatttcactttttagaagaaatagacttcactgctgcattctattatgaagttctctcttattcatctagactttactcaaaaattattcgatacatactcaagatagttttatgccagaggaaggattgtatttaagacaaagagaacattcacattttgtaattgcaaggaagacaaaattttgttttcggattttttttttcaaaacatcaaggacattataagtatgttagtagatattgcaattttaaagatcagaaccagttcctcttcatttatgagcaaagaagcctgaattattttattagagcacaactcaagattaagatatctagggctgtggaataaaactgcttgtgttttagacctgcaaatacagtgggtttgttgacttttaagaccatggaaccatttgccttcttgcaaccggcataaattttattttttgaagggtttctgctttggtggatattaccttaaattgatgtttacaacatgtcagttaaaagcattttaaaaaatcaatttctggtagttaaaagctctatggttgatgagtgtaattatgcttttttcaatatttagaccacatgactttaaaatgcaacaaaaagatgttttttgccttttctcctctggcattcaggtgtatttgtgctgatggatttgaaggagaaaattgtgaagtcaacgttgatgattgtgaagataatgactgtgaaaataattctacatgtgtcgatggcattaataactacacatgcctttgcccacctgagtatacaggtacaaataataggaaatattttgccttccatcagtatatctgtttgaaagcatcattggaactatgttatatatgtttagtaaatctttttttatttgataaatggtaggtgtcttgaaaatcagatgtaatgtaaataacataaggacttaaagatagtttcagctaaccaaataaaagacccaggaatctctgttcaaacatacgcatctattataaagccatgctatccagtaataaaagaagctattttgctaaagcttttagtcccacaattaaatggcatttttgtgcaaaccattttccctgtgcaaaccaatccccagtacctgtgtgtaaagaggacatttatttaatagccaaaacataattaagcttttgagatcatttgtcttcatacttgtgtcttcgctagtgagtatttgcctctagtaacccatgtccctcaaaataaaagtcaggaagatattgagcactttggatagtcttataagactatcaccttttttctaacacttttgtttctttggatgacacatctcattagagtattaattgctaaacttcctccctattcaaaccaatttgctctaaagtcaacatcaagtttatgacttgtctgttttgtcagaattgattttttatttttattttttgtggctccgaattagaaacttcatagatatgctctttttcctttaataaattacttaacattgacaaaggaaaaacaagaaagttgtacattttatttgtaagaaaaaaaatggagaagtaattttgatcactctactcaaagttgccgttttcattttctgggtgcatttcatttactatgtctgttttcatataatttaatacatagcgagaaaatcaaaggatgaaattacaatgcaggtgactggagttaacatctcataacatgaaagatgaacatacatctgtataattaaattttcccagggatttgttggaaaattattaaaacggaagcttttatggaatacccaaactgaactttactaggtacctttcttgatgggaaaatgctaggtagaataatgaggctcggttttggcaacccagatctgtttgagtgactctgaaggctgccttttctagggtcttatttttaatttttatttttttggcaccaataaagcacccaatgtcatgtaaagcagtaatagcatattaagtttccagtagaaatttgaacgtgctgtattaccaagtcttctagtagttgtctatggcccttcgactgcttagtgggtggaattttagcattatttgatattttacataaacaaagaatagcaagtatattcaacatgcacctttctagagtatctggaaagaatgtaaatgttatgtagctttgattttcacactaatattaccaatattatcacacctcagaaacttgacttggagccctttgagctgcctaagaatttaacttcattggatgggctaatttagacttctccaagaagcccgatgtttgcactaaaatctgctacctggtaccttcttaggatagaataattctcttttccatcattttcctgatcattatagacagggcttaagaacccagttaattttggaggcctccttaaaccaagccactgtcactgcaccagacaaattggacccaagcatttcaagcaagctttgcctaaccaatgcacagaaccaggaatatatatatatatatatgtatatatatatatatatatatatatatatatttcctgatgaaaacctaggctttggagcacaactgcaatcaggttcttatgtgtctttttgacaataaaatttctagaaggtggttgaggactcttgagttggtttggaggagtcctcctgctttgactttagatttgctattccttattcttatccatttcttttgagtctttgtctcacctgctcacccttcatttccccagctccctccctacacctgctcctcttgaacacatgttttctcctattctaagtgtcagttcagagcagtttccttggagaagtgttatgaagcctcacttccccaactatgtcagatctctttctttgaaacatatcataaatacctaaagcttagccaaaccattttttagccaaaatgtgacatctataaaagctgtcatctgggaacttgccatgagtatctgtcaagagccatttggctctccacaagaactgggactgttttagtctttttacttataactattgcaaatgtcagtttgccttaatttgggcaaagaatcaacaaaaatactaaacagaaagtgcatggcgtacagaacatgaagatatgaccattttatctttggaatgggtcttgtgggccatgaagagtttgacaatttggcatgagagaaggtatctaaatggggcaaatgtataactcatctattaattgtagtatttttgtgcacacatgaaatgagctcatttacaaaatttctaacaaccatctgcggattttgaaatcattgacacataagtgacctttaattatggggaagtatgaatgaggctctagagttttatatcctacttcatccaagtctgcagttaaggaggaattttcttataatgtgattatatggttttaaatttgagtttggaatctgattaatgagcatgagatctgggagcagaagccctgctatgctcagggaatataatagtgttgtcagtgtttaaaaatcatcctagtaacaagttgatttttcctttgaaaattttttattctatatcccgaaagcatacaatgagaagtgaactctgtttaataagaacaaataatgacttacagaaaaaaagcttgtaaattattatggtgacagtttttgtatttgacacctatgtcaagagtcagaacggacattatgtcaatggaaacaaattcagagatctgagagcaatctgacagagaagttatgatgtgatgaacagactacaaaacgtgactagaaatatttaaaataaaatgagccaccaatggggaatttattaaacattgtttaagccctatgtgaccaaaatatcacagtaagtagttactgatttgttagaggagaaaattctctgctctttcctgctccagggattgacagcatgaattgtaaggacaagtactgtttttctgttatttaaatattgctgtaacttcaccaccctagtcaccaaaaccattctccatatactccagttatcatctgtgcttccagttgtgtaatgcatgactgccgattactagtatattttaggtaagattaacttttgaaaagttgaattcactatgaatctaaattaacatccctatactattaagaaagtaggacttcagaattgttaaacaaataattttaaaattaaatttaaggttttaattgtagcttgagagaattttgttgattttgattttttgtttggttatttttttaaaatcatgatcatcttctttctaaagacaagacatttcttggagctaaatttccaaggaattcctgaaataacataaacctaacacctatgcaaataaaaactataaatgtggcacccctgtttttttaaaaaatggacactttttttaggctgtagtgttaacttaggtgtttaattcaaaaatgtgcttttgtatatttcccaacagtcagaaccctggatctgctgtatcaagactgtgtgtcttaattaacttttattcttacaggaccacatacaagtatgacacagttgatcacattttaagcccttctttcacttaatgggattacttaaattccataaagtgaacatctccatgcagattgggtgtgtaaagccttagaacacattttgtggaaaatattcagaccactttaaattttccattgtgtacccattttctctttgttttccgaatctctgacgcccatgcacaagccattcagtgtccatcttaaacagtaaaactgctggttgttccatcacctggtttagacgcagacctctagctccctgtgatggcatttaccttttgcctcattttctccatgtttgtgcgtgtggcccggctgtaggtaagaaatccaagccttgcttcagcttgctcgcccacccctgcttctctgttgtgaacgctgcgcattggcttcctgtgctctgctgttgtattgcaatgtaaaaagtcttttgtctcttctgtctttgtcgctgccagctgctaatctgaatgaggtggaaaaaggttagttgccttttaagtctattatgattttcattttagtctccctctttcttgtaaagttacatagatttcactgcgggtacacagtaaaaaggaatgttgacaaaatataaaatctgaaaacaatatgccaaatcagtcattcagatgtttaatctatgcatcgctatgacaaacagtataaaatgggcctctgaaatgcaatttatctattgttagaagacaatgaatagaaactttttgagtgggaagaaggggtggctagaataagggactaatataaatttttttaattttctacttgtctatattctttcactttttaaatatatcacaaacatattatttttggaatgaaaaacataggttatttagtactgtagataaggctgtagatagaaaaatttttaagtaagactgttcccataactttaagcaaatatctttagtaacatgtaacatgaaaaatatttgaaggtgtatacatttattgaaacactttatgaaataaatattataaagcccaagaagttgacttataaatttgtgttataggataccgtgactactaggtagtatgtttaagcataaaaatgccatatttaattattggcgtcaatatgggccaccaggctcccaaaatacatcagggcccaagaacgtgagtcatagaattattttatttatttatttatttatttatttatttattgagatggagtctcactctgtcacccaggctggagtgcagtggcgcaatctcggctcactgcaagctccacctcccaggttcacgccattctcctgcctcagcctcccaagtagctgggactacaggtgtccgccgccatgcttggctaattttttgtatttttagtagagacgggatttcactgtgttagccaggatggtctcgatctcctgacctcatgattcacccgcctcaatctccccaagtgctgggattacaggtgtgagccaccacacctggcctgagtcatagaattattagagtgatagccatgtctgggaaatcatcatggaatatttatgaaatgttatcttaaagactcagagttttaactaattacattggatttttaattattcagcttaccaaaagtcttcaagtaccaaatgctggcacagtgtcctaaaaggaacacaacgtgtgcttgtcttgatagctccagttgtatctgaagcatttgcagttggattatgaggataataaggaagttatagactgggcacagtggcttacgcctgcaatcccagcattttgggaggccgaggcaggtggatcctttgagcccaggagtttgagaccagcctgggcaacatggtgaaaccctgtctctactaaaaatacaaaaatgagcagggcgttgcggcacaagcttgtagtcccagccacttgggaggctgaagcaggagaatcgcttgaacctaggaggcagaggttgcagtgagccgagattgtgccagtgcactgcagcctgggcaagagagtgagactcgctttcaaaaaaaaaaaaaaaaaaaaacaaaggttattatatagcaggtctctctgtcttctcttgctatgggcttcatttcctctgttgcattgtttggatgatttactgtgtttgctgacttactcttacagtgtgcagagttaagttgaaaacaaatggtttcatattttagaatgtaacagtataacatgtgctattctctgtggattaatgcatctaataccttcctgggtcaaatggcttcttttctctttacaagtactaagcaattggtggcctgggtcagggatgtctaaggtctgagtctatctcagaaacataatagcaattattccatcacaggaatatgtccttaaattgttgtgtatactcttagaaacaatcttggcagtacaagtgttttaaatcgccatgtggtttcatgtgttgactaaatttcatgcttatgtttataaaagctcccttttatttccaagaatttgctgctgactgaatttgcttttaaaagcagtcaaatcattctctatattttcaattcaaaacttaattggaaatagaatttccatttttttctagcacctgggggaattgtcttaaataaaaagaatgtatatcattagtcgatacattgttaatttaaaagaactctgcagtttatgtgaacaacacaaaggtgggaaaaaacttctatgaaacaacgataaaccacttattcaaggatatgcaccttgtaagtagaggcccagatgcaaacccatgtctcattggccccaaagcatgcactttgaggtgggggcctctgctggagcctgtcccttctgccttgctgcctccttccaggcacggcttcttttctatctcacaatagcttatttctcattcatgatttatgccaaacaagctttccttctgctctcctgctgtctcttcagctcgctgtgcacaattgtccttatgtaaggaaagctgtacccacaaaattcaagtgcagccaagccgtctattttatctagataggaaaaaagcaccgaatgaatgcctgtacaattaatgaataaattccccccgagaactaggctaccttttatcccataaggcaggtggttagtttgtgtaggtaaggggaaaagttcgggtttctcttcctggcacgaatatttataaactctgggacacctcccagtcttttatttttcttctgtgaaagaggaataatgatatctgtcatataattcacatagacatttgagagtaacatgtaactatgtatcggaaaacactttgaattggtaaatgtctatactctggaaatatcgaaggctgccctgtaagacaggtttaaattttgcatcatttaattccagccatcatcactacagtgacatggttcagatatatttgatgccattcctcatggcagaagaattcttatgggaattctttattcaattttttataaagaaaattacctaaggtaaattatgtatagaatggaaatttctctccccatattgttcagtattgtctgtctttattattattgtttttaattgtactttgtatgctcacttcgtatagaaagattttatttagggataggtctttggttctctttgcccccatacactactttgaaacataaagaaatacacaatgctgaagagctcttggatttggctgagttggatttgtagattttgtgtatatttttagattttcatgatctcttagtaacagtgacttctgtttttaattctgcttcgagatgtgtaaggtctttatatcaaggtcgttatagttgcggacacacttgtgagcctcaaataagggaaacgttaagttgccatctgtttttactagagagaatactttggcagcctaatgatactatgtggtttgtattcatcctccaacctttcaaaactttcttaaatgcactttaatctcaaaaaaaagttttaaagatcttgtttgctctttagttaataggcagtgcccattgagcccagaacaacaatttagcctaagcaagtcttattcaatctaatttgaatttatttattttgaaaactgagttaaatattttctgaagtttcagtagctgctggaattggctatattatttagcctcagtgttccaataaggaaatgctgaaaaacacttcattttctgtttgtttatttggagaggtaagttttttttttttcatttaaaaatataccagatgcttattgagaaaatatattatgcaggacaccatgctaagtattgaaagtgatacaaaaatccataagacattaccctgatctactgagcaaaaactctttggctttgattctttactgcaagatcagatcagttcaaatatttctcagtacataaccatcacttctcacattccaagaacattaataatataatatagctactttactagtttgtaagtaaagaaaaacactccttctgaatatggacaccgaccaatctccctgacagagtcaagcaactcatttcataccacttagaaaacaaaaataggaaccgaaaactgattttccttctttgaaatgtcttaacacctacatttatagcatattttcttgaaccttcctattttgaattatgataaacttttatctcacagggtttctctatggcagcattccgattatgtacgtgtcccattttgcacctattgcacacaaagatcacatctgttaatggctaatgtatcttactgggcatctgcctgtgttactgtgttgtggtgcctgggattataaccttgagtatgtaacaaatagggcctgcctggtttagcaaaagaggagaaaatatacatacttttctttcaggtccaacttaatgaagctgccctgtgatgactcccataatctcatcagctatatccaccctgtgctatagatcatcagtctctctgccacactgcatggtctgtaggagtagagagaatgtttctgtttctataaataaagaacaaatgggaaatgtatactttttaaaatcagaattggatcgaatttataaaatttggtaatgataaacattcaggtccattcatcttaaccttcctcaaacattccacttaagtgctgacaagtgcaatttcttgataatggagctcatagtctccatcctccattggaatggtaattgttaggcataaaaatacagtagggaaatctggaaatgaacagtctacccatctcatccagcctgcaagggcacacctcgggctcacatctcagaacacaaatctgctatcagttttttaattctctctttgcttccttacattgttctttatgtgatctgggtctccattaacatttaaaaagcatttgcctgcaagaagcaatcaaataagtgctatctttcctatttttttatccagcactagtttgtgccactttactagcgaatgcaatgggaatggagaaatacaaaaatataaatataaaggtatcccatgccctcaagtagtgtacttttaagaaactaaatcatattttttatctattaggttgcttattttgatatcttcccttgctgagttaattcaaagagaataaaattagtacatttattcaaatctttcttgagtttgactgattacatttaacactagaattctggtccagttattcagattgccatcctaaatttctccttcattattatcaatattaataattatttcttataaaaaacagtttgttacaagttacagtaggaataaaaatgggctgcagtatcagctccagtaccctcgccacctctttcgtacatctatgatatccagaatggactcagatttttatctatttcaaagagagaagaagctaatctagttacattagcagaaggtagcaacagtagcaagagttacgtgtgccagcaacaccatgtactgctatctaaaattattttgttgtagacatgcccaatttgaatttaaaaagctaactttggggaaaattaaagagagatactcaacatccatttagtgtaaaacaaattaatatttttaacagtgatttgagttggaaaatttcagaaatcttaatctggggacaaaatgacccacttttttgataagcaggcttccacctttttgataagcaggctttgaggactaaataagcctagatgagacatcccattgcccagatttcttggtagatagaaagcaattaatagtccagccaaggtgggcacagtagctcatgcctataatcctggcactttgggaggccgaggcaggtggatcacgaggtcaggagtttgagaccagccttgccaatatggtgaaaccttgtctctactgaaaatacaaaaaaaaaaatcagctgggcgtggtggtgcgtgcctgtaatcccagctactcaggaggctgaggcaggagattactcaaacccaggaggcggaggttacactgagctgagattgcaccactgcactttagcctgggtgacagaacaagactccgtctagggaaaaaaaaaaaaaatagcccagccaacaattcttcaaaactttcctgtctgtaattaacacagcttatttagcaaagagaacaaatctctttggggtaataatgtatttcggaactgtataatatagtttttaataataattaaaaataaaaatttcattcagcccagtttctaggccgggatgctacacatatgtcagtcattaaggaaacttaacggacagtaggaaattagatgttgatcttatttctctaaattttccatataggaacttctccagggtaaagctttgtcatactcatccttcaatcatttgctagatctagcacaaaaaatttctcccaagatgtgtaatgaaaattacactaaagcagcttttgttggcgaaataaaaaaacctcactctgagagagtacatgtaaactaattatataatcagtaaatttatttttaaactattcttactcatttcgggaaacatttattgttaactctcatggaccatatactatcttcattattcattcatttgtcaaaaaattactatagttaagaaatttcaacaatgcttaatgagttaaagcagtattttttaaagaaaaagtacatttaagaaatttgacagtatgtacaggaaatgtaaatcaactcaaatattctccaaataatatatattatatatatatttaatatgtaatatatcatatataatatattattatatataatatatattatgtatatattatatattatgtatatattatatatatatatatatatttgagaccgtgtctggcctaggctggagtgcagtggcatgatctcagctcactgcaacctccgcctctcaggttcaagcgattctcttgcctcagcctcccaagtagctgggattacagatgcgcaccaccatacccagttattttttgtattttcagtagagacagggtttcaccatgttgacctcaggtgatccacgcacctcggcctcctgtagtgctaggattacaggcatgagccactgtgcccggttgatataatgtaaagtaataaaacactttcaggattatttttatacttaatgatagtatatatatatattatacgtgtgtgtgtgtgtgtgtgtgtgtgtatgcacataagtagttaataattgcagctgttaaagttcaagatcatctgcaaacttaccataaagctgatggcacaggcattcgactcactttctcttcttcaagacacagtagtctatgattctcttgcctttgctgtctttaagaccttgaagaggagaattgttgttattatttggtggatagcctgtcctgcaagccctaactgctaacaccagctcccctccaacagaggagtaagtgatgattggtccaagtcaagcacaactcacagtgctttgcagagagacatctggccacagcagcaaatgtagagctaatctacactactgtgctccacttacatcttgactctcttgaagcacggggagccttgtcatggagcactccttctcctttgtgcaccgcttattacagactgactgttggagaagcttatagtcctaaaagaaaacttgagacaaaggagaggacagctacatgaaataaaatgagaggaaagagacgtaaaaatgaaaaaaagaaaaagaaaaaggaagaaatagtggcataagttgaaagttttattccccgctgtaaacttccagtgatttggaatttactacctgtattgttttgctagggctgccataacaaattactgcaaactggaggcttaaacaacagagttttattgtcttacagttctggaggctagaggtctgaaatcaaggtgttgattcctgccaaggattgtgagggaaatgtctcttccaggcctgtctagttggcttctccctgtttttcatatcatcttccctctatgcctgtctttcttggtatccaggtttccctttttgataacacaagccatattggattagggcctatcctaatgactttattttaacttgatttcctcagtaaaaactctatctcaaaataaggtcacaacctggggtactagaggactcacacatattttgttttgaggggcacaattgaatcctcaacaccacatcactgtattttaaactctgtttgcaccagaaaacctggtcttcttccactgttctccatgtcaccaaaaggtaattcccaatataggtacccaaatcatagacattctagacaactccctttctctctttcccccatgcttattcagtccatcacaaagtcccatctgttttgcttcctaaacactgctttgggccatgtatatctccaccccacccctaccctgtacaagtggtcacctctcatgtgcacttgtatccccacttatgcaatctgccatcctccactggagacagagttctctctttctctctctttctttctttccagaatttcgctcttcattgcccaggctagagtagtgcagtggtgcaatctctgctcactgcaacctccacctcccgggttcaagcaattctcctgtctcagccttccaaagagctgggattataggcacccactaccacacctggctaatttttgtatttttagtagagacggggtttcaccatcttggccaggcttgtctcaaactcctgacctcaggtgatctgctcgccttggcctcccaaagtgctgggattacaggcgtgagccactgtgcccagccagagtgctcttttcaaagtgcagatgtcatctggccatgccccgactcaaaacctttcagtgggagcctattattcatagaatgaagaccttcgaccctgtggcccagccagcctctggggctcctctggcaccatgttttcccgggctcactccccatctcttagggctcctgttcttcatgctgcctcctgcagaagcctctgtcagagctcttcattctccacttcacccttgcctctgagtctcacctcttcagaagaatctctcctgtccttcttcagaggaaacagtccctttctagggccccataaaatgttcctgcttagcattcagcacagaggcaattttatgcatatagtagtcccctcgttatctgcgggtgatacgttccaagaccctcagtagatgcctgaaaccacaaatagtactgaagccagttgctatcaatcagaacatgtttctgttcatgtctttcaacccacacactgaatccctcttcatcccaagtaagcccttagcatgcatggtggctgtaacttttgcagtttgaggtatgacagcaaaactagtatgaatttctttttcccttgttcacaactttgcagagataggagattcatttttgcggtagatcttagcatcctcagtgtacaatttttctctctttccttattaagttaagaacttttaccttttcacttaaaggaagcacttgacagtttctcttgggcttgtccaaattaccaacatcactactcttgcactttggggccattattaagtaaaataaggtttccttgaacaggatgactgtgataccacgacaacagatttgataactgagatggctcataagtgactgatgggcaggaggcttcttcagccagataccctggatagagataatttacgtgctgggtgtgatggagcagaatggaacaagatttcaccaagctactcagaactcatgcaattcaagacttacgaattgtttatttctggaattttccatttaatatgttttggccgctgttaacagtggggaactgaaaccacagaaaacaaaactgccgataaagggggactactttacttgggaaattactgaattaatatctttctcctcctcctctcatacataaactctgtggaaataggaatagtttgttgttgttgttgttgttgtttaccattatacttctagcattggtagaggtccccattcatagttgggactcaaaatatatggtgatgttaaaaatctgatttgctgttttaattatttgaaaaagctataggcagatcattctgtaagtatcagggaagagctttgtagaatagttctaaaactatttcagtaagtatggtaacaaatttaaacacaaagataacaagatactaggaaggaagtagaaatgaaggcaataggaagggcccctttgtgttaaacaaggaaggagcattaaaaacagttaggttcaggccgggcacagtggctcacgcctgtaatcccaagactttgggaggctgaggtgggtggatcacagggtcaagagatgagaccatcctggccaacatggtgacacctcatctctactaaaagtacaaaatttagctgggcatggtggtgcgcacctgtagtcccagctactggggaggctgagacaggagaatcgtttgaacccaggaggcagaggttgcagtgagccaagatcatgccactgcactccagcctgggcgacagaatgagactccatcacaaaaataataataataataataaaaataaaataaaaataaaaaagttaggttcatagatctaaaatgaagcagaaggtaaggccaaactccaggtattatttctcataaaaaccatcaaagtgcattgaggtttcttcctcagtgcaataatactcacaatatcagtaccacagggggctctgaacatatgctggcactttatttttaccgctgaatgaagtaatgttattttgtacagctaagtgtgatactccctctggtaacttgctgtctgcatgatccatatcttcagaagcattttcctttttattgaaaaaaagggatttttttagagccacagttaaccttacacatctctaattccagagcctcagtttactgatgaagaactgaggctgagaacaataaaatagttctgcaaccagtcaactctcgtatattgcatacaaccgtagaaggccatcctagacaataatacaactaaccaaatgtcattttccccaataagaacagttacttcctgaggtctctttatgctgattcactcttcactccagagtattatcaactctgatgatccagctttttactgttccacctagaaggtgacccataacatttatcatccaaatcagggtagttatgtgagtgcccaggcacactattgacaattacgttgggacaacgggtataaaccaggacggttgtacaagcaagaatgaatgggcacattaccactccatgaaatttttcagaagaaacacattcacagatattcagtaagtagcattttatctccccttcaagagtgagtctgaaaaatcattcccatttagaagagtgggtatcacttttggcatgctctttcacaagttgtaatagtgttactgtagaacttggtcatttcttgtcctgttgtgtcccatatataaccgacagacaaaatcaggaagaggtgatctaagaaacagataaaactctatacctgtaatcccagcactttgggaggccaaggtgggaggatcagttgaggtcaggagtttgagaccagcatgcccaacatggtgaaaccccgtctctacttaaaatacaaaaattagctgggcatggtggcatgtgcctgtaatcccagctactcaggaggctgaggcaggagaatcacttgagcctgggaggcagaggttacagtgagccaagatcacgacactgcactccagcctgactgacagagcaagactctatctcaaaaaaaacaaaaaacaaaaaacaacaaaaaaaaacaacctctatgtcaaaaagattcctctgtttacaacatgtagcactttttcttaagaaagttctggcattcgcagatattggttaccagcaatatttattaccagttacagtagatcatttactaacctctcttatcctgaagaggtaaccatagaccccttgatggaccactctttgttttctcgccaaaacatacacaaccaacatatatacgtacactcagaatgcttcaacctcttatcaacaagagatgaaaactagaatcataaggaaaattaatttgctcatctgatcaaaagtgaaatcacaaatgccaggcaatgactgtgttccacactattgggaaattttaagggcccatggctgaaaataaataaataggatttcctgggatttagaggaatgggttgaagccagatcatggagtcaaggcttgcctaggctcctatctcttgagaggctcatagacaccaacatttaacctatattcaaccacattgccccaaaccactccaatggattgacttatctttcttgatgtcagtttaaacgtattaagacctgcttatagggtaatcatttacaacactaactctgtatagtcgaataaagaatatttccagttttcctttctgtcacctcacactttatcatctctgaaagggaggcagccattgataatattatctcaggacctgagccatcacaaaagcaaactcaattcccctattttttattatttttccactaactcagtactagctctgactacacttaaaataaaaaccaagtaaaaatggcatcatgtcctcacaatactatgaggtttgggggaacttttcaatattggtaactaaaaatacattagctgactaatgttagtcattttatctctattcttcctggaaaaccagtgcagcttttagctgtctaatttcctcttactggttgagaagtagacatgcaggccagtattcatctaaggagcttgctaagtttcccttcttatattgagctcctgaatctcgccactgttgcactcttttgaaagcggtccttccctcaagtatagcagaatccaatataattaaggaaaattaaagaaacagtccaatgaaaacattcatgttaatatttagtcagggaaaattcacagtaatgtttaaagagaatagcataagctatgttattactaatcatgagtgagtaattaagcaaaaaattacactaatctctaaaggctagaatgaaatctgagttgattacaggtcaacaagatagagctcttgccttaaaaagcatgattcctccttttaatgactattatttgagtatgtcagcataccacactctggaaaaaacacaaaagcaaatgtggcaagaattctactcttagtgattttacagtcgagaaaagagagtcagataaacaccagtaatataaaatgcacacataacagtgcaaccctaaaaccttaccttatatgcttgtaatgaatattaagtgactgcatatttatacagtgtttaaaactgtttagcatacagtagtaagcatgatataaatgctcattaagtacataaacaaatatataccatgtatatgtcataagataggcatagtcaaacacaatataaaattagagatagagaagaaatagttgaaaagatctggcatgattccataaagaagggaacatataatggatgagaaaagtgacaacagaattgtgaaaggttgttattaaagcaaaaggagaaaccattagccctggcatggagttgaaataaattcaggaaatagtaaacagacccaggtgatatgaatgtcgggtggaagattggtctttaaagcaagttaggcagtaattggatgcagaaaatgtttttgtaatatttgttagcattataatgttcggtgataataaagaaaatcaaatctttttttttttttgactgctcttgtcacccagaccggagtgcagtggcacaatctcggctcatggcaacctccgcctcctgggttcaagcgattctcctgcctcagcctcccgagtagctgggattacaggcccccgccaccacacccagctaatttttgtatttttagtagagacagggtttcaccatgttggccaagctggtctcgaactcctgacctcaggcaatccgccctcctcagcctcctaagttcggggattacaggcatgagccaccatgcctggccaaaaatcaaatcatttttgacgttgtcaacctatcttactaaggtcaggtgtatagctatgtaatggtcacaaagaagtaccatatacaatctcagtaatgattattgctattttgctactcttggagaggtaaggaatacttgacattgatgtagttttttatgttcaagttggcatgcttaatcttaaagctgttgattagagatttaacaatctggttagctaacagtttcttggaactttgtccttgttcactcctttacattatcaagtctgtggagtaattccttttagacaagggtcaactctcagttttatttttttagagatgaaattctctgtctctgttctttccctagctcaagactttctctgctggtagattaagaactgattaggagcagagtccattacattcatccttgtagctccagcctctagcacaacatcacgtagtaaatccttatggactgtgacttagattggatgaattgggttggattgtatcagagtaaataaagaataaaacatttccctttattataattttaaaacagtttcttatttaggcataaagtgaaaagtacataaaatgacatttattatgtatctcaaatggtccttctttactatcagtttttacaaactgtcttggatagatactactataaacagcctatatctccatcagatagatttggttagaaactgaaagtgatttcatcatagtaggctgataaaatatgatgaatgcatttcatcaaggtatccaacttagagtaatactatttgaaatcacaagcctttaaataaaacctgtttaaaaatagttcatcatgcatatgttgctaaaaatcttttgtatcccagaaaacttatagaagcaatatatgagacttactgtgcaattagttctttttaagagacagataaaaactaatatcatacaccagattgatgtaataactagatgaatacatttattaatttgcatcacgggaaaagactcttgaagtctaaataatatgccacatttagttgtcaagcaatgatttctaccaactagcagtgtattattttaaaaggatcatcttgtaacaaaggggtgctgttacaaggtgcacaagcctgaaattttaaccgatgctgttacaaatgacagttttagtagtttcctggaaatgaacagctgcctatagatgtgtcactttatttgtccatttattgcatataaaacaattcaaaagtaggagtaaagtagaaaaggtaaaaataacttaaaatgtattatgtaagttaatatatattatgtatatgaatacctttccagtcaccttaatactttatgccacaattgggaaagtcttctaaatgaaaattacatttggtctaatgtatgtgaaataataaccatgttatttttatcagaagaaattttctaaagaaattatcagtcatgtgattcaacaaagagtacctagaatctgcgtggttatgccttcagctctcatttgttgatagaagttctatttcatgagttagctgactttcatggaaaaaatatatgttccctgtctctgtattgagtctccttttacttttttctttatatgtcagaggatgtggctctaagaagttttctgttgagctgcggcaatgatccacaagaaggaaaccaagtgtttttcttatagacttttaagaccagagactatgaagatttgagaatatttttttcaaacataaaactatagaataagccaggcataaaagggtacatatggaatgatttcatttatgtcaagctcaaaaacagtcacagctagcctatggtcttgtcatgatagtgatcctctttgcagggaccggggggaaggcttctggggtgctggtacatggtgtgtttctagatgtgggtgctggtgacctgagtgggttcagtttgtgaataatcattaccaatttattcatcctttgggtctatgctatatatcaagaaaaaaaatccaaaataaacaacgccattgaaaagcattcagatttccttttcctaattcccatagtatattctgagggtgctcatattagtcacagatcacaatagtcctgttgtccaaaatcacaacactacttagcagcagactcagaattggataatggaccacctggttccatgccttgtggcttttgttttgggttttttgctttgttttgttttaaatcacaagctgccctaacctctaagacccatgacaatgacacagtctgctggcaggaagcctgttgacctttttctatgagctaacactgtttgccctgttgcaggtgagttgtgtgaggagaagctggacttctgtgcccaggacctgaacccctgccagcacgattcaaagtgcatcctaactccaaagggattcaagtaagtcaaaagctacctttttgctcacagtcagggtaggggacccattattttaggagcccttctcctccttcatccttagcttcacacctctgctcaggattaaagggacctattcactagtatcagtgacattttttaaatgtcgatatacaatatggacttttttttttttttttttttttttgagatggagtctggccctgttgcccagctggagtgcagtggcacgatctcggctcactacaacctcctcctcccaggttcacgccattctcctgcctcagcctcccaagtagctgggactacaggcgcccgccaccacgcctggctaattttttgtatttttagtagagacggggtttcaccgtgttagccaggatggtctcgatctcctgacatcatgatccgcccacctcggcctcccaaagtgctgggattacaggcgtgagccaccgcgcccagccccagactttttgtttagtacactaaagaaaaatgaaaaagtgtttccttttcatccatgattttttttgtgaagtcacctaaggcaatgagcagcctttgaaaatgcttacttaaatttatttgaaggcccaaccggtgacatttgtaatgtcttctatgtgcttcattgtctgaaggtaagtctgtggtaaaatagagaatttgactttaatgtaattgaagatgttacggtctgaaacaatgattggactatccaaggtgagaaagatagagtgaccatatatctcaggctgccccagggagtcccaggctatgcctgtgatgatcactgtagttattgatagtgtctcttccaacttaaatattttttgcatggggtgacaaagcattataatcccgctaagtgtactcccttaagtgaacacagaacttcaaaaaacacttcctttttcctccccagcaatattcctgaaatatgtttgctatgaaattacgtgatttctttgccaccatcctgtaatattttaagggtctttcaacagcaacttctctttttagagctggcagtagtttagagatcatctagtcttcatttaaacatgaggaaaccatggcccggagaggttagttgactgtccagagatcttaaggttatttattggcagagctagagctaggatttatacttaccagttgggtgatttttctactatgtgttacctataagaaattttatagtttattaacattacagttggtattgtgtagcaaataggctggattcttaggaattacacagtcgggtacaggggttgagctgtgctttcatcagacagctagcaaatagcattatctgttccttcaagcaatatttattgagtgcctgccatggccacagcacatggtaataataccatcttatgattttgtagtcctttatagctattcaccttcacttaattcatcttcttagagaaatgacccaagctcaattgccatagaattcagggaattaacaattacacaggtcgggatgaattttataagagaagatggaatttgagctggattgctaagatatttgtacttaccgaacagatcatcagatattttaagtcgggtgggagagtggggtcagaatcgccagatccccactgcttttcaaatatcaatctaaattaaatatttattctcaagctttcttttgacaatgtgcttttgctttaatttggtttaaaatccaaaaatgtagaatatgtaggtacagttgtagcacctgctaattccctacaatgtctttttgaaaaaggaaagaataaatttgattctattttgcattatattttagtttacaaccctaggcaaaaacccagtgttattccattttcactttatacaaaactttacattatattttattcaaccaaacactgtaggtaagttgtttttagtcttcatatcaatgatgcgctcacaatttaatttggcaaattgaaaacacatcacttacataataaatatcatttcttagagaaattagctagtaaggaaagttttccagaactgctcatctgctgaacagatgtcacagtactttgtgtattgtaagtataagataaagtattagtaagacttaactgaaactattagaaagtgagtttgtctgcaaaaagactaatccttaattaaatatctcctctcgccatcaaataaattagacactcttaaaagtgcattttgctgcattatggactaactcatttggaaacccactgttttccattatagtttgtaagctcgtttcatagctgtatgtaggtagtttagcagaaaacggttaggtcagtgtgtgtgctgttactcccgacattgtgggaaaggtagctgtggaaagaaaatagacgtaaaaatcaaattctgtgaagctgctaaagaaaatctctactgacaaatgttgtttagacaagttatgctatgctacttcaacttcattttcttattactaagctaacagagctggttttacttttattgctttattatatacctcataaatctcccaaattgctttgagatatttttagactatgatatgccataagcagtattttcaaacctgcatcttacatagccagctttgggcttctaaacagtgtattttatattctttgcttcttcctctctccttgtcagataatagagttgaaggaatgtgataggttttattgataatacaaactcaggaattcttatttaaatttttctttctgttttgaaactcagtctgaggagcaaaagaaagacaaaaatgttggacataatgtaactccaagctctaatggtcttgaaaaatagtatttggagagaagggaatataaaatagctcttagacagccgctatggtggatgtgttgttctcttatctttcactttgatttcttttttcagataaataattcagagtgtttcaaagcatttcttcttttttttaatgcttggcacttcaacagctctgctcacattaacattgatggaagttctcttctcgggccttgtccatctctttgagaatgtatatggccacttagagtctatttaacttcagacttgttgtttactttgctttgctatgatttagcattaaaaccaactggctgcaaagcaagcatgcttatgcagtgagctcattttatttcttaattcatacatgcagagctgaaagtctgtttgctactcttagaggctatatactcccatttgttttaattcttccgctctccagcaactctcaaatcctgatttagcattttcagacaaaaccttaggcattcagtaatgccacattcacttgggtgtttttaattatccttacttcaaatcctaatagctttgaaatagaaaagtggataattaatacagactaaaccataaaagcttttatagaattataaagactatatagagaattattttaaaaaccagccatttatagaacgtgcattatatataaaaactatactaattaatttacagatggatgcgtttaatctttaaataaacctgtgaggtggaattatatacgtgttaaagatgaggaaaataacacttacagagattaagtaatttagtcagtattatatatactttatgctaagtgaaataggccagacatagtaagacaaataccggatgatctcacctatatgtggaattttaaaaagtcaaacttatagaaaaagagagtacaagagtggttaccaggaattggggtggggaaaatgggaagatgttggtcagtggcacaaattttcagttacaagatgaataataagttctagagatctaatatcacagcatggtcactatagttcatactgtattatatacttgaaatttgctcagagagcagatctgaaatattttcaccacaaaaggaaaagggtaactatgggaggtgatggatatgttaattagcttgactgtggtaattatttcacaatgtatgtatgtataaaacattaccatgtacatctttaaaatataaagattttatttttcaattatacctcagtaaatctagaataaaataaagttgataacatacaattaagaatgaagccggggtacaaacacagttctgtaaaacctgaattctgcaaagcctgaattctgcagagctaagttatagttttctcatatatacacacatatatatacacatatatacatacactgctacatacacaatacatatgtgtgtatgtatatgtatatacacatgtacatacatatacacacacatacatatgtatgtgtgtatatatgtgtatatatgtacatatgtacatattctgcaaagcctgaattctgcagagctaagttatacttttctcatatatacacatatatatacacatgtgcatatatatacatatatacacacatacatatgtatgtgtgtatatatgtatgtacatgtgtgtatatacatatgtatgtatgtgtgtatatatgtatatgtatgtacatgtgtatatacatatacatatacatacacgcatatgtatgtgtgtatgtatatgtgtgtatatatatatatgtgtgtgtatatatgagaaaactatgacctagctctgcagaattcaggctttgcagttatgtgtatatgtatgtatatatgtatgtgtatgtgtgtgtatatatatatataaagtcagtgaaccctctcttaaactcaaatcaaaaacactcttggaagccaatgtgtaagcctaataaatcacaacaggagagtgttgaggaaaaggtggagggtagagggaggcttccagaagacccctcctcatagatggccatacctgtagggattctatggtcccctataggtccacagtgcagtttgaaaactgctgcacgtgccacactgcctttcttcatgcagctataaaatcctgcatccttggtatcataactagagatcccagtggtcagcactagagaagtacaggtttaaagggagcctgtggaattaattattcaacagcatagtgcagtggttagaaatacaagctttcttgttagattgcttgagtttgattcctggctgtggcacttagaagttgagtgtttgggggcaaagtacttcacctctttgttccttagtctcctcacctgtagagtgggcaaagtaataccacgaatatcacaggactgtggagaggattcagtgaatccatagaagccacatggttagagcagggccagaggaagtgctcagtgaatgtcagctgtattattactcctggttcctcaccatcaatgcagccaagaccctttaccaccatggtgaacaggctgaaaactgtccgtgggattggccccgtgaattttctatcagttcttctatcctaacccattatgtcagtcccgttcttctataatgagtatctggattcattgtgaattagggtatttaatattaatatatttgcttttcttaaaataataccttgttctgatgtatctagtctctattgtaaaattaaaaatgttaatctttttttaaatatgtttaatatttccagtaaattttacaacatagcacttttataatctcaatgatcaaatggattaggccaaactgaaaatatagggcactgtaagcaaacaaaatggggaaaaagaaaggaaggaagagggaggagagtgggtgggagggagtgaccctgctacaattaccctgttcttatttgggctgtggatgttcactatcaaggagataaaatcactatttctctggtagatcacagtgatagaacatggaacatactgcagaacagttcgattttctaggtatccattaatgtgggggctctatgagcctattctaaataagtattttaaagatggtgccattgtgtctagataaaatgcattgtttacttattttggctcagttgggtttgaaaccattacctgcttgttccaacagatgtgactgcacaccagggtacgtaggtgaacactgcgacatcgattttgacgactgccaagacaacaagtgtaaaaacggagcccactgcacagatgcagtgaacggctatacgtgcatatgccccgaaggttacaggtaaaagcagaaatgaataagacctagtgttcaataagacctagcacaacagggtgactatagtcagtaatagtgtaatcgtacattttaaaataactaaaagagtataactggattgtttgtaacacaaggataaatacttgaggggatggataccccatttaacatgatgtgattattatgcattacatgcctgtatcaaaatacctcatttaccccataaatatatacacttactaggtacccacaaaaattaaaataaaaaaattttaagacaaaaaacgtagaacttacagaagcaaagagtagaatgagggttaccaaagaggaggacagagggatggtgtttggggagatgttggtcaaagggtacaaaatgtcatttagacaggatgagtaagtttggaatatctgttgtacagcacagtgatgattttgtttaatagttaagaatacttgaaaactggaaaaacaaggaagtgcacatatataatatacagttatgttatacagctctcaattcagattggcaattaagtaaaatcgtattaactaatttttttttctccttattcttcagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcaggtaagagatctctctctatggagagatgatcggatcttaaaattcagcttcagagaataaacatttgtggtagcttctgaatgattgatagtatgtcttaaatagacagttaaaaacagaaaatgctccttgtgtggacagcgttagtaatttttctcttcaacatttgtattttcaagacaaaatgaaaaacaaatatttttattcattacttgataagcagacagtaaaaaaaaaaatatgtctctttgttttgtgctcagacaaaaacatttgattcatttgcttttatggctctgcagttcagcctctgcatgggggaggcttttcttaggaaatctgcagctaggaagggtgcaggcgagaaagaacacctggattcaaccaccagcacctttttttttgttttgttgtttttttttttttttgagacagagtcttgctctgtcgcccaggctggagttcagtggcgtgatctcagctcactacaacctctgtctcccaggctcaagcgattctcctgcctcagcctcccgagtagctgggacgacaagcatgtgccactatgtctggctaatttttttgtatttttgatagagacagggtttcaccatgttggccaggatggtctcgaactcctaacctcatgtgatctacccacttcggcctcccaaagtgctgggattacaggcgtgagccactgcgctcagccaaccagcaccttttaactcttcacccagaactttgaagaattgacatgaaattaacaaactcaaattttaagtctttccaccaactcactgtatacctttaagcaagtcattcagatccctatggaagaagctgcactagattaaagataataaatatagtgtacatggggcaaattatgtctacatatttgttttatctgataagcaaaatcatttaatatatttttaattcaaatgactttagccagtttcatgtagacaccaccccttttttggtttaccctgatactctagtgagggacaggggatccttttgaagtcaggaagaagagaatcctggaaggcatgattctctaccttccagtgtttgccccaccaaattgttatgagaaccacacagtgatgttggggcttaagtcttaacttagctaattaatcctttaaaagccaaaatgggccaaagagcaggataaaaacaaagatttccccctacacatggcataactgtgaagaatttgttgtttttaaatatgagatataaaaatccatctttgacaatgtagtcatttttcacagatgctataaataaagcttataacgggagcaaaaggagcagtttagcgaaaatctgcagcaaagaaagttctaagcacatccaacatgtttacttgaggatttcttattgttctttttaagtttcttcatggatttatttgcaacaaagcaatttaagaacaagtcacctttcaaggaataatttcagcatcgttttctcatagccatcaggaaaacataaaccatagtaaaacctgttcacctcacttagcagtctctttctgatcaaatacgtttggttgcgtacacatcctagtaatgccagggttactttctactagattgccacagatgaagacagcggaatcctcctgtataagggtgacaaagaccatatcgcggtagaactctatcgggggcgtgttcgtgccagctatgacaccggctctcatccagcttctgccatttacaggtgaagatctctcagttacgggtaaaggtgaaaaaaattgcttaatgaagaactgcttctcctctatcattttattatggagaggagagagactaagttggccccagcaggttttaggatgagggtattagtgaaaaacctggcaggaacagagggcatactcaaactggagagtgtgaggagggatttgtaaggggactgctatgcacaaagaggtgactgggatagtatagtaacctggggctggaaacaagggatgcagggaggtgttgctacccatatgcctgaaggatcaagaggagggagcagttatggaaactcatgctctgtaaaggctttgtagagaggcttgcctgccagaagcctcgacctttaatagacgtttgcagtaagttctcaaggaaacaaccagcttttgaaatacacaacctcactctctttcctcccaacaatctcctgtctgtgttccccacgggccacactgcatgccgggaaagaaggaatctatagactctagtaatgtagcttgcacatgagcttcctggggctcagagctgggtaaagaaagttggaagggagctccagagaatcaaatgaagatatccagcactgtgagtaacttcaggttgccattcatacctcagaggtttattgagcacttactatgtgccagacctgtcctgagctttaaggaacaaagcccctgctcatttggaacttacgcagaataagcaaatggattcatacaatgttgtcttagggaatcttgaccatccattttggaagttttctaatgattaatgatattaataatatactggagacgtgaaatgggtggtattcgtggggtataatttttagtccttattgcataagactaactatcagagcccctctgttggaacccaacaccaattccctaacatcctgcagacaatttagctatttaattttttcacatgtagaaattcaccctttagagaagggatcacaaactcctaagtagtcaatttttccagataagtaacataaatgattaaagaggtcaagtgcaagaaaataatatgctctcacccttttattctgtaaaagatctaaatttttacataagtattattttattataaatagccttgatgttggcaatataaaagaagtggttgtgactggaatgaaccaatagtaaatatttgtcaaaacaggatttcatctactcagttcttcgtggagaaaatatggacttaggtttttccaaactcttgacttttcaggaaaaaggcagaaatctggggtttttttaatataaattttctctcctttagatatcagtgtgcatttttaatactatatataatgaacaaaacatatctgtaggtcagacacacttggcaacaaaagaataggcattgattatgacataaagtggagacactggcctgcatgttattgatattctcatatgtatcaatgtgctttaaaagtctgcacatcttatttgatgcttcataatagttctgggaaagtacaagccacttgtagccatgaatggaatttgatatccaccacttgtgaatatttggagcatggaaacaaacacataattattggtttccaagttgaatacaatacttattttatctccaaatggtgatgaattagtgccaagattttagatattacgaggccttaaattttcttgcctcaatgtgtttcagcccataaaaagatttcagaaatttgtggttcattttttttaatttttttttaatttattttatgtaatggtgcagcacagaactctcagaagccatagtaaaggtttttggtttggcttattaaagctagcattcatatcacatatggcaaaatatttctaaatactttgtagaaacccaagtgattatatccaaacaaggacctaccataacgagtttgtttgagtttatgttcattgccatttcacctaacaaaggatggagtgtatcttgtgacatttataaagggactattatgttgcattttttttttttttttttttttttttggagacagagtctcactcagtcacccaggctggagtgcagtggtgcgatcttggctcactgcaagctccgcctcctgggttcatgccattctcctgcctcggcctcccaagtagctgggactacgggcacccaccactatgcctggctaatcttttttgtatttttagtaaagacgtggtttcaccgtgttagccaggatggactcgatctccaacctcgtgatccgtccatttcatattctttattagaagctgcaagcccatgtttctggtggtggatcatctaatagagatacaaaatgtgaggcctagagcaaatacagctttaatttaattattgccttttggcttatgaccaaaaaaattttcttgattttccaatccagaaaagctatgaccttattttttaataaaagaggcaacaattaccaagaattcagatatgtagatatgtataatacattttattaacatattaaatatagaatattatttttatattgagaaaataatataagaaaaaaggaagaaagaaaggaagcaatgaagaaaaaagaaggaagacaggaaggaaatgtaaggaagaacaagttcaaaggagataaatataagcacttacattttcatgtatttgcacaaagaaaaactagacacaaagaaatagaaacaagacttctgcatgaataccattttatatccatttgatttttgagccatttcaatgtcattaccactcaaaaataaaattgaaataatagaaaaagctgctgttctagagatagtctggcttgattcaagtccagctctgttatcaactaactgtgtgtcttggacagattgcttcagctccctgggcctcatctggcaaatggggataacaaataatagtgtcctttttgtgagattacggtaagaattgtacgacatgataaatgtaaaatatttgcaacaatgctaggtaaaccataaacaatgatggctactggtatcacaaattcaggatgtccaaaactgaatttatttcatttgcttcacccaaacctgtgttcccattgcattccttctttcattgaaaggcatgacaggtgcaatggatctactcttaatcctctcctttcctttaccttcaatttgcagttttacataactcttagctctgatacggctaattttttggccttttttcaaatgccagaaaatgccaagcaaggcaacctctgtcctgggccaggcctttactacagtgtaaaatctttgatgaaagatagtacttctccatccctgtagtaaaatctatcaataacagtgttgcaatcagctgtcccattagttgctaataaatattttgtctgggtgaagtacattttcaaattttgatttgtttccacttaagttcagttttattgccataattctatgttatataaaatttactttggtaaaacattgttttccaaattttgcattatttaatatattattgggccttgcacttggaaataattttatacctcaggtgcatcatttcaattgcctgcttaattctccacattgaagaaaattgattttattttagcaaaatgaaacctaataaaatgaggggaaagtaataatacacttattaattctatagggtatttttggttaaaatttattttatatgtcaactattgtttcacataaatcagtatgaagacaattattttatgaaattatctctagactggtaatttgctgcccttcaaaaagactttcttttaatctagataaggggaaacattttttacaaaagttaatgaaaaatatgtgcttctttctttaaattcaaattaatgtcattttccaaaccagacagcctctttgaaaacacagccaactatgttaaaagttaaaagacagtagttaacatagcttgaagtgtgtttaagaaaactcaagatgtagtaattattcttttagcgtagaaataaagtagtatgcatattttctcatcttatctgttacatctggatagaagatcatggcttcttgtagacatgcctgctgttaacagcaccaagcatacaggcagtagtgtagaatggttgtttccaaaagtctgcattggaatcacctgaaaaacatgttaaaatacaggcgttgggcaccacccctagtttctgattctgaagctcttagctagacccgaaaatttgcatttttaacaagtttccaggagatcttgtactccagggactacactttgagaaccccttgcgtaaaaggaatatgtactttgagagctgattgtctgcatgtcttctcatatccaagttctacaacatcatgcttgatgctcacattgaaatcagccatattgggaatattcgcaccacaaaaatcagcaaagcctacaaatccaggtttttgttcttgttttttttttaacagtaccagttgttaaacatttgccagcaacctactgcctaaaggactctaaccagcaacatagatgaaatgagctgcctaataagggaatggatttggaatatggcgcacgggcctaatatttacagcacttagagaatagcataaagagggacttagtaattgtattagcctgttttcacactgctgataaaggcatacctgagactgggtaatttataaagaaaaagaggtttaattgactcacagttccacatggctagggaggcctcacaatcatagcagaaggcgaaaggaatgtcttacatggtggcagacaagagagaattgagaactaagcgaaaggggaaaactccagtaaaaccatcacatctcgtgagactcattcgctaccatgataacagtatggggaaaaccgcccccataattcgattatctcccactgggtccctcccataacacggggaattatgggaactacaattcaagatgagccaaaccatatcagtaatagtgccatgaatgaatggaaaaatgaatggcagcctaaatttaagcagtaggtcctcagacagggctggagtattaaatttttattctcaagtaggctaataatctgctctttcaaagtgagtttcttttcatctagaaaaacataaactttttttaacaaaagttattattgaaaaatatatgcttctttttttagattcaaattaatgtcattttccaaaccaggcagtttctttggaaacacagctagctactgtttaaaaataagaaaatcagatggaccaccttactagtgtacagtttttcatatttaggcaacctgctcaaattcaggggactttctgtcacctactgttacatttggttggctacatacactctgggttgtgcaatttacaggcttacatttcaacaaaaatacaaaagaaactcaacaaagattatctttgtatctgagaagttcagtctcattggggagacagagagtagacagaatctatatggtattcttgttttcaagatgtttattcagccattcttgatatgccatatggaaagttccccctgtttactagcttataaccttgggcagattgcttcatttctttgtgctttattttccttatctcagtaaatgcaattagctctgcttttcatgtttggttatgagaattgaatgaatgtaaagcacctaacatcgtgcttggcacagagtcggctcacgatattgagtaatgctgatgattcatggatactcttcctgctcaaatatctggatactgaagaataaatacccaagtgggaattttatagcctgacatctcactgtacagtatgttcaagtttagagaagcctttctagtttagtgaattttattcatgttaatctgttttaaaagtactgattaaaatattacttgaacaactattttctaaagctttcttttgaaaaattcttacaggtatatttagatatcttttctttttggagacagagtcttgctctgtcgcccaggctggagtgcagtggcgcgatctcggctcactgcaagctctgccacccgggttcatgccatcctcctgcctcagcctcctgagtagctgggactacaggcgctcacccctacgcctagctttttttgtatttttaatagagatggggtttcaccatgttagccaggatggtctccatttcctgaccttgtgatccgtccacttcagcctcccaaagtgctgggattacaggcgtgagccactgcgcccagcctacatagatatctttaatctcatttggcttcccattccttttgactaaagagataggcaagaatacttttagtatcactcccacttcacaggtgaagtatcatcaggccagaaacaccaaaatgagatgaccagttgagtttgggttccagttcctattccaaagcgtggaatatgtcaccagatactttaattttttttttttttttagatggagtattgctctgtcgcccaggctagagggcagtggcacaatctcgcctcactgcaacctccacctcccgggttcaagcgattctcctgcctcagcctccagagtagctgggattacaggcatgcactaccatgcccagctaatttttgtttttttactagagacggggtttcgccatcttggccaggctagactcgaactcctgacatcgagatccacccaccttggcctcccaaagtgctggaattacaggcgtgagccaccgcacccagcccagatactttaaaattttaaggcaagaagttgaagctcacataaggaaaaacagtcttttattaaactacagaaatacattatgtttatcattgttagtgtgttgtgtgtatgcaaaatagagaaagaaaatcagagacattttaaagcccctcttttaagccccaagtttctgaattatttttctgtagcagaccacaaacagttggggaactgctttgttttcatgtatccacttccagtatataaactcaagaaaacaaatctcaggaaataggtgagcgtagtaaaactaaaccttatagtaacagtaataaatgcaattcaaattcccagtggaaaggcccaaagttaagtggttcgcttgtagtttttgtgaatcataaaatatattgttccctagggagtggtgaaagagagtttatcaatacttatcagaacccaaaaggatgccatgcattacatgtgggtatgtaggagacagctgctatagactgaaaagtggattatggctttctagctcaggcagtcttactatgtagcaactgatgtgtcgatcactgcttttattttattttatattttattttattttattttattttattttattttattttattttattttttgagacagagtttcactttgttgcccaggctggactgcagtggcacggtctcggctcactgcaacctctgcctcccgggttcaagcaatcctcatgcctcagcctcccacatagctaggattacaggcacccgccaccacgcccagatgattttgtttgtattttagtagagacagggtttcaccatattgcccaggctggtctcaaactcctgagctcaagcaatccgcccatcttggcctcccaaagtgctaggattacaggcgtgagccaccacgcctggcccactgctttaattttaaacgaatgtgtagacaaaggattcctggacatcctccagtttatctcatgctagaaaagacagcaagaaataccaagttagaatgttattaactctgaaaaattctctttaggtcccatgtgtaaaatactatcttaaaaaccaaattggccagtcatggtggtttacatctgtaatctcagcactttgggaggccaagccaggaagatcacttgagaccagcctgggaaacatggcaataccctatctctacagaaaaatttaagaagtagctgggcatggtggcatgcagctgtggtcctagctacttaggaagctgaggcagcaggatcacttgagtccaggaggctgaggctgcagtgagccgtaattatgtcaccgtactccagcctggctgacagagcgagactctgtctcaaaaaaaaaaaaggaatctaaaatcatgaactttactgtacttacctgttaagaggtcaagatgaggcttcatttaattccagggagatataaatggaattaatctcaatgataagtcttgtggaagttctggtgtgatcagattagacatttaaagcttttagggagagaaaagtatagtcagtctatctcactcataatctcactcataattgggaaaataaaatccaaactcagtttttaaatccatataatttatatgcattcttcaaactcttattgtaagatcattacttttattaacaattcagtgttttttagtaaatgaatcaagttttgctatcatacaaggtaatttactatagaactttattcccaggctatttgggacagaaatcatgtattaaaagcttgttagtggtgaaaacacacgccatttgtctaggaataggtattcctcaggtttttgattgtaaaagtagtgcataataattaagagcacatacacttgagctggacaacctggcttcagaactgtttagccactaactagatgtgtcaccttggatgtcctcagtgctcacctcttgttgtgaagcttacatgaggtaatacttgtaaagttcttagtacctggcccttagtatgtgatatataatcctttgctcttcctatttgcacttctcttaaaaggaagaaaaatcacctaaggtcacactaaccaaagatgacatgtctaatgagagctaggacaagctgagcaagatttatctctcagcattatccttgacgatactgccactgaaacttccaactatgttttatgaaatgaattttcagaggtcttgtcttaaacatgcttgaagtgtaatgattatctatagatatcatctaggagtattgctaaaaacaattgatatatgttattcctaatacatctctcttgtatttacttaccacatattttcagaaataaataatacatggatgatattttaaattagcttacaattagcaagagtttaagacatgtactccaaaaaagagtaaaaaggaacagaggagggaataaaggagcaataagcaaagtgagttgatgatgaaactacctacctccaagttcccatctgacacactgcattagggtgtttaaaactgtaaagtgtgttaacttaaaccacacaattgtactgcatcaaacaccatcattgatgatgacatgactgaattgactaagaccaatatgtgaccaagaatccattccttggtaatatatgggtcttttctttgcaattttaaagagaaatggggggcctcattattaagatttattaaggttgatgttgataggacatccatataaaactacttggaaagctgtgtataacctcaaagtaaaaaggaattcacttctactctctccatgtctgtctttattttaatgttttactttaaaacttttagtaacttgaacaagatgtgcccccaaagaagttgttatatttctgccagcctttaacattatcttacaatcaatatttaaaataaagctaaattctttactaaaaaagattcagaaatggtattgaattatttgtatcatgatgatcgtggttgggtgggggaccgatatgatagtgatggtgatactaatatctaacattaatttttgctatgctgggtatctttcagtcattttacatagtcctcaaattaaccatggaaggcagaaatatttattagcatttactgaagagaaaactgaaatatattagtaataaagtaacttatctaaaacaaacacttaataaatgcaggaccacgattcgaatccaggattatctgactacagagtctatatgcttaaccattagccaatgttactacttggcataccctcttagaagagagtcatatttaaaaccactaatggtgtgcaactatacttataaaataattttctggtctattttttcctctgccaattgtattgatgttaagtgttaggataattaaatgtgtaaaaggcaaaaatattgattgacatatctaacatttagttttataaagttgtttcctgagacaggctatcaaagattcctgtacacgtggactcttctaaccacctaaacagaaagaatgtcaagtgttttcacaattctgcagagtgatttctcttgttctcaaatcaaaaaaacgttttattacctgtcagcatacaacggaagatgattagactccagtggtgagaaccatgcagaaatatgttaatgcatttttctatcattccctagactttgccattttacaaatttaaatatcagtgcctagaaatttaagcagtcatcttgtatacagagtattaagtattcacatttaggaataatctatcacatgctcccatgtttccatgttggagcctttttcagtcttcccagtatcccagcatgttagatctttaataatcaccattaactttttgatctcaacttccattatgccatgtttttcctgtatagggaaaggtaagtacgttcttaacactgcaccgtgtattggtcctatttcttctttggtcctgtttcattggtctggtttgcttttttgcctgctgtaacaccagagttagatatgcaactacactttaaaaccatgtaaaacatatttactaattgcactcaacttcatcttattttttaatcctcattttccatttacctttcttcatctttttgtctttattcacttcatcaatttctataagcccttccaaggtttttagaaggtgacagtaataattgttagacctggcccttgaaaattatagaaaagaatccagacagccactgtcattgcaatatttcctagatatcactatgttaagcattttatttaatctgttattcccatgtctccactgagcatagataacttcttcacagcaatatcagttgatgaaaatgcacagaaagtaagaggatattattaacaaatttcaaaaagtactgagatcccaccaagttgtttctccttgcatttgtgtgtgtgtttgattctggtaagtcctaatctacagttttttttaagagcagaagccagcagttgcctaaggtcgatgtgttagggtgtttttggcacaggcctagtttccttgtcttttcgtacaatttgaagtaatagtatcttggtaaatggaccttttatggaagttaaaagcaaatgtataaattatcctttgaaattgttacatattgagagaatgtggctggatgatgatgaaatgtagttatttctacttcttgtcataaaagaacaaacttattttgtattcagttcctgagaaactgaaatcaatcacatctccttgaaaatgcctatttttgaaaaaaaattcaactactcgtctttatcttcattagtgttagattgccatctcttttcccaaggagcacttatcaaagtttgtaatttaactaccttgctttaatgaaaagaaaatggaagaatcagccatttttttttccgttgtagtgtggagacaatcaatgatggaaacttccacattgtggaactacttgccttggatcagagtctctctttgtccgtggatggtgggaaccccaaaatcatcactaacttgtcaaagcagtccactctgaattttgactctccactctatgtaggaggtaagctgtcttccaaattcaggtggtcctgaaaccctgtgattctcattatggacgaattctgaagtttgttaatgcctaatatatcaggatttgtcattgaccaatagtgatcaatcattgaaagatggatggcaaagacagaacagaaagatctctaggtgggtgttaagggatcattttattatcccatctctctttctaacaaatgtgtcatctgggtagagaaagacattaattaatatttcttttgtgtcaatcacatatgctaggtgatttatacattatataatttaatcttatatttgatctggtctatggaaaaggaaagttggttagagattaaatcatacaatcaagaaaatgataaaacaagcttaatgcaaactggaaagtagatgaccccaccccagctcccttaaggaggcaaaccctatcagctcagtcaaatgttaccatgctggagcttctgcactaccagttgctaattcatctggatgataggataagtatcactgtaatccaatgactgactgaatgaatgaatgaatgaacaaattaaatgtacaaattgtattagaataacaataaatagttctgttccactaagaccttaaggtgaatgaacaagagagagggttggaaaggtaggttaggacttgaaatcatagagtgaagaccctgggctttatttttaagtgaaaagaaggcagatgagtgaataaatgagggacagagatataagcaaagttctgtaggagcccatcggagaggacccgcaaaggagagaggtcccaatcttgcctctatttggaggaacaaatataaactggaggcatagagtttcaaaattctggtaaaggagccagaaagcagttaatgctgaattgagaagcattggattaaattacattgaatttatttgaattgactgattaacttattttacagataaataagtaaaagctttgaacaggttagtgtacaatttcatcaccatgacagatattttcatgagtttcacatcattttctgaaaaataataacctatgctacaccattatctcaaccactcaaagccttcttttcagtgcctctaagcctaggacatttctgttttaataatttcagtagtagacagtcttaacattttgacagagttggattgttttagaaacagttggaagtctttggttcaattctgtaaatatttattgagtacttaccacatactaggaactaagtaaatggatacataaaggatataaagttgaagaagaaatgtccattctactccctaaaaagtcaagaatgcagaggcatcttcaagtaactataatgcattataaataaagtattgcatagtgagtctactcagcaagttgacttatctgattgcttcatgggaatcacagcagagagtctcattaaaaaccaaatcttccattcttgccagcactccagtttacagggttgcttttggatgggtgaagccaagtcacaagcatacctgtgatttgagagaaaataaattatatttattgagcacatgctatgtgcccaacacagtgctccttttatagccttaatgtgcagagatcttaggaaataggtatgattttctctgttttgtagtccctgaagagcaatctcaaggattttatataacttgtccaagtacacaaagctattatgtagtagacacctcatttaagtccagatctggctgactccaaagccacctgcattgccattcacttcttcacataaagcagaaagggaacaaatctaagtgctgtggccttttgttgtttatttatggacttttcgttcacttgattttattatgttttcattagaatccacttcattaaatctttcgaagcccctttagaatatagtataaaaccaattttaaaaatacagggggctgggcatggtggctcacacccataatctcagcactttgggaggctgaggagggaggatcatgtgagcccaggaggttgaggctgcagtgaaacataattgcaccattgcagtacagcctgggaaacagagccagacactatctcaagaaaaaaaaaaaaaaaaagaatacaggatgagactgtttaagtcagaacattcccccgccccccgccaaaaaaaaaaaagaggaaaaaaagttttaaatttcaaaatgaaaagtatttatccttctgaaggtagagggcctggaaaaattcaaacaacacctctgtccacccaggcctcaaggaaaccactttcatcccagtcccactgccagagatcaccatgggcccactttctccccgcttagagtgcagtctcaagggtgactcagattttcaaaccacaaggaacctgtaagaccacagccttgaatgctgtatggcaaaggcatgagaagcagagggagaaaaggagagcaaggtaactaagttctctttaaaaatagtgactacagctgggcgcggtggctcacgtccgtaatcccagcactttgggaggccaaggcgggtggatcacgaggtcaggagattgagaccatcctggttaacacggtgaaaccccgtctctactaaaaactacaaaaaattagccgggcatggtggcgggcacctttggtcccagctacttgggagactgaggcaggagaatggcatgaacccagtaggtggagcttgcagtgagccgagatcgcaccactgcactccagcctgggcgacaatgggagactccatctccaaaaaaaaaaaaaaaaaattatgtctacagtgagataccatctcacaccagtgagaatggctattattaaaaagtcaaaaaataacagctgctggcaaggttgtggagaaaaaggaacacttatatactgttggcagaaatgtaaattaattcagccattgtggaaaacagtgtggcgattcctaaagacctaaaaatagagctaccattcaacccagcaatcccatgactgagcatatagtcaaaggaatctcaatcattctatcataaagacacaggcatgcatatgttcattgtagcaccattcataatggcaaagacatggaatcaacctaaatgcccatcaattctagactggataaagaaaatgtggtacatataaaccatgaaataccatgcagccacaaaaaaagaattgagctgatgcccttggcaggaacatggatggagctggaggccattatccttagcaaactaacacaggaacagaaaaacacatactgcatgtttctcacctataagtgggagccaaatgatgagaacacatggacacagagaggggaacaacacacactggggcctagcagagggcggagggtgggaggagggagaggaccaggaaaaatcactaatggacattaagcttaattcctgggtgctgaaatagtccgtacaacaaacccctcgtgacatgagtttacccggtttgttatacggtaacacataatacactgttggtggggagtgtaaccctcatatacccctgaacttaagataaaagttaaaaaacaaaacaaaaaacaaaaaaaaccagggatgctgcccaaggaggactgcctgaaggtgttgcctcagcatctggggagaggcagccccttggtgagtatatggagaggcagcttaacctacccttgggttatcaactacccatgatatgtgctttacttgacacaattttttttgtttttctgagatggagtttcgctcttgttgcccaggctggagcgcaatggcacgattttggctcactgcaacctccacctcccgagttcaagtgattctcctgcctcagcctcccaagtagctgggattacaggcgcctgctaccacgcccagctaattttttatacttttagtagagacggggtttcatcatgtttggcaggctggtctcaaactcctgacctcatgtgatccacccacctcggcctcccaaagtgctgggattacatgcatgagccactgcgctcggccgacacaaaataatttagttttcatgtttttctgtctgtagtccaactgaacccttattacctaatggggaagaaaatcaaaaaataagccccatgcatggaaatccatgtatatgcaacaaatgtcctccttgtcctgccacgggacagaggacctaggcttgatacttggtctctttattgccattttgaggcctgtagaaataaggctaaaagctgtttgctaagttatctgttggttgattgattgattggctgattgattgaatgatttccaactaggccaatagcatagaggaaaggcttaaaaaaaatcatggatctggccaggcgtggtggctcatacctgtaatcccagcactttgggaggctgaggcgggtggatcacctgaggtcgggagttggagaccagcctgaccaatatggagaaacctggtctctactaaaattacaaaataagccaggcgtggtggtgcatgcctgtaatcccagcttctcgggaggctgaagcaggagaatcgcttgaacccaggaggcgggggttgcagtgagccaaggctgcgttcatggcactccagcctgggcgacaagagtgaaactccgtctcaaaaaaaaaaaaaaaaaattcatgtatctacttctgtttgtcaatgaagacctagcacgtgaaaagattgactcagaataattcctgattttatgatagcctattgaaactcaaatatacgtatgatgtctaaacattttcatttacaaattactctagtcaaagctgggctttttctaattgttagctttggaacaaaaaggaacagatttactaattgtttctctgtgctgtggaactttgccaatctgtatttattcttgacatgtgcacatatgtgtgttgtgcctatatcaaaatgagctattaaaaatagttttggaagaagttcatttttaaccactgaaaaaaggaccataaatatgtggtcattaaagtccttatgatggatggatatggttaaattagaaaaacttaccccagggcaaggaattttctgtcaccagtcctttcctggaaatggtaagtttcatccttttgaccctgctctagaaagcaacccacagcgagatggacatagactaaaggcctgtactcacagaacttcacagccaagagacttcattcaatacctgtcagagtgtaaccatggactacccaaatcacctgagctgcatgtagatatttagatttctgcacctctcctgttcctacaggatcagaacctcagaaggaggggagagaggagcctgtaaagctgcctttgagcatgcactgctgttggttcttatgtatgacaaacttaggacaacttctctggtccatatgctcatggtgtatagatgacaatactaagccccagagagaagaaataactgctccaagtgcacgcagaaccagaaatccttaccgtataacctagtggtttcgtacacctagctgtctgactgatgcctgctttgaatgccaatggatgagtcatttcctatgaatgggaaaggagaaggtggcataagttcagacccagagtgtgctacagttcttggtctttagaaccaacagaccccctgaagagtgagaaactgggtcttcctcagcctagaacttccagccagtagtccagagtttaggcacagctaaagcataattacggggttgtggggatgtggtggtatagccagcactctgaaagcttccagcaccctccccccttccctggatgggtgccttctgcaggatgccttccacggactaagggtctggcttaggccatggaaagattcttccgttttgccaaaatgagtgttaccagataactgtcactagtggaatgtatatatacaaagattgcaaatactctgtttttgaagggatttcatttttatttctgatttcttggactatgaagtcttcactcttaattagcaagaaagaaaaaatgatgtgaatgaggtgctgtcctgaaaagaatcaggagtgagtttttaggcattgacatcattgaccaagcttagggacgttgccaggagtgagctgaattagttgctaacttcgaatgtgggagggctggggtgaatggtcactgtgaaccccagctgtcagcccctgaaacctggtggacctaaccctgactccagagatagaggagttcttctcatcagcctaactctaacctgaactcactgggtcaccttgagcatgtcaccagggctttctgagccctagccccttgtctttaagataaggggtagaattagagcaccataaactgagctttatggagctccagacttccaggagtgtgtgcctggaggtggagggtggaggacaaacagagagggaacattcccttcccccagtcttgcctttaaggacagtagctctgcctctaggttttatatatttgtgtacatgtaaagttttctttgaagcaaattttaaagattaaccaccaatcaactaggtattttattctagttgtggattagaatttcctggagcatcttccaatacagaacaaaacaaaaacacacatctctacatctcttctccacttcacttccctaccaccctgcccaaatatcctgccataataggttggcagtgaggtcccaagcatcagtatttctgagtagcaaatggctcagaaatccccagagagcctgacctctgacctggtgttcctccccaggcatgccagggaagagtaacgtggcatctctgcgccaggcccctgggcagaacggaaccagcttccacggctgcatccggaacctttacatcaacagtgagctgcaggacttccagaaggtgccgatgcaaacaggcattttgcctggctgtgagccatgccacaagaaggtgtgtgcccatggcacatgccagcccagcagccaggcaggcttcacctgcgagtgccaggaaggatggatggggcccctctgtgaccaacggaccaatgacccttgccttggaaataagtaagttcctgctgcttgggagttgagcacacacctgaaagcctcaaagccaaaccaaaggaaggaaggaaagaagaaggggaggggacgggaagggaggggaggggaggggaggttcgttaggcattagcactctgtccctcatattttctcaatcatcctccattcttatatcacctccgttcattcttacctcctcttctgaatgcattcccactcctgtgttcctcctccctgtagatgcgtacatggcacctgcttgcccatcaatgcgttctcctacagctgtaagtgcttggagggccatggaggtgtcctctgtgatgaagaggaggatctgtttaacccatgccaggcgatcaagtgcaagcatgggaagtgcaggctttcaggtctggggcagccctactgtgaatgcagcagtggatacacgggggacagctgtgatcgaggtaagccagccccactgggcacctcattctcttggcaaagcaagaggggtcccatgtctttgaaaagagagggagaaaaagtgaaaaaaaaaaaaaaaacaggagcaacagagacagagagaggggagtgacaggagagaatactaggtcttctcactacttgcagttgctgctattgatttattttcaagtattttgaaggcaccagctgtgaaatgaccttaaacctccaccgcaagattgtatacagccttcagatgcttctcacaagttgatttgttgtaaaagaaatgctcctttttacctgatggagaagcacatttactttactcctgtcttacctttaccggctgttctcatccgtatatattattaattcatcttctggcacagagaagatggtcctcttaattctgctctagttttagtacaaaatgacctttggccttagaatcgactgatttatcacagcaaatcatgtgggtgagaggaacggaaacaggctgacttcttagttcaccttcctccttctcctttgtctgcgtgatcagagctcgcctggcctccagctggcacggattttgttttgtgtgtccaagggacgagacaagaggaacgtgcccatggaagcttttagcagatgtctcttttttgaactacatacttcatactggggtaatttatgaagttaatggaatgttacttgtattaagtaacagattggataatattaaactccaggtctaataaataaaatggcatactctctgaaactgctccctgtggtaaacaaaaccagctgttagtagtgtaaaaacagaagatgtgtactttttttccttttttgcaatgaaagaaaatatttaggaatccaattttcttgtcactgcaatagcattgtatttatactctacataatagcattcactttgctgaaaatagagactaaaaagaagtatttttcaaagaataggaggccgtgccaccagctaataatatgtaaagcaagttacaaaggggaagcaaaggcttctgaattaagttgtggattcacagtcactctgcatgacttacagtgactgttcttaaaatgcttgtgctttttgttcttttctagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttg

SEQ ID NO: 91 - DNA, 1135933 bp, Homo sapiens
cctagcggcgatccgggccgctgccgctcgcgcttgggcaggacgcggggcgggcggggggaggggggagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagaggtgagtcccgggcagagcatcctccatccctgcctgcctccctccctccccacctccctcccatcctctccatcctcccccctccccgctccccaaccctccctccctcatccttcccaacatccctctctcctctcccctcctttctcccttccagcctttctttcatccctttcttcctctctcccagccccacttccttcccaccctttctttcttccccgtcttccttgcagccactcgccctagagcacagctctgcatccctttcctcttgtctccatctcttcttcccccctttcttacctcttccccggtgggagggtgggagcatcccttgcctgctacaactgtccggattcaggggttccagaaaattgggtgcatatactgagagacacactcttaaacagcgggtgccctgcagattcctaaatttttaggatgaagggtcaagttgggtagagtactgggaactggagggagaagaggatcgaagaagaatctgtggatttgtgctatattagggtgggggtggggagggttgtcacttggacatgctgccaacagcccccatacccctcttcagcagtttctttttttcttctgggaattacatatttccagtgtgtgtctcaccaatttaaaatccagccttccctgctttgattgtctccgtgagaaaccacaacgaaaaaggagaagagaggaaaggaacaagagagaaaaaggggaggggagaggaagggaggtggcagtggaagcttgtgttcttttcccctaggcctctttggtttgacattttcaaaccacccgcctcatatttggcttggaattgaacccgtgtgtccttggtcctgtcactacctacttcaaaggcagaaactctctaaactttaatgcctgtgcaccacagcattatttatggaatgttttgctcagcatacaaaataccaagatagaaaggtttgggaaaatagggagcagaagggtggaagagaggtacttttgttcatcatgggttaacttctcaagtaggataatggttagacagttttggagaaatgaggttatactccacaggcttgtaaatataccatttagatggcattagctgcattagagcctttaacagacacccttacccattttcacccacctcgtaggacccctgaagatgtttaaagagaaacatgctgtgtgattctgtttgtggcttacaccaatggaaaagttgaattagcttcggaaccattgttaataatttaaaattgctgttggttttacatcacttattttcacagaatgctataatttaccttgctctcttcagcttgcattctaaccccttacattatacatgttattggcaatttgacaattctttctgttagcattgctgctgtaaagtttatttttacatggcgggacagccatgcctcagaatgtttagcatatttatcatctcagaagggtccaacagtgtaagtataaatcaaaaatggatattttgaagcctatattttgttctatttatattctcctaaaacaacagaccaaaaaaccttaatatctttagaatagctgtgttttgtgtttaaggagtatgtgtgagggaccaaaattaatggtggattctttgaagttgccagtaagacactatgctgtggaacacattattgatttttttcttttcatttaaattattatatgacagtagtgcaatatgcagttttgcattttatgggagtgtaaagcaggagttgagatgaagagaattgccttcctaagtgattgagtgctgatttgatgaagagctgatagttaatcacctgagtcagtgctggggaagtgtgtaatattaggagtgatggactccttcaactccccatggtaggaatgcaattccattaatggcttggctgactcttcagccatgtaactaaagcttggttgaattaccagtgttaccaacatcctgatgcagattgcagtcaaccctgtgtgtattggaatgcttgcattacttaatagtgaacttgtagataggagtgttttccttgttggtgttcctttccctagaataccgtgaaacaagtgaaagactgtcatgttaattatacatgagcataataagttagttttgtccaaatttctttcaaaagacttttcccctgccagtatgtctgctgttctttgtggggcttcagagttgtgaatgtggggaggtggcagcccctctatgggctttgctctttctttgttgcagtttttctgcagagtggtgtgggtgtatgccccagtttttgatactgtgcttagtatagaaacacaggtacttttcacttgcctcctttgtaaacattagtccactgagtggaaacaaaacataccaagttattaaagaactagcaaacaaagtaacatttttttacagcaaaattttaagagagatgagtacaattaataaaatgtgcattttagaagagcaactagtgtctttgaaaagcagcttgcctccttgactataatccagtttgcagataaagactgacttcctctgaagaatttcatttctagaggcttctgtctttagttgactggacctttaaaaatacttgatacaataaagagccaatagaagatcttatggacccctgtaaaatgtattccggatatattctctgtgtctccctccctcagagctcttaacacctgcctaaccctaggctgagtggtgtgaggcattccaagaaagtagaaagaagtaaaagacactctctttgacctcagcttacagtctagttgaggagaacaggcatttgcatgaggtcctatttcacagtggcaagtaacaagatctttggagacagctttagatgtgagtacaggctctagttcttaggaggatcatgtccttgtgtacaatttaaatctgttttttcatctataaaatgaaaattgtaagggactctgattcatgggcttgctttaaaggttaaatgtgtttagctcagtacttggtacaaacaaaacatgtattaagtaaacattattataattaggagaaatcacttaaacacattccaagaccatatatgattatgtactagaaagacagaagcgcaagtaagtactagaggaattgggaagaagacgggtgtctgtgtagctgggaaaatattatatttggtagtagcactggagcttggacagagactcctgggaatgatttcatgcagggtgggctggaacaaaagcagagagggaggaaaaggcatggtgtgtttgaagaacattagagagactatttactggaagatttggcatacaggtgaatgtattgaaaggtagagtacatacagtcagagtaattatactatcactgggttaagacaacttctagtgtgggatccatttcattacatagaaggttcagctacccatggaggtagtttcagttctttatctcacctaaagccccatcctgagacatggaatccatgatcggtgtcatagtgaggacccagaatattcttaggtcttttcttttaacttcaaggcagagggaaaacttgacctttgctgaacaataaagatttaatattatggttactagaactctccctcatttttccttatcccatgaatattccaggactatatctcgttgtataataactaaaattattgtattttgacctatgtgaagccagtacttgttagggtaattgtatttccaggggcttatttacttttcctaattacaaaagccccttttcattggtgtccgagattattaataaattctaaatggatggtgctctttcagttttgtggctgtgagactaatgtgtgatgaggatagagagtctaggaaggaatttgcatggagcaggttaagtatactctctgtgtggagagacagatgctcactggctacatctgttggcatacctttgtttttagttgaggttcataaactattttgaaaaatttatccataaaatctttatccaacagcataagtgatatgaattgaattcttttattcaaaaatggatttccagaaaattttacccacaagtttgaagtatcagtatttatcatgctcatgtttaacccattttaatagacacaattccattgttttctcccaaatagtaaaatgtttctcatatatttctgttttgtagttcaaataatatacaaaattgtcctcctgaatattatcttaagatatattagtcataaacacaaatatatttctaaaaactaatgtaaatatacttctaaaaactaacagaccatagactgtagtagttttattttttatgttgagatctttcttaattgatgttttaaaaattcagcaaatctaaatcatacattttcagatgtattgctgctagtcagctttatattatactaccagagatttttgacatttttattttccttataagtgaatttttacctcagagctgaattctaactcagccataaatttgcattatatacctctttgaaattattactcataacacattttacaaaacatagtgatagtctaacttcagacaccttaattttctagggctttactattgaacactattttatttttccttttattaataggccttatctgcgtacacaactattagactattacatttcaggtattaggaaaacttgcattaacaggagtgaaaaagcaggtatgttccccatacgtgagggtggtgaccaaacagggaggtggagtaaggatgagacagaatgaattaattgtgttttctcttttgagctgaaggatgtataactatctgttcaattaggggttttctaaatttttgctgcgatgtctactataatctatgttttagttgctttaaagtaagtttatatgtaaatttcaatgaataatttttaaaactagagcatggataaaaaagtaatataaatcatatgttgatttttcagtatgttgctacttgtagacatcgggctattttgtttgctaggcagttttgggggaagccaggtaatacatttatgggatgtattgagatggagatacattaaataagatcctaacttgctacagtgtttctacattaaatgagtggacatgccagagggctagagataaaaaagtccttgagttgtatatggtctcaagggccacagagccataatagaaaattaatagaaagcttctgagatgttcatattctgcaagttgagtttatgttgttcattatgtatctgcagtaggtccaatatcttttttatggccccttgatgttttggaactaaaaccatggactcttgatggagctatgtcagttgttcttccacatcccacccagaaaccacaaggactccagaaatcaccagaggatctgatgttcccatgttttatttgtaagcatttggtgaaaattcagtcttccaagtttatcttaaattcatagggcctgaagcagttgttaaatatcatcaatctatctttcagtgaggaagtagcaatgtcccttaactactttataaagagctaattgtactcaattgtttccgggaaagggtatcctacagtcttttagagtttaccacttcattctgtttcttcaggcgttgataattgccagagtaatttcacaaaatatgttttttttttctaatatgtggaagtggcataaagaagtgtatacaagactcaaatttcctggggaagcccaggcgcagtgtctcatgcctgtaatcccagcactttgggaggctgaggcaggcacatcacctgaggccaggagtttgagaccagcctggctaacatgatgaaaccctgtctctactaaaaatacaaaaattagccaggcatggtgacgggcgactgtaatcccagttacttgagaggctgaggcaggagaatcgcttgaacccaggaggcggaggctgcagtgagccgagatggtgccactgcacttcagcttgggcgacagaacaagactccgtctcaaaaaaaaaaaaaaaaaaagagtcttggggaaaaataaatctgtgtctaaattcatctctctactgcacttatgcctttcatgtattttttttattatattacctagcatgaattcattcaacaggtattttttgaaaatacctgctctgtgctcaatgctctcattgagctagagattataattttataagcacactgaaccaaggcaactggattcccctccaggttttcaaccagctaattaatttgttatgtgattaaataagcctcaaactctccaacacttatttattttatctgccttttgagtgacttagacttatatctagctataaaattctataattctacatgtgtttttttcttaaaatttcaaggcaaatgatttgttttcattgtgttccatttgttttttcttttgaaacataaacttctgctgcataaggaaaaaaaaacttcaccttcagtggcatatgctttccctttcccaataaaattgcaaatttagcttcacagtctctgggcaaactgtgagggactaagtaacctgtcttttcttatctctccatccttccctctctttcattttgaaacttcttcctacattgaaggtacaagtcagttgctaccactatttagggactctcccagtgtgtggttggcttgtttcggccatgccaatgtttgtgaaagactatatggcatttatgcatttagaatgaagtaatgtttatttaagaaattatatatgctttaaggttaatatttctgcctcaggcatagcaaagccttgcttatccccctaaattctatttcagaggacctggtggtcaccagtcttcctaccaatccagctccaaattcccattaaaattattttagtaaaattttgggcatatgttttatacaataaagtgtacccattttaagtgaatactttgttgtggattgacaaacacacctgtgtaaccagcagtgcgatcaagatacagaatatatctgttaccctaaaatcttctcttccgactgatctgctctctgtcactatagattcttttttcctattctagaaattgatataggttgaatcacagaatatgtgctcatttttatattcctttttgcattgagcataatgtttgtgggatcaatctatgattttgagtacataaacttctagaagaaaatataggagataatctgtgatgttggattaggcaaagatcccttaggacccaaaaagcactaatcataaaatttaaaagaaaatatgcattagactttatcaaagttaaagaaagaagttttgctcttcaaaagacaaaaggtttgttagaactacatgtctctctctgtatgtttgacaaaggactttatctagactatgtatagaactcttgcaactcagtaagaagacaggcaatccatctaaaaaatgaacaaaatatgtgctgagatatttcacacaagaaaatatacaaatatctaatgagcacatgataactctataattcaccgaaataattaaatttaaaaccacagtgtgataccactatccaaacactaaaatgactaagttgtaaagactggcaataccaagttttggagaggatgtgaagcaactgtgatactcatacattgctggtgggaatgtaatactttgggaaacagtttggcagtttctcttaatgttaaaaatactcttaccatacgatccagaaactccactcccaggtgaaatgaaaacatatgtacaaggacttttgcatgaaaattaataacagcatactcataatagcttcaaactaaaaacaaccaaaatacctgtcaaattcctatttgaaagttacccctttgagatagaaaacaaagctgctgatatatatatatatatatatatatatatatatatatatatatatatatatatatatatataaattttaaggtgcgctatttaatatatgttacctggcagcagaggaaggggaatacattggaaaagatttctaaaatgacaagaaatgcagaggatgggagacatgggcttaatttctgctttctacatttctcttgtctgtgctcagtctgcatgttgactgcttcctcagccggtgctatgatcacttctttagttcctagcacaccgtcatgcagcagcagcgtctcttcctgcagaatgaggaggtttttgccaaaagccctcctgcagacttctctcttatgtcactggccagcactgaatcacatggacattcccagtctagtcaatggcaaggggaatgggaataccatgaatgataggcgcttagactaaatcaggatttactggctgggactatgtatgggattagccttcactgggtggaggaggttaggggactgatgaacagagtagcaattcttttaatgaggaagaggtaaatgattgttgggtaagtaagcagcagtgtttgttacaatttgatatagaggcctgccttgttctcaggttttggcaagaggttgaagcaaaaagctgagattgtggtcacaactttttattgtgggagagtgtatgcagaaacaggtgacagagggcaacgtggcacaagaaggagaaaatttagattctagcccacagcatgaactggaggggcagggaatctggacccaagggaacaatttaaagtgggcaagcatacaaatagtgacaagcaaagccaagcacattggggcccatggagttgggacaggaagcaaaagtcagtgctggcagtagtctggaatccaggcaggcaaattcgattgcagtttgcccatctgtgaaatcaggacctcaggcaagaagattttcatgttttgcttgttaaggcagaagccaaaacagtaattattttctactttttttcctaaggtgttctcaaccactctagattctgtcttaaggataggagccgcaccttccatttttctagtattctcctgtgtcattgctgggcccacagtaattccttcataaatgcttgttgattcaactaagtctctgaactcgctccatcttcaaacagatcctcagatttctggtcatatgtaacagccatttacaaatgctttcctacaagttatcgaaaccactgttttgaggggcacggtcctggagccatacgtgagtaagacacagtgccttgtctcataagttgacaatctagtaggggctataagatgaatacctgaacagtttaataccagacagaatgatcgagtgtgtcctgcagtgtggtactgatgccacagtggcgtggggcaaaaatccaggctgacacagaatcagcaactttgcttcagcaatggatgggaataagagtatggaggagggggtgaccttgtattagtactttcagattcagtcctgtcttggtctgggaactgggacagggctggcctgccagggagatgagatcaatgagcacagcagtgggagaggtggagaaatcacattcaggagaactaaagctgggacactgataactactcggtaggtagctgaaaagtgagactagagtgaaggggagaggctgggagtagagaaatattttggcattatctatacagaggtatctcaagaatccaataacagaagatacattgtttcaaaaagaacatgttttgtcttttgcacttacagtaataaatgcccattgtagaacatctagaaaataacaagaaaaagagtctggaaaataaaaatcactgcagtccaactattcagtgaacatttggtgaatttctttccccccgtgagtatatctgagttatatagtgagggtgttttcaagtacagctgagatcataggtatatataaatttgtatattatttttaactaaatatatctaagcgtttcctgccataataaaaattcttcctctacattagtttttgtgtaacattgcatttttttggaatttaagtattcaatttttggctgtctacagagataaaatgtctgggttgatctgccttcaatatgggctgtggcatgggcagaagattgattttgggggccccaggagactgcttcaaagaaatagaggtgaaggtttgtgtagctgtgtatatacatatatatttttttcttaaatggtaacatgatgttctatactttattttcattttacatatagtttaaagatatctccacactggctcaaaaacatatacaccattgttttttttaactcttgcctattacttgatagtgtggttgtaccatggtttatttaatccttatttccatgtacattcagtttgtttgtgctattatgctatttcaaacaatgctaagatgaacatccttatacaggtttattgtctacatgtactaatgtattttttaaaggtaaactcataaatgcagttgttgagtcataaggtctgtgaattttaaattgtaatagtgccaaattgctcttccaattgttagtaccttccaccaacaatatgaaagtgcatatttctttacccttttgccaatacgtgataattttaaacttgtaaaagtttaccaatgaataggtaagaagaatacctcttttttagataaatttgtttcccagatttctagaggttatcttttcatttgctttctgtctaatggcctaatgtcttgcctttgctgtgatgagtgtgttcatgttttccaagtttttttgcatgacttagttattttaatttaaggactgaattatattctctgggtataagtaatttgttgttattcctgaattaatgatatactattaaaactactattatgatttctagtaggtgatggtttctttccccaaagtttcatctctatttttacatctttattttcagaagaatatgataatcaggttatcaatttgaaaacaacactgtattttagttagtattatatttaatttaagataattttgagggagaagtgacaactctcaattcataatctttccattggcaggtctctttattcaagtcttttttgtgtccttcagtaacataaatagccttctttatagaaggaaatatttctcattttgtgttattgctatcttgtatgagtttttattaccgttgggaaagggattttattctttaatatttcctaataggttattgctgatgtagaaattattctttttgatttttatatttggttttgtctcctgtcactttgttgaaataccttattggtccaaaaaaacgtgcccttgtgtttttcttagcaatttgtattacctcttttatatgttaagagttcatagtttaaatacacacaaacacacacacacatacacacacacacaccccacttacaagccttatttacatgaaaatgataacatatactttttatttcagtgtcttctaattttaaataattttttgtcttctatcttagatttagtgtgaatgagacactgttcagattggaaatacactgtctatactgtactccagacacacctattttgcttttaaaattattctcaatatctgtcttttccatagtaacgtaagtatatttataccaatatcagtatatttgtgaatctttccatttggagtaagcatagtgtgtacatgaatttcatatgttcacttccagaaatttacttggcacttttatagatgtttctcagtattccatggtgctttttttttttgtatgctattcaaaggcacgggccatgtcttttctatatcttggatagagttgagtgaataatgatctaatggtggtgacaacatgtttgattatgctaatgcctgtgatagtaaactttttttatttatccaagtgactttattgtttggatatctaattttttaaatattttgtcatcatttgcattttgaagctgttgtgctaatacgagaccttcattccacatccatcattgtttgttagaaatgtgtcagtattgatacaatagccagtacagcagcactaagaagattttacagtctccagttcgtacccacatagaattttattttttggcagtaagatcttcttattcaaacctgagaggaagcttaacatgggtagtattttcatgatttttcaaatcacgaaaatggttattttgaatgaaaatctttcactgattatacaaattgagaaaatgggctaattgccttgaattgtaattgttcatctggtctagtctttctgcatacatatcagtattgatttatcattaatgaacccatcatcttaaaaccctgtgagccattctattaggttggtgcaaaagtaattgctgttttctccattaaaggtaatggcaagattgcttttacattacattattacattacattacattattaaaagtaatggcaaaaaccacaattacttttgtaccaacctaataagttagcttaaatagatgatataatttttactgttgaaaacaggcattttgctttgtagaatattgactgtgtatgtgaaattagtaacaagtggtaagtcgtggttcatggaatggcaagagacttttattagtgctgaatcactgaatctagtttaaaaatttggttaactgccttttcttaaagaattataccataaggatgagttaaagtaatactaatatgataagtttcaataaaactctcagttaacaacatatagctattttctgttctagtttgcttgaataatttgaaatgcttctgtctatatgatgaaattttcttgatgactggttgcctttggaaataatttttttgtttgctgtttatgaatagctgacttcttaaatccaggtgtatacgttttattgttgctcattttatcttacagttgcagagctgttcttaaccaaggcaagttaataccatatgaaataaatactcctttttgagtatgaatttaaaatattttttatcaaaattataagtggcattataaaatgtttcaactggtaaaatgctaactttaaatagtttttatttttatactttattgtaattataaaacaatctatactgttactgtttgcgttttactcaagaaaatgcaaatacttagtgaagatactagaggctacaaaatatcatgaaaagaatttgaagaagacctaaaaaatggaaatatatgtatgttcacaaatgggaagacttagtattgttaataaggcaaattgatttagagattcaatgctattgctgtgaaaatcctagcttccttttttttttgcagaaattgctatgctcattctaaaattcatttgtaaaataagaatagtctgaaacaatcttaaaaaaggtgaacaaagttggaagacacacttcttaatttcaaaactaaccgcaaaagtataataatcgagactaaatggtattgacatcagcataggcatttattttactggaatagaattgagcattccgaaataaacccatatatttatggttaattgatttttcaacaagggtgacaagacaatttaatgggggaaagaatagttatttaaacaaatggtgctgagacaactgaataaacatttacatggaaaagatgaatttggaccgctttctcctcccatatacaaaaattaatgatagacttcaatatgcattatagacctaaatatgagagctaactatgaaactcttggaagaaaacataggtgtaaatcttagtgaccttggattaggcattggtttcttgtattaggcagtagatttttagatatgacacccaaagctcaagcaatagaagaaaaataatgtaaatttgactttatcaaaattaaaaacttttatgcatcaaaggacagcatcaggaaagtgaaaagacaacccacagaatgggagaacatatttacaaatcatatcagtaagaatctattcttccaaatttataaagaaccatataaagaatgattacagcttaatagtaaaaagaatacctaaatttaaaaatggacaaaggactagaatagacatttctccaaagaagatatacaaatggcaaataagcacacgaagagatgctcagcatcatcaagtgaatgcacatcaaaaccgcaatgaaatacgagatcacacctgctagacgagttctaataaaagaatattaggccaggcgcggtgcctcacacctgtaattccagcactttgggaggccaaggcggtggatcacaaggtcaggagatcgagaccatcctggccaacatggtgagacccttctctactaaaaatacaaaaaaaaaaaaaaaaaaaaattaaccaggcctggtggttggcacctgtaatctcagctactcaggagactgaggcaggagaatagcttgaacccaggaggcggaggctgcagtgagctgagatggcgccatctgagactttgtctcaaaaaaaaaaaaatttaataaacgttggtgagaaatatggggaaattggaatccttatacatgaaggtagaaatgtcattgtaaatttaagggggaatataaaatgatgccgctaatttggaaaacagtttggtagtttctcaaaaagttaaatataaaatttccttatgacccaacaattctattcttagatgtgtattaaggagctgcaaaaacatatgtccacaccaaactctgtacatttatatccatagcagcattatttatgatagccaaaaagttgaaaaatctgatgtctattaattgaagaatggacacacaaaataaggcatatttatacaatgggataatattccaccataaataggaaaaagtactgatacacgtgaaacgtggatatccttgaagacattgtgtgaagtgaaagaaagccagacacaaaatatcacatattgtttgattgaatttatataaaatgtccagaattcaccaatctatgtagagaaaaactagtggttgtcagggtttgggagaagggaggaatgaagaatgaacgctaatgggtacacgttctctttttcttttcttttcttttttttttggagacacggagacagggtctcactgtgttgcccaggttaagtgcagtggtgcaaccatagcttactgcagctcgaactcctagacacacacgatcctctccctttggtctccacagtagctgggattataggggtatgccaccatgcttggctgattattattattattattattttgtagagaaaggtcttgctgtattgcccagactgagagttttcgttttgagatgatgcaaattctggaattagataatggtgatggttgcatatactgtttgtgcatatactataaaacatccactgaattatacactttaaaatggtaaatattgcttatgaattatgcctataatgtaaggcaaacaaatcaaataattatttgtggttttatttgtttttccatttggaatgtagaaattactccttgtcataatattaaatcatgtattttttcactagagttgaacttaaagccaattcacattgtagagtacaattgtactatgttcatataatcacaaaatgaatatttctttactttgaaaatgacatttaattatgtttatatctagccacaatatagctgaaaagacatttcttaattgcctttcttaggtaaggtagtctatttacgataccaagataagtaagacatggtttctacccttaggacatctaatggtatatagcgggaaagtgcggcccgtaaacaaactgaggaatatgacatggagtagaggtatattggaagttataggtagcagtgatgaaggagtgtttaaagtaaaacagaattagacaaaggtcaagaagattcacatttcaacaggaacttgaagaacatgtaaaactttcctataaagataaattaggaaatagcattccaggttgaggggaaagcatgaaggtaggaatgtcagtgtaaatttaaggctcaacaaatcatacagttgccagagtgcatagaggagggatgaggcatgagaaggtggtagggaaggagacaacaggactgattatacagaagcaagaagacttaggaaccatctgaatgtgagattcaggacaaaggcaaagacaaggctaaccgtgaacgttatcacatgtcttcttgtgcgaaacataattcaggagttagctgatgcttggtgttgatgatgtaaaatatgaagagcttacaggacatccagatgcaagtcttcaatagacatttaggaataagatctggacttctgagctgttggtattcaaattagaaattttagagtgaaacaggaggtgacagttatagctgtggaagtagatgaaatgccctaaggttgcataaagcattttaagtatgggatctgcatctcaggaataccactgcttaagtgacaaataatgagacacatttaatgggaaagaaagagaggaatcgtatgagggtatttacctctgaagtcaagaaagtcagcaaaatgaaaaagaaaacacacttggaaaagaaatatgttactcctacttttagcttttggtttggatttttagccaaagcatacacaagcaaagagaggcagttgtaagatcaaatcttgcatctgtttactgcttccagccatgaggtctctgggttatgacgtcaacaagagaaaggaagggtaagaaatgactcaagcagatgataaaggctgaaccgggacattccttggtggactaggattgtagctcctgggtagctctaaaagtgtagcagttgtgcagcctggtctcaggagccactggagctctgctggtgatgagaagagactgtggaaactggtcagatcagcagctaaacaatgaccccatgtccactttgtggtctgctctgaaggctttctgtggtgggaggttagctttgttttctcttcatcctgatttctgatatttaagccagcagaattttccttccagctgcattctttattttactacacgaatcaattattggcgtgggtaacattttacaaatgaagcttgctaagctaaactgtaactcttgtgggtttagtggtttgtgcaaaatatgttttcagtaaaacaaaaaaaagcagcatttcttgttaacaggatgcctcacttctccagcaaaacaaagatattttactgttactgtccatacaactagcagaaatagtttatcgataaaaaggaaacatatctctttactgagaaaccatttctagttttcacactgcacaatctgaatagtgaagagtggagaaggggaaggcaggtgcctcactggttgattttttttttccttaactccttttaagttgtgaaggaagagtttccaagtttccattgtttccaggcaggaaaggagatcataaaatgttgttgcatagatcagagaggttaaagaatagagaggccgctagaggccactgtatttgttgagtaagaagtggatctcacttgatctttgccagagtagcttcagtcaagtggtcacctcagaaacctgatagtattgaagagtcagtgtgaaacagaaattagatgttgtatgtttccaaagatatttagcagacttggatgctgaaagggaagtgagagggaagcataaagagaaggttcagtttagtgtgctttgttttaagtggagcagtttgagcacagaacactcaggatagtgagttcattggtgaattagtttcctagagtaggtagacagaaatgggtcttagaattttaacactttttaaaactttgtgcttcatctgaataatttatattctttcttactttattgcaaagcccaaattagataaaatttgatggaggggagaaaagaagatgtcagttatgctttgctttatataatagatggactgctaaaatctcactttgtaattataaccactagggaagttatgatttaaagaagttcttttgtaagggaaatgccaccactagtttttatttattagtaaatagatacgctcatatatatatatatatatatatatatatatatatatatatagcttgagggtaagaataaatgacttacataggtttcttagtttattctttcatttctctcatgtgcagcaaatcaatttataagcattaaaatgccagacagtttaagttttaaattcttactttgaataacagtgttgaaaacatagagactttgttctcagacatgaacaatagactttgttgccaaacttcagaaataatcaaatgctatggttttgcatttatatacctactaattaggaaattaaatgatatttccatagcaacggaaacagtctccttgcacacttgttttatgcctgcaataatacacagcagggtgtccaaggactttagcttaaggtccaaaagaggcaaggtgtgtaagcattgacacaaaagatacacacagaggtgttattggatttacaaagatgacatgagtggctaaaattatgttagtaaattttttttttttttttgagacagagtctcactctgttgcccaggctggagtgcaatggcatgatctcggctcactgcaacctccgtctccgaggttcaagtgattctcctgcctctggttcctgagttgctgggattacaggcgcgtgccacaatgcccacctaatttttgtatttttagcagagacggggtttcaccatgttggtcaggctggtctcgaactcctgacctcgtgatctgcccgccttggcctcccaaagttctgggattacaggcatgagccaccgtacccagacattagtaaatatttttaaaaataaatcctccatatgaataatgttaattgagaaggcctaaagagttttcctgaactctgttacagacgctggtttggtaaatgacttctccagtctcaagaattctaccattatattatggtatgcttgaagatgctgaactgaccaatttctgttccactttttttaaaaacagtcaggattaatggataaagtaatgtggctctctcagcccactgggtctcagaaaataaaattatagggatgggctctgtccctagaaagtaattctgtactagtcattaggggagtgacttcatgggatgcttaaataagctttgtgacgactctgacccctgtgaatttaggaggtaaaagagagtattcacttgtcttatttccttctagcctatgttccaaatttatattataattgtgctattttgctatagtactactgtgattgaattacaatttaaagatgagtataggtggattcattgaatgtgctttaatactttaaaaattttcttcctgaatgcattcttctgattaactaattgatttttctttcaccatcattggctattattgacaaatgaactttctaatctctttgtttttctcgctgatgtatttttgaatgacatattttggaacatccaaaaaccgccaagctgctgcttaattctgtactgtcctctcatcacagaatttaatctgctctctcagtctctgtctctgtctttctgtctgtgttcctgagttgtcatttctccaatgctaaaacccctaatctggatgcacctgcacctgattaatttttgaagttctaatcttgctgaaaaagcattcagtgtgtttctctggctacctaattaactgtaagtgccttagcctaccgtaactcacgggtcctgtgttccagactcaagctcatagctcccattccaaaaagacattatcatgctcctctaagggaaccctcttccctgacaagtctgaaatattcctctcccatacccctggctcttcttcagggcaccttggactcattttttgttgtctacctaggagaccttctacatgtcattgaagttcatctaatatgcagtctcgctccttgatgaatttgtatctgatcccttaaaatgcttccatctcattctcctcctaactgctatatccctttatctgttccccatttttgttacaccttttcttagagttattgttgtatttgttgtccaggctccatacccgctacataacctgtactcttgactgagaatgtctttaaagcagggataagctttattcatctaagtataccttacaatgtgtatcacagaatttagcatatggtcagtaaatacaggtattcagtaaacttattcagtttcaatatattaactgttttaaaacatgaagtgaatggtagtttatagaagttttggtatgtttggaaatatcaattttacagtatctaaaagtatattaagacattcttgagacttagaaaaaaacacactgagttcccatgggttgtattttatcaactaactagagtatattaaataatatacaattttgtaattgtgttatagatgatgagagacacaagtggcccctaaactgattgagatcttaataatggcacatgttcctaatggattcagagatctagaggagcacctattgtgggatactagtcctaaggaatgctttatcgatcaggttctgtttataggtaaacttgggaaacgacttgctttttcttctaaaatagtgtctgagagtttctgccattaaacaggcaaacaaatagcccaaagaggaaacaacaaaacacaattaaactacacttaaatatcatatatccatatatcctacattaatttggcacaaaatctctctaccaatctgccctctcctgctcggccttgctggaataacaactggcatcctgcagaatccaccagaggaaatactgatctgagcctttataaagctttttattaactatgtttgctgcacaaataatattataactaaggacatttttcttaaaagagaagtgttatccttcttgtcaaaattgtgatgtatgttgtttgcatttctgtgtttcttttcaggcttgtttatattcattttcaacatggttgtagtcatagaatacatatgattttatgtcattttaaaaagtcatagttcccaattgttatctatatttaataattattattttatggctacattttattacatgtttaaacatttttattatttttggcttttatttgtaaacagtttagaaatgaacaccgttgggcgcattactttctattaaaaactgagcttaaggatcctaagagtatagataccgagttgaaggctctagtgattatggccatattgtttgttataacgctaggataagtttatatagcttcctgcagtacttaattatatccagttccttgtctttcaggctcataataggtattctttttcaatttaattatcttaaaatgaaaacttgtgaacagtttttttttccctgtaagcctcatagagttgaggtaaatgaacgttagtttattataaaaaagatttatagataatttttgctactcttaacccatgatcacctagatacagatatatttattctagtactgatagtatattttctcctgagttcctctttttcatttttgatattgtgcttgttgtccccagtttctgaaatacaacatttttcttgactttgtgataacttcagctgtgttttatatagctttccacttgtgtgattattggcttccctttcaaatatgtcaagttctggataaatattttttcatttctgatttttgctgttaatatttttatagccagttagttggtaagaagggtgaaaaaaaaaaactcctgcaaaacaaatagaaaaaaatacacataactatttaatctgatattgagtagggaaggcctttccaagcataaaaaggaagaaatttaaaagtaaacaactgacagattaagtatgacataatttttaagaaattactttaaaaggcggtgaaataaagagataaactattcatgcaaaaaaatttaacatatgatagacaaaatcttaatctgtttaatagctaatgagctcttatcagtcaataaaaaaccctaaatctttcagaaaaatgaataaactatttttcaatgaacatattttgctcttttttttttgagactgtcgccctggctggagttcagtggtgcaatcttggctcactgcaacctctgcctcctgggttcaagtgattctcctgcctcagcctccggagtagctgggattataggcccctgccaccacgcccagctaattttttgtatttttagtagagacagggtttcaccatgttggccaggctggtctcgaactcctgacctcgtgatccgcctgcctcagcctcccaaagtgctaggattacaggggtgagccactgcacccggcccatattttgcttttataaccaggcaaaataaatttagaaattattataagtagaatgtaaaacttgacatttaaaaaaattatgcccttcaaaatcatttattcttatatttgtccttactatcccattggatatgtaattacataatcatatatataatttaaataaataataatgtatttttaggtatgaatgctatcagaattttagcttccagggacgggtcaaatatgaagggggaggaaaatcaaggtgcttagaaggtattcccagaaagaattaaagataacagcagggagatagttaagatttttgtatcttcaaggctcttgtatagctgcacattgtcagctctgttgaagagttgaaaaaaatgccagcccaattaccatgattagatctgccttgccataaaatatcactaatgtttgtggaatgtttgaatggacacgtacgtgaacagctctcaagctcttttctgattttgacatttataagttaactggatggtacccaaattcttgaagggatgcaacgtagacagataattttcagaggggtcacagcagggaagaagattcggtcaaggtaatgaggcactgattggggtctgctgacagggaagagaagttaccaaaaagtcagagatatacaaagaaagccatacctagattcacattgccagcctcactttcccaagtggctaggttttcttaatttgtcaagagctgagttgtgtaatgaggtgaaagcatgatcgctatttggttgattctgatcatatatctgtttctattaaggtgcaagctgtatggtttgtcaccatccagattggtaggaaaagtataggcacattcaggttaattctccagttggccatcctagctaatagtgtacagcttcataatgaaatggcaagtaagatccagagattcagatactccagataccagtagtacaatcttaaaattgcgaaactgtggcttaaatattttttgactaataatatcataacaaggttttctaaagtttcctaagttagcatatatacacctaaatatctctaaagaagtgtgtgtgtgtgtgtgtgtgtgtgtgtttgtgttgagggtggggtacatgcatgcatttgctttgagctcatcccctactctactgtcgtcactttcaccatggattttttttttcttttcttttcttttcttttctttggagaaggagttttgctctgtcaccaaggctggagtgcagtggtgcgatcttggctcactcactgcaacctctaccccccgggttcaaggagttctcctgcctcagcctcccgagtagctggtgttacaggtgcatgctgccatgcccagctaactttttgtattttagtagagacggggtttcagcgtgttgcccaggctgggctcgaactcctgagctcggacaatccgcccacctccgcctccccatggattttactgtacttacatctgtgtctcttggttttcctgtttgccttttgttcttcactcagggttctcatgttgtttacctcacttgccactgtttgcaaaattgcctgttctctcctcagtgtctctgccctttttatttgcacgtggagggcttaaaccaccccccattgaaggacgttctgttggtgagttgaaaaaatgactgcttaactgactgatttgacctgcctgatccaccagtctgccttgttatgtaatgaccaccatttctagaaattaacaagcccttgaatcaaatgctcatcagcctgtaagcaaatgtttccccctagatttctgctactctgggattttaacatttcttgtctcagaatgctctgctcatgctcagttcctgcactcctatcctttcatgccctttcccgtgctcttgcatcacatttagttcttttatccctttgttcttatgctgctagggtctatgcttggggtgttcatttttctgcattttccagttatggtgagaggtgtcatgtgtatgaccttaggaaaacccaactttaggagaagactggcttccttgcagaacggttaaggtattttccccttaggaaccaaatccgtcttggtaatcagttttcattcttgctcaaattcaggggttcacccagtagcaaaggctgcttgctgcccgcactatgtaaaagtagaatgcagaaaccatcagaaccacttttacctttagaccataaatacttaccatgtcagttatatttgcatcctagaacataattttgtttagcacatgtttcttgaattactatgcctttttttttttttcaagagaaagttatgcatacaactttcctggataccagtagcccctcaggatctgtggttttggacatttgggttttataattttataccccaagttgaaaatctaacatcattttacatatgcatggcttacttcagtttccttcatttagcgaatatgaacattattgattctacttttggaaggaaaaatggtgaccctgttcattccaagagagggaagatctatttaaactccattcactcaatgtagaggagtaagaccaggatcacaaaaacatgttttaaaacactaagatagtttgtaaaaaacaaagataaaacacaaactcaaacttgttgtttcaaactctataacctattaataaatactgtgaacatatcagcttctggaaggattatgctgcagcattagtaataaagatgattattcgaaaaaaaaaccttatcagggtatacttttaaccacaatatatcagaaacaagtgtctttgaaaaaccttataccgcctgtaattttatagactaaagctgttatgatttttttctctaatcctttatttatttattgttgttgttgagaacttgaacatgccagccttgtttattgcaaacgtggtatttagttatctttggaattgttgaggaattactggattgtaatagtgatacaaaatactgtggaagcatggaggacagagagacatgttggatggggtgaatggggaaaatccagagatatggccttgctatcgagcagattttgagagtggaaatagcaggtagggctggaaatagtaacattctatgggaatggagagcatgacccaaagtaggggagctcagagaatattgctgagaggtgagtaggcatgtgtggttcatatttaaattacatggggtcagagtttggtcagaagaaggctgggaacagattttatatggtcttaaatgctattctgagagatttgagctttatttctattccaggggcaagctgtctaattagtgtgctctaatgtctgaagcatgacatgatgactgtgcaaacagaagatcataactgggaaaggtggtggcagataaatcaattaggaggctcttgcagcaagtcaggtgaggccttatgaagacctgaacgagggcagcatacttgagaatggaataacctagagaagtgatctgcttacatcaaaatcaagatcaataaggataaatccaagcttttctttggtatgaaaatatccaaataattgcacagataatggttaagaaaagactagctaggcaggcacaagtacagcagacagagacctgggagtccaagaagaccatatggtgaatgtgagtcagcggtgttgtgctgttattaaaaaacagaaccaacactatggggaaatatattaataggagtgaggcatgcaaatggcaggaagtagcctttctgatctattcataattgttgaaacttttgctttcctcgtgtcttctgttggccttcacacatcaagagcgtgtttagaaagtgtgaaaggcctcgagaaggccattggaaatgctggaggtgatagaaggtgatatctgtggtcctgggtcctctggatataaagtcatgaaggctaaatcactgtaaacctttttgactgtatgaggcccttggaagcagtaatgtgaattctagcagctcaaagaattcagatacaatgttactttcagatacaatgttacttgtaaatcactctgattttatctttatattgtaataaactgtgggtggctttattattaggatagacaggaacagggaggtttggaaatgctacttttacccccagctgggagtgtgtttgccctcagttgttgaatcctgtgatctcatttttcccttctggtcacctcaagcctgtcagtgtttgaaagactcttgtggaccagaactatctgtccttccacttccacatcaataaatgaggctgaccacaactgcatggaaattaggggggctgtgcatttctagctcctgcacttctttacctggttaatgacagtatctttagagctcctcctgcttagtgtctctttttggaaggtctttctgtgactgccccacccaggtcttgtttcttgtcacgtgcattaagaaaacctggcttttaaatagtatttattttaattagcagttacacactaatttgtatataattcctaaattcctttctgtcccaccagactgcaaccttcatgagaacaggaactctgttgcttttgtttgctgatgtttccccagaaccttatatatttttttgtatgaaagaataattaaacttatatcacaaaagggaatgagtaagagaaaaaggatccaaagggggcagttttcggtcattcaaagcagtaccacttagtggttaggggtgtgggctgtgtttaggtacaacacctggctctgccacttactagcttgggcaagtgactgaccctcaccgtaccttagctttctcatctgtaaaatgcatataacaatattacttacctcatagggttacagtaagaatcaatgattggatatttgcagagcaccttaaacagtgtctggcaccgagtaagtgcaacatatgcccttgaaataaatagaagagaagcagagttttgcccctcagctgactccatctccgtttggactatccttcctttaaatctccccacccaaaattatactaatccccattgtattcctgtaatcgtttacattactgtttcctaaagtgtggcatgaatgccacttgctttatgtaggatgactcaattgttttagttgattcacaggacaaacacatttttaagtcatagttatgtatttataatgagcacatgaaatataagtgaaccaaatgtgattcaattttgttaaatattaatgaagtcgcttatacatttaaaaaagatctttgattccgtgactttgctttgtgtagtttttggacaccatttaactcttcagtgatttgtttatttctgagtactttgaagtgttgataacttttcctacttactgtaagtttgatcaaataatttgcttgaaacaacttaacatggtatggagagttggaaatgggtagcttttatttaatagctatcggattggtgtgattaaatgtcaaattttaatgttgtgttgatcaaattgttttgattggtttgcttgtgatttagcatttcataccttgtataaaatgtccatgagacatgtcctgaaaaaacatttctttgttaggttttaagtctgcaatgtaactgtgcttatccctatgtgtcttttgttaacatttttaaccttgaaagtatattcatgtgtataagtataaacatatatattacacatatatatgagtttgtgtgtatatatatatatatgtacacacacacaagaataatttttcaaattcttattttacaaatgttagaatagaatggagctgctttaattttggagctcttatatgtacacacagatatcctatatatatatatatatacacacacacaatgtttacacatatgtataaatacatacatatacttgtatacatatatacacatacacacacgcacacacacatatatatatatatatatatatatatatatacactcatatacttggtaaaaatatgtactaaaggatatatttagctacagagtgaaatatttgccatatagcccaaattcttatggcttaggagttgattaataggttaaatagtggctggtgtctcagcttattagaacatttacgatttgcatttccccaatcttcataatttttttttttttttgagacagagtctctctctgttgccaggctggagtgcagtggcatgatcttggctcactgcaacctccacctcctggggtcaagcaattctcctgcctcagtttcctgagtagctgggactacaggtgtgcgccaccacgcccaactaatttttgtatttgtagtagagacggggtttcaccatgttgtccaggatggtgtcgatctcttgacctcgtgattcacccaccttagcctcccaaagtgttgggattacaggcgtgagccaccgtgcctggccccagtcttcataatttttatggaatgtgtgacatggtgcttgtggtgataatttttcataatgctagaaaactaataatgctttcaactgagagctttctggccttataatttctttttttttctctttagctttttaaaaactaggctttatacttctgcaactgaaatgtgccgaaccttttagcccgaaagtagtatatattgtgtgaatgttctcagcactgctaaacttgccaagataacctgaagggttttgtctggctgctgcaatttcctactgccagtattaatccccatttttcatcccctagtatgggctatttcttcagcccttcaaaatcgaaagaaagaaattttgtattacaaaatgcactatgttatctgatgttaaaagtaaaagatttatcctaaaataactattctatttagtattctttatgagttttgcaaacttaagcagcaaaagttacttttcctttttgaatgtaattgacttttgtatttttgtgatttcaaagcattgaaattaggttgcagacatttaaacagaatgtctcaatttttttgtctgtgttgagctttgaagcaaaattcccagatttgaatctcagcttcattgctcactaaaactgggcaggtttaatgagcattctgagccctaatttacttatctgtaaaatgagatgatagtactaacctataaaggattaaagataatgcacataaagtttatagcgtagtaccttaaacactattagcaaattcttattttacaaatgttagcatagaacagagctgctttaattttggaaatctcacatgcacatacacacacatatttatttattttagtaagaccatttcactatctcctgtaaactggttaaaaactatcaaaaatgaatattttctttatatattaatgtcctgatttttttcactgtagtgcatttctctgcttaatgtgtcactaagaatttttatcaacttatgagaatatggaggggcttagtaagtttaataaatttaatagtttgtttgcattttctaccattttaaaaacaactcatgtgtttttaaaatttcaaattcattttcaaccatttataaatgctctgtttttcttcttgggaagtattttcataaactttagcttacagtgttaagtgaattgtctggaacctggctgttttgtgatgtaaaattgactttcaagtacgacattagatctttgatatatacttttactatttcggaacacgttcataattttccattaaaacatatttgtgaagtttggtaaaatatttgtaaagtttcattgaaacaaaaccgtgtaatatccaaaaaagacaaagcaatcgttatgagctggatatcctataaaagagtgttaggattttattttactttgaaatgtgaaatcaagttattatttcagtaactaagcattgttgtacctttcttcttaagaagattaatatgtaaatttagtgttaccttaattcaaatatttctttaaagatgtttttaaagatagacagctgtagcttgctggttataaaagcagcagttagaaatacatttttgactcacttattattttgactgttttgatggttttcaatctgacaacttttttttagtagctccactgcttccgtcacacccaattggaccttgtttaatgtgttggttttatgcttcactagcaatgaacagatcatttaatagatgattatatatgaaaatatgatttataatgaaaatggtttcataggctatataatagtgcagaactacctggaaataaaacattgtgtccatctgttttacaaagtccattttatgcctttatcatgataccaaaatttcattaacaccaatttgaaaatattaaagaataaaaaaagactttgtgatttaaatttctcgttataaaatattaaagtagaaaaggacaacaagtattcttggacaagggaagagttggacaaaattagtcaacaagatccaggtttggggacttttcttggaaatggagtctcactctgtctgctggagttcagtggtatgatctcgggtcgctgcaaaccctgcctcctgggttcaagagattctcttgcccagcctcctgagtagctgagactacaggcgtgcgccaccacactgggctaatttttgtatttttggtagttacagggtttcaccatattggccaggctggtctcaaactctggacctcaagtgatccacctgccttggccttccaaagtgctgtgattacaggcatgagccaccgcgcccagctggtttgggaaatttttgaatgaatagtgtgtagttgcaataaatcagttgagttgtaggttaagtctagagaagtcagtccataatctcttgagctgaaagacaaaccacaaaatgactattttggcttgggaagccatgaacatggctttcttttcttttcttttgtaagtgaagcaattgaaacaaacttttcttggtaaagggaatgggaagatttctggggtctagaaggtaactataccagttcctagtctaggtgccacttcagaggccttctgtagcatagaagataggtaagacaaatttgtgtaactgataaaggcagtttttgaaaataagctttttatgaaagtgcagggacatagctatattaggttttagtgacttggtgagaatatgtctagcttcagaattttttcttggtgacacaaagaatattgattttttcatgagacccaaaatgaagatgaatcacttcttaaattctaggagttacccaaggaaaatgcttagcaggtatttagagcccaagtggcctaacaaagaaatattgccttggcctcccttgcttgagctctgggtgaacttcccagctcaggtagactgactttggaagaggaagcaagcaactgtcaatcttaaaactccattcaaaggacatctaacttgcagagagagtcccattctgtgcccaattggagcatatgataatggttctgttttgttataacctgagggagcaataggccggggctatccagaaagataagaaaaaggaaaaacacaatatttttcacagttccaaatatctacacaatatttaaattcagcatcacatgatagcaccgttgcagagacagttgtcagcccccttactcactctcacatacttttttagtaatacaactcctgaattggacatagtgcaatacatgtcccagcctcccttacagctacatgtgattattcagaaagttatatccagtgaaggaggagctgagttttgtgtgcaacttctaggccctatgcttagagagaagcggcatgccttcacttctccttccccactccctgtccataggctcagttgagttacagtaagaggacctaggttacaaaatggaagctgtacattgaggatgccacagtaatacaatagatggagcccacatccgtgatatggagcagccacatcaaatatgaactatgtatatgccaactgttacacgagagaaaaaggaactggtttaactccttgatctgttggcttttgttatagcaggtggcctcatatcctaattacatcaaacactttaactataaacacactaaaatgataaaatgatgaaaacacatttgtgtagttgggggatgttgttttctttttttaaaaaaaatattattcaaagtgagtttattgatcttcacaaatgaatccatacacccactaggtgtcagtgatttcccaggttgataactctcgatttaggcaaatcaggagtgaaagtgaagtgactgaaagtgaagtaaaagcttacttttttatgctcataatataagtactcaaacaagcttaaattagataggagcaatacttataatatgaataaatataactagtaattataaagcacttcatatgtgtcaggcactattctaagctctttatatatttactcatttaatacaacaatcatatgaagtaagtactactattatctcagtttagcagagaaggatgtgtgtaagtcaggcacagagaagctaagtaccatacccaagattgcccagctagttggggaagaggtggggtttgaacctgagcagtcaaactctagttgctgttcttaaccatgttttctttaggaagatacaagactaacattagagttagccttgtacagtgagtggtttgtttttttcatgtgagcagagttgctataaatattgccaatactgagtgaggcacatactctcactcagatggcatcttcccctgagtcatccagtgttttttctaggtcctaagttagagaatttagcatccttaaattctcaggaacttttaaaaccatgtcttagagcagaactgtaactccaacctaaaacaggttagaattcatgggaaagttttccagccagttgtatccaagcatccttcagagtagaatagagaaaccatctttttaaaagtatttacaattgtattcaaattattattaccgtagcactgaataagttataaaaatgtaatttccttatagtccctttatctggcaaattgcttctgtttataatctgtagctgctcttttaattctttccaatatgcaaatatattaaaaataggtactaagaataatataaatgtgttgttctttgattgctttacactgccctgctacaaaccaaaatgtggtttatagcagacacatacaacagtttaaaaactaccaactgtccccaggggtggagcaatcaagtaagcaatggcatgttaactcactggaatactgattgattgtacattattgcaacttctgttgcaataactatatacatattttagtcttctcagcaacagttctccctacaatagcatttttatttattttgaagaagttaaggaagctgggttgtatctcaacaacttgcctatgtaatgattcctttccagattcaagccttaaggcctgctcaacagtgcttccaggccaactaattttttagaaatttgtggaatttgtgaaaagaacgcttgatgtacttgtttactaaaatgtaatgtgcatgcatgcgtgtgtgtgtgtttgtgtgtgtgtgagtgcttgtgtttctttaggactagttctctggtacataatagggatcataatagggtttaaaacatttctccataggtagtacagggcttctcaccagaatgactctttgatgcaaaataaatgtattactctttgtgactaattttccatattcagtatattagtgagtgttttctctaatatgcttcatctggtacctaataaatttagatatataaacaaaagctgtcccacaatgattacattttaagaattgctctcccatatgagaaattgtttgatactttatgaagttattcttttggatgaagacttctacattgacaacattcatatgattgctctctttctattttttgacacacaataaggtcagagctctggctgaagaattttccacaatcaagtcattcatatggcttctctccagcagggttttctgatgtgaagaaaatgtgacagcttcaactgaagtattttttagtctttgtattatttcatcctattgtgaattatctgatgcataataacatgagacctctgtatataagacttcctaaattcattatcttcgtagggcctccctcttatgaaagttctgtaatgcataatgaggtgagtgttctgtctgaaagattttccaagttcaggactatcactgagtttgtctctggtatgatttctttcaagtctaatgaaactaccacatggaaaataccaaacacttttccacactgattacatatatacagtttgtctccagtatgagttctctaatatagaaaaaaagtgatagaaccagctaaagactttttcacatgcttatgcattatttacctacttatgatttctcaccagtgtgagttacatgatgttaatgtagtgagaaccgcatttgaagaattttgcatcttcttgatattcatggtgtttgtctttttatttacacccttaggtataccaagggatgtactataagtaagaaacttattgctatcattgtagggtttatctcctgtttgagttctcgcaaattgaatcaggtgaatgttttaacaaaaggttttagtacgtttattactgttactgacatagtttgcctgatgaccactaaactaaattatgttttaaacttttaacatttgaatcatacttaacggaaatactctttaagtactaatgagcatgaaagatacagtgtccccagtatttatcactttcacagactctcctaagcactttgttttgtgtgaatgtttcttatcttaaatgtttcttctcattttcctgataattgtctagtttgttttcacatttccatttttaatgacaaatatgagaaatcattcctttccatttcttccattttaatgtcatagaattgtttatcttcagaaatgctattgttagaaattgatgatttgatttccatgatagtcactgaatctggccagttctccaccagctatgattctttacctttctccatctagagaatcacatctgtttgggaagctgacactcaaaggaaactgggttctcatagtactaatgcatcacttatttgtatatgttctgctgagaagtgaatttggtgaaatctacaaccatatcctagaaggcgatccatgtctgggactggaccattaatgactcagcttctatattcccttctctgatttcttgagtaagtggagagttctgtgaatgcaacactctctgttgggccaggttcagctggcctggcctgccccacagtgcctgctcctctttacctgacttgcatgtatgatgggccagctgctgcagccttctccatgtcactctgttcatcatgtacccaactcccaatcccaggcacttgagctgacccctgtctgatgctgccaacccacatagaaatgtctttcaaataaaaggctgttcattttggtgaaggtccgttgccgcttaatggttatgtgtccacagggcatacggtgcatagtaatacttcagaaactcaggcttatttctgattgtccatccaaaaacaaatttctcagaagtcaggtaaggctgaattctgtctttattatttcaaattctctgttccttcctccgttatatcatttaaaaaagatatagggattggaaacttggtttggccatagactgttttttcaacaaatagaatttaaatgtcttttggtggagctttattattagttcccatggttcctataactttcatgcctcttagcacatgggtcggggcagtattcacacacgtggaatgagcttaatgcaaagcattgcgctttctccttgctcatctggtccaattaacttacagtcatttacatagtatacaaatgtgatgttttgcagaacatccaggatggtttagatcccttcagagttcagtatgacaaaagactagagaattggtttaaccctagtgccagattataagtatatactcttttctttgtcatgtaactatgaactgctacaaaactcttttccagtattttggaaaatgatatgttaatcagctcaatggctaaatacatgaagctatattaatttgtcataataaaaaaaataccacatctgacactgaagctgcagttgggattactacttggttaagtttgtggaagtttactgtcatctgtcaggactcatctgttttttgtagtgccagatggtgtattaattggggatatcatgggaggaccactacccctggtttctttatctgctatttcccctgttatatgatactgtttttgatatactattttgaaagaactaggaggagggcaatatctgagacttatgcttgactttaagatgaaagagccaaaccgagagttctgctatttacaggtatgtttgttttaattatataagggccagtaaaataatcactggctagatccgtggacctagtggacccactatgagccagaactgggctggaactccatttattgcctgactgtcttgcattctccaatctaattagaggtaggaggtgagggagggggcacaataatgtttcagttccctggatatcaatgtcaagtgaaattctgtttctaactattctcaaaatgtctgaatttcccctttctgcactctggttacctttatgatcttcagctgatacccttgggagttctggagacgaaatgattcttcagagttattctttttgaggtaaaagggctagaacttcggacctttaaattgagcagtcactggatgctgtgtttccttgagaagaggccatgactctgggcaaggcacatttctgcagtcaaagacaatttcctgagggagactcagcaatgagccaccagtgcacgtcactcttagcatgtgagggaatcagtatcttggtattgaaaggaggatgtaggcctcacaccacatcatccactccatagccatagccgaattgcaatggcagaatgttatgaaataaaagtaaagaaatattgtagatgagaaggccaaatattaaaatgcccaaatgttacccctgttgtatgaccattacatctgtattaagcgcaacactcatttacttattctttcctttattctttcattcagtatctttttataccaaataccatgcattgcgagcagggtttggattcctagcattgtctgaatctcagctatgttccagtaggactgcatagttcctttagaccttacaacgtgaataaactaagacatagatgagaaacctaatatacccacagtcacctagctgatgaatgggagagttgcagttgggactcagttctgcctccaaggactgctgtgcccttcccactatatctaaagacctttacagggaatattaaccacaggttcatcaccgaagagtggaggaatagaggaataatggaatctgtgataatttgataagtcaataaaaaacatttcaataaataaaaattattactgtaggaagtgagaaaaaatttgcagcttgttcttatagctgtgtctgttttaatattttctactattcgtcactatatagctgctgcaaaccaaagaaaaaaactgaggtgagtctctaccaaatttggaagcttattttgccaaggttgaagatagacccaggaaaaagaaacaaaacctcaggagcatctgtgattatctgtgctttttccaaagaggttttgaggacctcagtatttaaaggggaaagagaaggcaacaggggaaagaggaaatggaaaaatgggggagggtagataaaagaggcaagaggttacattctttttaaggttttgattaatatttactgaatccacattttacttgtgaaaggagggtgctcagggaattacatttttacataagataaagtaaatgcagagtcaagcaagcagtcaaatatacatttgtctcaggtgagagcagaaggataacctctacacctgcgttagtcccaaaactgtggagacaagctgtcaatttacattgtcagagtgaaattcaacagaactctgtttcagggtgtattaagccattctcaaattgctataaagaattacctgtgactgggtaatttataaagaatagaggtttaattgactcacagttccacaagttgtacatgaagtatggctagggaggcttcaaaaagcttacaatcatggtggaaggcaaaggggaagcaggcacatcttacatggacggagaaggaggaagaagggagtgggaggtgctgcacacttttaaacaaccagatcttgtgagaactcactatcatgagaacagcaagggggaagtctgcccccatgatccagtcacctcccaacaggctcttcctccaacattggtgattataatttgacatgaaatttgggcagggacacaaatccaaaccatatcatttcacctctggcccctcccaaatcttatattcttctcacatttcattcccaacattcccccgaagtcttaactcatcccagcattaactcaaagtccacagtccaaagtctcacttgagacaaggcaaatcccttctgcctatgagcctgtaaaatcaaaaccagttagttacttccaagatacaatgtgggtacaggcattggctaaatactcccattccaaaagggaaaaatcagcccaaacaaagggactacaggccccatgcaagtctgaaatccagcaggacaatcattaaacctaaaagctccaaagtaatctcctttgactccgtgtctcacatccagaccacagtgatgcaagggtgggctcccaaggcactgggagcccccttggctgcttccaccggttggcattgagtgtctgcagctattccaggcacatggtgcaagctgtcagtaaatctacaattctggagtctggagcatggtggccctcttctcacagctccactaggcagttccccagtggggactctgtgtaggggctccagccccacatttcctctctgtactgccctagtagaggttctccctgaaggctctgccccatagtagacttctgcctggacatccgggcatttccattcatcctctgaaatctagatagaggctcccaagcctcaactctcacactctgcacaccctgaggcttaacatctcatggaagccaccaaagcttttggcttgcaccctatgaagcaacagcctgagctgctccttggtcccttttagctgaggctggagctggagcaaccacaatgccaggcattattttttgaggctgcgtagagcagtggggcccagggcctgacccacaaaaccatttttccctcctaggcctccaggcctgtaatgggaggggctgccacaaaagtctttgaaattccttcaaggacttttccccattatcttggctatcaacatttggctcctctttacaaatgcaaatttctgcagctggcttgaattccttcttagaaaatgggtttttcttttctaccacatggccaggttgcaaattttccaaacttttacaactctgcttcccttttaaatatgagttccagttcccaatcatttttttgcccttgaatataagctcttgaatattttgctgcttagaaatttcttccccctcataccctaaatcattactttcaagttcaaatttccaaatatgttccttctctccattgagacctcatcagcttggccatctctgtccatatcactatcagtatttttgtcaaaaccattcaacaagtctctaggacgttccaaacttgttcacatcttcctgtcttcttctgagcctgccaaactgttccaacctcttcccgttacctagttccaaagttgcttccacatttgcaagtatctttatagcagtgccccactcctggtatgaattttctgtgttggtctgtttttgcattgctgtaaagaactactggagactgggtaatttataaagaaaaaaggtttaattcattcacagttgcacaggcttaacatgaagcatggctggaggggcctcaagaaacttatagttatggtggaaggcaaaggggaagcaggcacatcttatatggctggagaaggaggaagagatagtgaagtgctatacacttttaaacaaccagatcttgtgagaactcactcactatcatgagaacaacagggggatgtctgccctcttgatccattcacctactaccaggcttctcctcttatcactgaggattacaattcaatatgaggtttgggtggggacacaaatacaaaccataaaatagggtaaatatcttggggctcacaaagaattttcttgtgagcacattgtaagggaggccacctggggaggtatgtggacttctatctttgcagctatctacttaggaacaaaataggaggcagttttgcaactcagttctcaagcttgacttttccatttgacatagtgagtttgggtcccaaggtttttgttttcctttcacactacaaatagatttgggctgttgaagggttacatctgatctgctgtatcattcttgcatgcaatgacctgtgaatgtaaagctttgtctccatttagccaaggtggatggagaattgcttatcactcatgtgctggcccctcttgtagccatcaatacctgatggcacatgaaacctttttttttttaaaacacaaatctgtatttgaaagactcagaatacatgttggaactgatacgatagccttctacatattgaggtaaattactttgcaacattatttgaagaaaatcactcaaggttagtttgtattaattgatcacaatatcttccttaggattgtttgggaaaagaactgtagatggagatcctgaaaattatgagaggacatatgctatatagtattaccatataattttatacactgtactatagagagcacttacattagcttaggggtaattctgaagcttatcttccagtgggactgacacatctaattattaaggtagttttgtcatacccattgccaggccataggatgtttcaaaaagcccaatgattctggatccaatgtctgttagattttcaaggttcctacaggaatacctctagaaaaagtgaaaaatagatcattaagatagaaggctccagacacctcatacccaacatcaaattgtgctagacactctattaaattaatcctgttctcaaaacagttccacagaaatggaggttattgtcattatttcataaatgaggagaatggtgatacttccatggtcatagttttcttatgtttgttttctttctttgtgaatttaccctgtcctatccaagaggcatgaaatagaaaatccaaacagagcaaaatgggtattaagcctattgatagttggtatcaggatattttaaatgccatttagcagccatttaattgcatttgctcattttcaagatgcaaaacaaaagagcccttagaggctaaagcccagtgccacccacctggctaaaagtttattaggaattaggagcagatttcacagtcaagagtctagcactctttttgccttagggcacattcctttgtgggtcctatttttatgcaaattgagatgcaggtgacatccttaggattcctaggtgacaaaaaactgttctatcacttttctctttcttggcaaatttactcttgccttttcaaaagcaaaatgtgaaaattattgaataaggccatacactggaatatagtgtagctgagaaaacacccagtagtccccaccctgagcctttccctcaaaagcatcctcttgaatggggagggaaaggtgagagtgaaactggcatcactttaaggaataagacagttttacttcaaaagctttcattcatgttgtaagtttcaatagttaatatgagtttacatactacgaatttagaagaggcagtcatggatctcatttaagaaatttcctgtgttttaacattttaactgctctattttatttgaattgtgttagaatatattattttattctcaaatgctattaaaacatttcatgcaagaagcagatttatagtgaactgaattctgtatcatgaacagaattctgactagagcattgaatttcttattcttagttatgtgccgtttccatatttcacattaggatttaccaaggtcaatgatataataattactcaaaagatacaagaaatgttcatattgcaaacacatctcagtgttacccactgaccttgactaaagaaaaagttcatacagctccttattcaaagactgagctgagtaagtaaacaaatgtgaaaaatgtaaatattgttgttgacagttttgaggatttaatttctcagtgaaatgtaagaaatttacttgctcagatacctttttggttctataaatgggtccattataatttttgcaaaggtacctttttaaaattattgtcaaaacacattaacttcgagtttcaaagagaattagactatagtccttgtttttattttaattttctgttgccttatttttatgattgagtaatatatcctcctccatataaattgaagattctgctgactcattaatgaaacaagttctagaagttatttttctagtaataatggcttgttaatataataatgatagatttatattgaaccctctttattctctcattctgtcctgtcaccattggcagggtttcatgcatttgttcagtaactgggaagggttaggagtgagcccttagttgaggatcagaggatttcctccatgtaaatttatctggttcatagaagattttatagtggtgacttggacctccctagcagaatgcagcattatgtgtactgaccccagctagcacttttattcttggttcaccatgtatatgaaaagaggaagatgtagctgcctttttcatctagttcaacaaacatgagatgattctgacggtttctagttttttgaattgaagccagtcccctgatacattcttagttacattgttgtgcacaaaatatgtgtgttcaggttttagtgcttaagcatgcctctctgaaatgcagcccataccacacttaggtacttgtcaatataaacacaaaattgttaacaccttttgtcttcttatatgtaaaatagtgccattaaatggaatttagaattagcgaagcctagctgtaaatactgcctcccctaattatttatgtaacctcttcgagtctcagtttttaaatttggagctggtaaagcagtgtttggaaatgttcatttttattgcagacagtcaatataagatttatttgaagtactggttttaaaacataggaaataaatcagcagtacctttttgagtcacttaatttacccatctttttctatctcctgagttaagttaccctacatgcttgcattttttctgattcttaaagatcttcagagaaggaaattctacagcctttttgggcagcctattctagatccttacagcattcactgtcagggaactttttctcatatctaaccaaaatctctgttgctggaatttaagctcatttcttcttttattgtcccctgtgggaagtagaataggtcagttttttgtttattattctctcaatagccctcaatacataaaattaaattatggcagagttatctttatttcataacctacaacttttgcccgttaggagagttcagggcctaaggtggccctcttaattctgatgtatgcatttattttcttgctgtgtattgtgttagttgtacttcatttcagaaattggaaacagaatgtgatgagtgagctctgaatgctggaatttaagctagtatccacaagagacatcttggaggagctagcagagatgcccatttgaaaattaaatgtaattcactttttaggtttccttagttaaaaaaaaaatgacctacacttataatttgcctacttagttttaaactcaatgctgttctaatggtttcatttccattctgttacctaaaatttgaactacttattctctgtgtggaagacttttaggggatgtactaaacccttggaaaattatattaacttctttagatttggctggctttcttctttcaaaatgatgactctgcttatggtggcataatccatatgagctgatgtgactctaaaatccataatgtaattcatttgttttcaccctggattcatatattgagatgaattggcttctctgcagatgtgtctacataggattggcttcctaaactggtattgacatctattatttttgtcagtgtactactgtggtactgaacctaattaaatgaaaactttcagtttagtagaattatctgtttagctgtgcataggattctcctggtgacagttgggcttgatgttgttttgtttttaaatataatgcatatttcacagcattgtacagaatctccagagcgtttacacacatagagatttatacatacgtaaacgttcacaaagagacacttccatgttttagaccagactatgattatcagcatattctagttctgcataaatttttctaaagaaatttagataacattcttagtatgttcaggtagtttcctgggctaataaaagcttagtttaaaactgaacatgcccacaagtgttcttaagtcaacactgaacatgatatctttttacagattgattctgccatttagtgatgcaaaaatgactgcatatctcattattaactataatttaatcagctattattttatatcaataatgccatcttagtaaacttctggtctgataacacgcctaataggtaccaaaattcaggttttacaaaagtattcattatttgtcactctatctgtttatatgcattagtttaaagcttttatgacatacagtagtgctgtaaagattcaatgaaagatccattatgaatccttccctaaagggacgtgcagtgtaatagggaagataacaaatgtaaaatatttattgtatgtggtagaagggcctcagttccttatagagtgcctgatactcagaaaaccaattttctgtttggtcaatcaggattggcttacttgggacatgaaagatgacaaggatttggacacagtgaaatgagatagtatagggaaagtctttctacacccttttaaagtaagtatgagcccaaacctacatgcacaaagactcagcgtttttgtggaaacaatgggagctttttattttcattggagcttgggtaatggtggtgaataagaatgaaacctgacagtggtgccaaactaagaagaaaattaattctaagtgtagatcctttggctagcaggatagaggtattgaataaatgctggtactctctgctcctttctctctcctctctttctctgtctcctcccatcccatcactctttctctcttcccatctttaggttgttaaccactcaaatattttattttatcctcggttttcatacactcagcacctattattgtaggtgcttaaaaaattttgatgaatgaatgctgaataattaaggttgaactttatagatagtggagaggtagagtgtgttttagagcagtaatttgagaagctgaactttctaaagaatatagctggcattaccgggtaaaaagaaacagtggaaagagctcatactggaattagactatcagagggtgctttcctggtatgtgccattgaatttgaaatctggcagtttatgtgaatcacttgggagcttttcagtatggttgagttctaggccttattctttggagtttatgattgggtagatgtggggcggttccaaggatttggattttgattgtgatattttgccatgtctgagaaccactgatgaaagtgagaaataacagaggcccggcttcatttctgtgtggaaatggagggcagggaatgcacttaagaaatattgcagagacatagttgagtaaacttgggaatatattttttccccatagtaggaaagaatgaaagctgaaaccaggctttcaaaccataaaactgtgaagatggtgatatcatcagtgaagtagtggtgtttcttggcacctgacaaagatgatcaaatgcactttggatggacagagagtacgtggaagtaggttgaacactagtagttctatctagcagagaattctacaggagcttggaaaagagggcagaactggagataaagacttcaaagttaattattataaaggaggttataataatagtggtgaagatgataaaataatactaactataacgaaaaaactaccatttatgtgccaggctagtgataataaattcatatgtaacatgtcatatcatttttatagaaactctgaaaaacacccgatttacagaaaaaaaaagttggggctcttagaagttagtttgcctgtgatcaaacagctattatgtatgatatgtatatttaacatctctagcgcctgactcacttctccaagaaagtctttgtgcattagaaacagaacagggaagaaacgtcagctacatttttttttttttgacaatcttagttaaaagagaaaatgacaacttggagcaagtggctttttaaacagtattaaatgcttcagagaagtaaattagtatcaaaacttgggaaaatctactggctttggtcattaggaggtcattaacaaccttggaggttagaattaagtgaaatggagatggaaaaagatgaattacaaggcattagaagtttgttttcagagaccaggagagattgggtgtagcagctctattaggttggtggtggtcatggaaagaataaacaggtggctgtgtttgaatgttcagggtgaaaatgtccatacacttagaatatggaaatagccttggaagaatctggttgttagaccactttaaagtgttattgaagttggctttaattcaggttgctggcttctaagaataggaaaaacaataggagtatgtggcaggtgcagaggttggatagataatgatgtgtctctctattgtatgctatggccattaggaagcaaaagaggatggatattagaaaggcaaaagaatgtcttttcctagaaaaagcagatttcttaagcctctaaatttcagagaaaagagtatgaatatgttaggaaaagcatatgaaataccaaatgatctaaagagctacagaagctgagttgtgaatatatcctggaaacgccttagatcgaagaaaatgttcaccatcagctattgactcaacctcagagattgtccatttatgaagaagcatcccagatttcacctagtattaataattcctgagatttttgttctaaattgtatcattttaataatacttttacattttaattgaaatataattaacataccataaaattcacccttttaaagtgtacaatatagtggtttctagaatatttgcaaggttgtggaactatcaccactatctaattccagaatattttccttacccccaaaagaaaccccatacataatagcaatcattctccaattttctcatctctaggcttactgtctgcacagtgtttccacagatttgcttattgtcgacatgttatgtaaactgaattatataatatatgacctttgtgcctggcttctttcctttagcctcctatttttgaggctcatcaatgttgtagcatttataaatatttcatttcgttttatggctgaataatatgctattttatgcatataccacattttgtttatccattcatcccttgatgggcatttgggtgtttctactttttgtcaatcatgaataatgctactatgagcattagtacacaagttttcttttatgaacatatgttttcatttctcttggtatgtatagtccaccaaggagtggaatcgtttagttgcatggtaacgctaagttcaattttttgagcaacttgccaaattattttctaatactactgcaccatttttctttccctccagcagtatgaagattccagtttctccacatctttgctaattcttgttgtttttttatctttgtgattatagccatggtagtgagtgtgaagtggtatcttcttgtggagataccacatgtctaatgattttagagatgtgcatttttctagtatgactcatgatgttgagcatcttttcatgtacttggtggccctcatatagcttctttggagaaatatctattcagatctttgcccatcttgggctatttgcatttgtctttttattattgagttataatagttttttatatattctggatattagagtcttactagatatatgatttgaaaaaattttcttccattctgtgaaatgtcttttcagttttttgatggtgtgctttgaagcacaaaagtttttaattttgaggaagtcaaatgtatttgtttttattttggtttcttgctcttctggtgtcatatctaagaaatgattgcctaatccaaaagcacacatatttatgcctgtattttcttctgagagttttctagtttttacttctatatttatagatttttgatcaatttttagttaattttcatatatggtaggcatccaactacattcttttgtatgtggatagccaattgtttcaacactatcttcaaagatccattgatagaaatgtaagggttatttggggaatcttaattctattctattaatcaaaatgtctgtgtgtctatccttatatcattattagactgttttgattacagtagctttgtggtaaattttgaaataactcttttattcttaactactataacatttatggttgccattttaaagtttgtgtttttaaaataatgtagttaggtaaatttatttgttcatttatgttcttagttaatcatcttgactgaaaatttacttgatagggttttttagcctctaatttctctgaatggagacagaggaaaagtgcctagctgcctacaatctgtttgaacagaaattgacgactgagattatacaaattctagaaaaaataaaacattacccagcatttcgcatctacaatttgaatattattgctgctaattatactctaaaagttattttaactttaacatttatagaaacacgtgtgtagcatgaaaagaaatgctttgggtatatattgtatttctagccacactcatgcaattatgcaaatgtgaaacttgctctgttgaacagcatgatatcactttactttttattaatttgaaagaatacatctagataaattggagttagatgttaaaaaaagctgagtgttgttgctaaacttgggtgtgtgtgtgtatgtctgtgtgtgtctgtgtgtgacagagataaagagagaaaagaatactaatgaaacttattttctaatatattcctcttttctaagataggaatgtgaatataaaatatgcaaacaatatatgcactgtctaaccaagaaggtgtgtattcatggcattatgatagctaaagtataaacgtagctgacatgatccaatatgtgattcataatgttttacagacaatattttgttaggcatttggaaaaaggaaaacacctaataataaagatgtgtatatatatatatatatatatatatattttccttcattctctcagtactattttctatttgatgtgcatatgatacatttataaatgcatatacttacataaaaaagtatttatataatttatgatgggattcagggttttttggtccagatagacatccaccaagctctaggtaataacataacctttgtctccttaggacaaaaagtgacttttcaaaaacaaaagttgtgttttatacatgataatcaggacaatacactatagttagttgtttctctttcaggttcactgtatagggaaaggcatattaacactacttagattgcgtccctttctctcaacatcattgcttgtctctaatgggctgccatctccagtccacatgtaggagtttgggtggggcaggttccatatttggtcaaaacaatcttattttactcatgtggaacatagacatataaaattttatgctaattatgcaaatattattttcatgtataatttatgaatgttttgaaaatcctctgtaaagtgtggaaaatgttttgaattgcatactgttctttaagctaactcataattatgttatgtggaacttaccaagtatactagtgcagcatgtatttagttttcattaatttggaaaaaacatactttgctacattgtacatttgtcattcaaagtcattataacaaatgccattaaaggctagattgcctggtatgttaatggtcccaggttacattgtttgttggcatagggcctggtcattgctcttttccatcctcataatggagaccatctccaggatgcattactggagcctggtctgacctgagggcaccaatggagatggagatggcacaagaagcattccttttccaccatcccagtttggctgtgccacacgtgggtttgcgtatcacctactttcagcattaccaaaataggaatgcagctgccttcgttacagggaggtgataaaaaccgcatgctgagctgatattgtaaagaacatcctattaaatttcattgtattgtttttgttatatacttttaaagatttttaaaatatattattttaaaaattaatattttaaatttaaaatttaaattaatattattttttaaagtatattatatatttttgaaataaatgtcaatgggaaactcaggtcctaactctgtgctatttaatattccatgatataactgcgtattagtggaacgctgtctctaaaaggtgaactaataatagtcactgcttattgatatatttttacagaggttccttaggagacagaatattttaagctggtagtggtgaagatgattgaattttctttttaaatggagggggcttacgcattcttagcttattttagaaatcctactctggggatcatgcacatttgcattgaattccatggcataaaaaggaagttaattcacaccttttcacactagtctagtttataacacctttgtagcacacattaaaattttttaaattggtgaactcacatttttttctcaagtgtgcctgaatttggtttattatgtgtggcaaagagtagaaagaatatatgtcatactttgctttttctgaagttatgccgtatcctgaagttatatttttcttcttcttctttcgctctgggattccagcttcatgctagtgctattaagagctattagcatataggtccttcagtcctttcatatatttatttcagttattttaattaagcactgttttatttacttgcgttctgtttattttctgcctctctcagtgaaatagtaaactccataagggtatggacttgcagtaatcataaaggatataacagaacatattaaaatgtaaatatttttgggcagttggggagagcaaggatttaagtgagggaatgacttgattggatttacattttaattttggaaatgatcttgatggtctggtggtggtggtgttgtaggactttctccttagctaaaagccgggttgtcacacgatcatgaaatatttggcttgcagaccctttgaagggtgagaaaaattgaatttattgggtgaaaaggaaaaaaaaaaaggaaacagggactctcagcaaagcgagagtcctcctagctggtttcccacctcaggttgaatctcaggtactatccaggaagaggaggggccagactcctccccactgcaaatggacgaacttcctgaggccccaccccagtgcacactcctctctcagtgtgcggtccagtcagaagttctccagggacccctttatacttggctgtctcagtgagagcatgtctgggcaggaagaagacttagaaagttgatgcagtaagagatgatggcctgatttaggatattggtggtaggctggaaactcgcagaagtatttaagcaattattcaggaggtagatagaacctttgaggcttggtgcttcactcatgctagtggtaagtgaaaagaagagtcaaggttattctcaggctttgtgcaattgttgaagtcatacaggaggagaaatggttattttgtatagtaaacaagtaactcagttacaaatttgtttcatgtgaggttcttgaaagctttcaagaagaaacatacaggaggttgttggagataggaatttagagctcagtggagagatctctgcgtgtttaggtttattgatgcataaatggttattgagaccatagtaaaagagattttccaggaaaaatatagacagaataggggattaagactagagccctgaggatctttaacatacatagaataagcagatgaaacagcccgaaaagacaaaatgaaggagtagccacaaagatatgcagtgaaccaggtgagtggggtgccctgagaatgtatccagaagtctgtgggcaatggtgccagataatacagaagaagcaagcaggagaagaactaaaagatacctattaaatattaattgaaacaacatttgtctagggtctattatgtgaatgtggtcttcaaacagttccataatgccagctaccagctttcaaagtatttcatgaaaaagttaccaccattaattcctgataacctaatccagattgtgccttctgaccttttccaactttgaaagtttgaagccacaaagaaagacctttcccatgttgcaggagcaaaataaataaaggaagcttttctttatttagatccaaatgcatgatttataaaaaacactctttgttatgaaaaatgatttcattaagagaaaaatggaaatttttttaatgttgccaaacaaagtggctctccactattattttcagggaagtcaaatctattgcatattgaaattgtatattgatatgcagatacccaaaagatgaaatgctgacacactcagctggtttctttcattttactttcttgttgttggctctgcacctagggaggcagtcatatgagataattatgattatttgagtgaaagaaaatacaatactttttataaaatgatgaaaaaatgtaactggaaaaactctaggaaaaaatgaaagtccaattataatattattttcttatctttttttgggtactcagtttcaatttatatgtgcccggtgtgataatatgaaataccttttgagttatactctcttttgaaattgaatcctactttaacttcttgttgctagaattccttctatatttacaactctcattaacagtatatgttaaaacagatatggcatctttatgatttaatcaatgaaactcatgataaaatatcaaatgttcaacgttgacaagaacgtaaatgaaaacaagatactagacccaacaaatacacatttgggtaaacatatagagaaagcataacacattcaataaagtagatactttaacaactgccactgaggaagtaaatgattctcttggtagaagagaaaattaagttggaagaaggaaatgtatttgacttaaataccttaacaaggaactcaacgagctttgtgattgcatgagggcaatttaatgaagtcctgtggttcctttgctgttgttgttgaagttgttgtcatttgtaatgtgatctctttgcctaatggattttatctcttcttttcttcaaaagatggaattttccttgatttttaaaataaatcttaaactggcacttttagctatttgtaatgtattttatctatttctacatttactagatatgagacttaatatgactaatgctgagtagtctctttgacttcacctgagtaagcctttgagattcacattttatgccattgctccaacaggaagacccttctacctagactacccttcccttatttttctttcatatttctgcccaaatatgtaagggccaactcaactgttgttgttcttgtatagccttcacctctcatcccagtcaaaatgagtttcaccttcctctttattctggtttgatgacccttcctccccatacaagtagaagcagcaatgttagatgagttccctggagttgcagcctgagattgggtgggcattgcttgtgttgagaccacagaaggtagagccaagggatgtattccacaatacagcatagtgggaaagagccaaactcggataatgaatcatcaacttgaatggttaaaatttcagggaccatccaaactggaggctctaatcaggaaaaaatggtttgaaattgagggagaaagttggtacctgaagacaaattactgagccagagaagactggactatttttagagaatgcctgcagacttggcagggcagaaggtagacattgaagaccttgaccacaggaggacaccgaatctttgtttaattcatcatgtaacacttattacagtatttcaccatggattgtaggttggtaaatttttttctcacctggtatattgccaatgtctccaaagtcatgttttcagtgttctctcctttgtatctattccccaagcagtataatgtctggcacatcgtaagtgctaaataaatattatttcagagttattcttattatgtaaatttatagctaactctcattctgaactgtactttcctgtacatgcccccagtgaagtttagtcataatttcccattttttcaatttataaaagtaccttcagcctgggcatggtggctcacacctgtaatcccagcactttgggaggcccaggtgggcagatcaccagaggtcaggagttcaagaccagcctggccaacatggtgaaaccccgtctctactaaaaatgcaaaaaattagccagtagtggtggcacgtgcctgtagtcccagctactcaagaggctgaggtgggaaattgaacctgggaagcagaggttgcagtgagccaagattgcgccactgcactccacctgggtgacagagtgagactccctctcaaaaaaagaaaagtaacgaaaagaaaaggaaagaaaagaaaagaaccttcaggtttataattaaagaattcatgatgaaataaaaaacaatatttcattattgagtaaatattgaacccattttgtatttaaatatcacatagggccaggcacggtggctcacacctgtaatcccagcactttgggaggctgaggtgggtggatcacctgagctcaggagttcgagaccagcctgggcaacatggcaacattctgtttctacaaaaaaaaaaaaaaaaaaaaaaaaaaaaagccaggcatgatggtatgtgctcatagtcctagccactgaggaggctgatacgggaggattgcttcagcccaggaagtaaaggttgcagtgaggtgagatcatacccctgcactacagccttggttacagagcaagaccccgtctcaaaaaaataaaaatgacataatattaacgtttctatttttatatgaagaagtctatttaatcattcattgatttattttttcaaatcacttcttactgtgtcttgagaattttacagaaaacactattattgcttctttcaccagccagaagagaaagcatgattgtgttaggtagcgtgacaggtgaatgcacagtgaatgacaggagtccttgtgggagtagctgttctctcagggagaggttaaggagtccattttagctaagtagatgaatgaacagggtcggctggggggtcttgaggtatgaatgcatacggctataagggaaatggttcagtagctgaatgtcctgaggactgagaaacgatggaagatagtaaatgcagagaggggacaggtcatgaaaacatgccatactaaacagtttgagttttattctttgccttgagaagcactgaaggatatatgaagggattcaggtacctttcttgtattctttgctgctttaccttctacttaatttttgatttccaactcacaggtgctagtaggatctgtcaggtcttaccacagcagcaatgtaggacttgataccagcgccaaaaatgtaactaccaaagtcacttaagtgtggtatttgcactggaaactctatttccccatttaataactcctttggcatatttgaattcagtgtcagatttaaaacatatgtaggctcaggctttacttttttaagtaagttaaatataaaatattacaaatactttttatgccaaatctctttggaaattgaatgtactgatatttattgtggagatacctcagccatacattctaaaagctaaactaacatagctaaactaaaatgtgactgtggtctattatgactaatttatttgcaattgtgtcctcctgaatgcagtaaatagaaatcattatgaacagtcctcatagtacaacagcattaccttataatatttagagaatttattctatatcttgactccttaatgtcttaaaccagaacttcaatgtggtgaataaatttgtatccacatgcatcaattatattgcaattacggtagatggatttctcagtaaccctaaagagatggatttctaagttacccactgtaatatattatttcttgaaaagctttcaggaatataacttcatcactgtctccagtggaccaggtcagtgttttattcctcttgcagccagttttctctctgataatatagctagtttctcttatgtatcttttgggaaagctcttaaaatcacagtctcaggtgtttagcaggtgcctagaaatgatttttttctttaaacatttctgggatatatgatgaaatattcttgatggaccctttgtaaatgtggaaaagaatttcttccaaatgattgttgtttacaaattgttgtcatccaatttagataagggaattaagaatctgtacatgaaatttgccgattgtaacctatcagcataggagattatgacagtacttgtatatcacactaggaataattgacactaggtttagaattcagaacacttttataaagaggaaaaaagatgagaaactcattttattgggggtattcagaaaactatactttagaataacatttagctataaatttacaaaatgaggatagcccactatgtgtttactaaattaaaaaaagaaaacagattcagagatcattgcagaggaaaatagagcatgaattagtcagctcttttctatggcatgaaatatgtagattaaatgtcatacagagttacaaatacaatgaaataatatactcctgccctcaggagaccacagcagagaaaatgtaaatatgaaacatccaaactccaaagtatgtatattgtttacattcatatgccaaagtgatgtgcctgctattgagttctgtgcctgtgtggcttcttgaaaagaccaaatgtttgcaatattttatatctgcagtgataacaacccaatttgttttcttctgaactatctcttttatgaatagcctagaaaaatgtggttcactaaatcattagaagcactgattctggaggattatgcatcatagtatgctacttggttttttggcttaaattatttcaacatggtaaaaggaaatgggcctgttttccatttctcatttggaatggtcagtaacaagtgtcttaccttggaaattgtatctatcattcttgtagtcacccacacttttgtacttggctccccaccatcccaaccatctgttacaatgaattataatttcagaacaggaaagggactatagttaattgtcttctgagatatgaatcccctttaaatgatccctgatagatacccagagtgtgctgtcaatacctggaatgacagggagcatcctaagtcctttcaaatcttgcttcctgctattttctttgttcctttctttttgtcttttcagcttttaaactgatattgataattatcatgcctggatgtctgcatatagcttcctaactgatctttcttctccatttttttcccctggaatatcttgacaccacactttaactaaaattccaaaaacactttggtcatattcctaccttaatcagaaaccttcaataattccccatagcctgcaggatacagtcagaactcattaacttgagttaatctggtcccaacatgtttaacttcacctttcagcttcctcagccatttacttggccttagttgatctactcacttttattgaaattatattgttttttcttgttcaatgcttttggagatgctatttcccttacctttccctctttcactatgaccaccttcttattttagtactgtctatacttgaagaccctagtcagtccttctttttggtagctgcctgcagaacactgcccatactgtgatgtctttgttttctgaactcccagcgtgcccattttcggcctcattgatttggtgcttaattatgagctgaattgtgacagtttttgtattgttttattgaactttagtttatcttttgtattgacgtttaatttttcacactttttaacttggctgtcttccagtaattttatgagatggcatgataaagcagatggttttcaagtagtattcaaccaaccttgagcgatttctgtacgtcttgctggggaagggaaagggagtggactgagacttgtggtctccaccagcttcaagcagaacatctctgctttgattttcgttttatactgaacttctgtatttgattatttttgagaaaaataagttaagctgaaaatgtttgaaaactatagatgtggaggagaagaacctggacttggaataaaggtacttgggttttatttctggctctgctccttgctgccctgggctttagtttcctcatttaaaaaaaattataagccaggtgcagtggctcactcctgtaatcccaacactctctgggaggccgaggcgggcagatcacttgaggtcaggagtttgagaccagcctggcaaacatggcaaaatcctgtctctactaaaaatacaaaaattagccatgcgtggtggcccacgcctgtagtcccagctattcaggagcctgaggcactagaatcacttgaacctaagaggtggaggttgcagtgaaccaagatcacgctgctgcattccagcgtgggtgacacactaagactttgtttaaaaaaacaaaaaattataaggccagtgtatatgatcttacattccttttattgtaaaagtctgtgatgatcagaaaattagctttattaaaatagagtgacatttattcttaattttaaatttcttttttctgagaagggtatgtttacataggaagttctgttaccaagtggtttgcagtttttagttgctgccacggccagaatgtttcacatatggcacattaattatatgataattaaatatgaaaaattcaaattacatttcacttttgtcttgatcaaaacactctatacggcatttccttgccttttgttcctccataccgcttatgaactcttcattagcgtcagactggaaatctttatctattttttaaaacaagaagaattttaaaacaaaattactgttggatgttcaagtaataaaaaccgtgaaggctgaatctgtgtaaagcaagagaatgctattccttacaacgaactttttttgtcaatatccttttcaaagtaggaagtctccataacgataggcaacaagtgtcatcgccaatgctgacaacacatatcttactggtaagttttatttgttcctagcctcatacccaaatgcaattaaagatatctcctgtattgtcactgcaggagaattttatttgaaaagtggactaacttaaagcctgaaatatacctagtctgaagtctgtaagttacaatttgactcaaacagaagccatagtgaaacagatgaacacctgaaattcagcagacattagcagcatgctgctattcagcaggtttcagctgcaaaccaaattctactgatgagggactcacatttccaataaattaaacatagaaccacgatttttaaaattcctgttttacacttttattttagaaaactaaacagaaaacctttaacaacacaagaaaataataataaatattttgtgtataactatataagctgcttcagattatcttaaataatagtatcttcatttcatggaaattaatgggggtgttttcatgttgatagcacttgtgaattggtggtataaggcctactcctctaggtcctggcatttattacagaaataacctaccagaaatttttggatgtcttaagagcagtgtggattctttccaaattccaagaaatagtctttattgatcaacacttgcacattcctctcaagcaagattgtcttgttcaggaagggaattatggagacattgctgaaaacccggtcattgaaaattgttttaaaaatgttcagagattctgtaaagtgattcagtcagtcagtcttctgtaagcatctggtcacattcactagcagagacaaggaaaagtattgatgtctcactgtggaagcaaaacattcaatccaatgtttcctttctgatctttgatcagctacatcaaacattttgaaaggaacattttctttttcttttcttcttttaacatttattttaggttcagggatacatgtgcaggtttgtcctataagtaaattacgtgtcatgggggtttggtgtacagattatttcatcacccgtaataagcatagtactcaaaaggtagtttttcagtcctcaccccccttccaccctccaccctcaagtaggctcctgtatctgttgttcttttctttgtgtccatgtgtattcaatgtttaactaccacttttaagtgagaacatgtggtatttggttttctgttcctgtgtttgctcgcttagggtaatgacctccagctcaatccatgctgctgcagaggacatgatctccttcatttttatggctgtgtagtattacgtggtacgtatgtaccacaatttctttatccagtctgtcattggtgggcatttagtttgattccatgtctgtgctttcatgagtagggctgcagtgaacatacatgtgaatgtatctttatggtagaatgatttgtatccctttaggtgtatatccaaaatgagattgctgggtgaaatggttattctgttttaagttatttgagaagttgctacactgctttccaaaatggctaagctaatttacattcccaccagctgtgtataagtgttcccttttctttctaatctcaccatcatttattttctgactttgtaataatagccattctgactagtgtgagatggtatcttgctgtagttctgatttgcagtttttgaatgattagtgatgttgagaattttttcatatgcttgttggtttcgtgtatgtcttcttttgaaaagcgttggttcgtgtcctttgcccactttttggtgaagtcatttgttttttgcttgtttatttctttaagtttgaaagaaacatgttcagtttcaatgttgtacatgaatgctgttggtgggcttctggcaagcagaatcctatgatggaatgtaatctggttctcgaagtttatccattatcactaaatatttttacatgttcacccagttgaaatatccacactggttatagggattcctcatgcctgtgtctgcccataacattctcatagcagaaagatgttataaacaaaataaaacaaccttgaggttccaccatttcctggttccctgtgcctccttgggtgacaggatgtcaaatgccatcgtgttgtctccactgagttggtttgaatgccctcctcaaggaatatgaaacttccttttttctctactggcatcctcatacttttgatctcgttgctatagagagtggggtgaaattcgtcatgtgtgcacaggtcaaaatcctgccagtggattatccacagtggcttcaggaaggtggaattgctgctgtctctatgcccatagcaggatcttcacaggctgcttgatgtaggcctgtcttttcccaggacagacacttgtccatcaccttggacttgctgctgcacatcgcaatactcatcacaatgcagctaagtgcatgcaaagtgtagacagaaaaagcaggaagccctgataatttattttttattccaaacaatattaaccaatggaaagagcctgcttggattgaagtacaagagtatctgttgtagagaaattgatctggacttaaatgctggctctacaaatgaagaagcctggccaagttactaaaccttattgaacctcaatttccttatctgcaaaagacagataatcttaactatctctcaggactgctgtgaacaccaaatgagaatattagtctaaagcggttagcccagtgactggctcttaggtatctggactatttcaccaccttttgttccctgtaattattcatttcctttttttggacttacttatgaatgactttggacttttttcaaaaatcagacacttaaaagatgaagtttgtcaccattcaggctccaaaaacatttctaaatgatatccaaaatttagtggtggcaatttcaatggaatagattccaaataaatacatatttagatgtctagctgtgtttgctctgttagaaatcaatcgaatttacctgagagaagggagaagaattttacaaaaagagttaaaggagagtttatgggaatgaaaatttcaccttttttgatgtcttgttttgagtggtaattgtatcagtgtatatagctttcaaaactcaatgaactaaatatctattctttttaattttatcttacctgtagctcggttttttaaagtacccatgttgcttaaaatattattcaaaaaagttatagtctctatttcactttgattctgtaaggacttcataacaagagtctcatcgatttgttagttgaggctcatatatttaagtgctgcttgtaagactaggtattagtatgccaaattaaatttatggggcgtgtggggtgtgtatgcttcttgttagacgatatcactcatttttagtgtttgcttttctctcatgctagaacctgtaacttcactctacattggccccattgtgaaatacttagaacaattgtttcttgagtttaaataaaaagtcttatgcatttacaatgtattttaaaataaattatcgtttttcatccataagtgaagaaggtcagggattgttctctgccaaggaatgactttactatggatcatttgagaaagaaaggcctactaaaaactattcgagcataacatccagtttaacataaacacgttttacttaagttagtgaaaatgtgaggatagaagtttgcagccatgttcttcatgggggttttatgttttaagttttctttaagcttgtaacagttcattattttctctttgatctatctagcagttgaatcaaagttagttaaaattttcatgtgagaaccatagttcacttgcttaattcatgtgttttagatagtattaagatactgtgttcatctgaaagttcttataactggactctaagaaatatatattcctggtatgattgttgtttactacccccaagtagtttcaaaatgtttaatgccttcttcattctgtgaataaatgacgtatgttaacttttattctatttatttttccagataagcatttttaatattatattagttacatcaaaatatatttagaaattaaacaatgtaagtttagtcaagtttcatgagataatgatttatatcgaagacatggttttcattttgaaatgttattttgggtcactttacaatgatatgacaagttacaagcaaataagtgatgtctaccttttgatgcttgaaggaggctattacaaattatttcaggcttcaaaaattgcacaaaaataataaagtaaatggtataatatttttattgttgggagaattacccctatccattctaaatttttttttgtagatagtctaagtattatcttaaaatgttaattactttggtgctttaaaataacagtgactttttcctcccatgattttgaaaccttattaggtcaggtgtataaaagtaagtgacattttaaggtgttgccaactcaatagtgctgtctctttgcatgtgtttgtgaaaccgtttccttcttgaaatcccttgcaagtgaatacatttactgttctaaaaatgagaaaatctgagtctaattcattccctatgtttaggaagaagttgattatgtgtccttttaatccaatacctttactgaaaataataactttttataaattcatttgataactgaaaagtattcaaacagattatttaaacaaagctcatacgtgtgaatgttggttgtcactgccttcaataaggaataatcactgaggtgcaaaaattaccgattcttatgtggaatagtgggcacagacagcccaacatttgaatgaaaattgtaaatgaacgaaagctattataacacttcatagcaacatctaactggctctgtaactagaagtacatatttgattacttattttgctctgtaaatgtcctgtttagatatttggtgtgttttttttcctattagttaataggtctttttttaatatgtagaatttcattatattttcaagataatatccctttgtatgttatataaggttcgaatatttcctcccagagaataacctgccatttattctttaacggtatattcagacactaatactttcaagatagtgaattaataattattttaacttaccttttgtgggtttctttttcaggcaaaggctgtcttgtttaggaatagtttataatcttaaagaaaggaaactattctatattctcctcaaagtttaaatttttcattacatgtaagtctatgatttatttagaatatatttttttctgtatgggtgaagtagggatctgattattttttattgtttgggtaaccagttgtctcagtagcatttgaagactattttctcccagttcatttgccctgcactctctgccttacattggctttctatatagcacaggcctgttcctggactctctattctgtttccggggcctgtttgacagtctccaagtcactaaagtttgtcttaactaaagtttgctatagctttatatttaaccttaatattcagctgggtatgttttgaatattatctccttccttccctgtagtctttttgtgtcttaaatgtggggcctctaaatagtatatatctgttcatttaaaaaccatcctggcattctctgccttataactattattttagtctacttacatcatgttgtttggtattcctgtcatatttgacattactactaataacttaggttgttcatccttcattcctcccttccttcctcctttcttccttccttttttctcttttctttccttttcttcctcctctttctttccttcctccctttattccttttttccttttttctttccttgtctttccttccttcctttccttctcttttttctttttcttaatttccttccttccttcctttcttccttccttcctccttccctccctccctctatcccttcccttcccttccttccctccctccctcgcttccttccttccttccttccttcccctgctacttattttcttcctagaattctaatcattttttttatctgctacctggatcccccctgtggccctagaatgaggttcaccactttttcaaggttttatgaaggatttaattctgtgtttaaaggggcttacaggtagaattagacacctgaacttctctatcggtgggacagtttaatataatctttcctcaccctccctttgtcattcaaattaaatattttaacattaagcttttaaaatataaatgtatttgcttggggtgcaggacagtatgatctaacctccaaatctttggttgctcttaagcacaagtaaaggacattttttattttattttttcgagatggagttcactcttgttgcccaggctggagtgccatggcacgatcttggctcactgcaacctcctcctcctgggttcaagcgattctcctgcctcagcctcccgaatagctgggattacaggcatgtaccaccacgcctggctaattttgtatttttagtagagacggggtttctccatgttggtcaggctggtcttaaactcctgacctcaggggatccacctgcctcggccttccaaagtgccgggattacaggtgtgagccaccgcacctggcctcaagtgaaggacatttcttctgaacaaagttgccacaagctcggagaccatctgacactgaaaaaggaaaatttaatggcaaatgctcttctcttggatgttaccacagacctcttcactgtttcaggaaatgcaagtagggtctgagctggtcctatggtcaagaggtgtccattgtagcaaccccatctcttgattagatattggaatgcagtgttttttaggatctatttcttgatctcaacgttggagaaactttctccagatgggagattgtcctgtattatctgggtgggcccaatctaatcatgaatcctgacaagcagagaacctttccttattgtggtcagagggcgaggtaattacagaagaaggatcacaaagatctgatgtgaaaagtacttcacccactgctattggctttgagttggaaaagggctgtgcgccaaagaatgcagtggtggaagccggaatgactcttagctgacggccggcaagaaaatgcaaatagtcctacaacttcaaggaactgaattcagccaacaactccaatgagcaaggaaatggatttttccctagagcctccagaaaaaaatgaaagtggtaactttagcctggtaagacccacgctggacttcttctgacctagagaactgtaaagtaacaaatttgcattgcttaacttgttccttttgtggtaatttgttgtggccacagtataaaaccaataccaaatataattatttttctttttaaatagtcatagagacaaaggagaaatataaggaaatgtatgaagacaagtgatccttagtaaaactttttcttatgtgaagaagaccaaagctctggttgacctttgtaatctgagctcagtaatcattttcctagagtagtatttcctgatgaatggataatggtgacaaattgctactggtatatatgcatgagaaaaaaaatcagaaacctcaattcaagtcaaaattcatttatagctttgcattttaatgtggagtacttgattttaccaccatgtttccttttctgtcaaaaaagaagctatatttaacctgtttctccaaggaattttagttggttaccttcttaatagctactctgaaaagcaaaatgctattaggattcccttacgttattgccaagatgaatgtatcatggctgacctttcatttggaaattaagtcccttggtaatcttgttaaacattccccttggagcatgtcactcagagaaggatcaaatatatggtcctgtggttattcttaacattatgctggtgaagataaatttatgaaaacttattttagttttggctgggcgcagtggctcttgcctttaatcccagcactttgggaggccaaggcaggtggactgcttgaggtcaggagttagagaccagcctggccaacatggtgaaaccccatctctactaacatacagaaattagctgggcatggtggtggatgcctgtaatcgcagctactagggaggttgaggcaggagaattgcttgaaccctggaggcagaggttgcagtgaaccaagatggtaccactgtactccggcctggaggacagaggaagactctatctcaaaagaaaaaaaaaaggtaacatactagtttctgcttatgactttgattttgcctcttcccatttttttcacctaatagtgattagccatttctgtacaaaacatcttaatattcataagcctgttcacaacagtatgccttttcattatcagcaatagaaaaagaaggcctagagaaaaatagattgaaggtatgcatacaaaactgaaaaggaacgagtggcgtaatcacatttattattatgactaaatcattcttctggcaaaaagaaacctaaagtatttcaaataaatgttttaaattctaaatgttatgctaactttcacattttgtttctttcttaatctaactcattctgttatgatttggggaaggcagtcaatatggtgcctttactttggtgtgcaaatacagaactgaaaaatgtataagaatgaagaaatacagctgtaggtattaacctgataaccagcatgagagataatatacacagactgtaagaaaaccatgtagtctagactataatttaaaagggggttctggactagttaagaatgtgagccttgtgccagcctgcctcatactggctacttgatttgggggaattttttaaacttggcagaatgcctccgtgtgtaaaatgggcattataattgtacttaactttctatcattgtcataagaattaaatatgttaacatgtaaaaccttagaatatttccaggcacaaggtaaatactcagtaaatgttgactattattttaagttttaattttaaatgtgttcaaacgtacacaagagtagagagttgcttatatcagtatctggatcctttttagtaattacctaccatatacatatcatatagatgctagaactacacaaactttaccatgttttagatgtctctcttttttctcttacctttttctgaatattttaaagctcccattttatctccgcatgctcaaatatggatctcttaaaaatatggaatatgggcttaagaaaaccttgatgccattttcccaccttacgaaatgaaaagtaatttctccttggtgtctaatgctcaaaccacaattagattcttttctaatttgttttaaatatatatatatttgtagctgttggttggaatcagaatccatccaagttccacatattgcatgtgccatatcttctaggtttttctgccttcttccctcttttcaatgccaggtttgttcaggtataattaacattcagtaaaatgtatttcttctaggtgcacagttctgtggattgtaacaaatgtatgcaatcaatgtaaccactatcataatgaggaaattttctcatgcttttttaagttcatcctttccccactcaccttagtttcttgcagccacaaatctgtttttctgaccctgtagttttgtgtatctcttccagaatatgataaaaatggagtcatgtaatgtgttgtgttttgagtctagcttctttcactgagcataattatttttgaattcaccatgttattgtatattagtagcttgttcccttttcatggcttagcattattctaccacatggttgttgccacagtttgtttatctagtcatcagttgatgaacttttgggctgttttgtcatttggcttgttttgtgtgattataaataaatctgatatacacacatatatatatatataaaatatatatatcaacaaaggaagactttgcctcatctactcagactacctgtttatcctatggttcatataaaaaagtttatacagaaaaattagaattgctaatttctagaggatggtttcctagaagtatccagtcataattaatgggtagttgtgattttttttcttgttgtctttttcttttagtgtcattatgaattcctgggtttttcatatattcagtgtgtttcagtcaattttagtgattcttgttgatatatatatatgtttttgtgtggatgtatatctcatttcttttgggtaaatgcctaggagtattgacctaggtttactaggctgtgtggttagtgtatgtttagccttatgcaaaaccaccgaactgttttccagggtggctatgtcattttgcatctccaaagccatatacgatcatttcaattgctctacatctttgccagtacttgttattttcggtaattaaaaataattatttaaccattttaataggtatgaagtggtatctcatagtttaatttgcatttcctaattactaatgacttggagactcttatagtgtccttgcttttcgtagaccttttggtcaagacttctccaaaacatttgtttttccattacattgactgaggaaactgaaatggatgtcctatttttttcttcattgttttctttaacctgatctttgagcattcattattcccataaactggaaatacgcttgtaacacttggttatatttcaagtttgcttgttttgaggaaatgctttgtaggctatttatttcacattacatcacttaggagacatgaatgtctgattgacattgtgttcagatgctgcctccatcgtaaagttgcccgtcaactctttatctagttaccgtttcctaaattgattatttcattgggtgctacaaaatagtgatgcattctaattttactcttcctctggatttatcagtaggatttcttctgtaaaggaagactttgcctcatctactcagactacctgtttatcctatggttcataaaaagaggttatacagaaaaattagaattgctaatttctggaggatggtttcctagaagtatccagccataattaatgggtagttgtggtgattttttttcttgttgtctttttcttttagtgtcattatgaattcctgggtttttaatatattcagtgtgtttcagtcaattttagtgattcttgttgatattcaaatttaggatataatgagataaaaaataaaaatgtagaagcaggtagattttctttttttttttttttctttttttgacggagtcttgctcttgtcgcccaggctggagtgcaatggcacgatttcagctcgctgtaatctctgcctcctaggttcaagagattctccttcctcagcctcccaaagggagtacaggcacacaccaccacgtccggctaatttttatatttttagtagagatggggtttcaccatgttgtccaggctggtctcgaactcctgaccttaggtgatccatctgcctcagcctcccaaagtgttgggattacaggcgtgagccaccgcacccggcgcaagcagattttcatatgcacttgaaaccagtttattttctggctctgtgtatgcaccagtctcacatagacatccggaacaattttttaaaagctggtagttttaaaagctggtagtattttatggggtttatatgaattaatgatttggggaaaagtgttcctacttgagaacacgcagtttttcctatctttttgagtctttggatcttccactggtgttcaaatatcttcctcttgcacatttctgtatacatagtttatatttttttggttcctgctataagtgaggtcttttggttcattaaatatacatttgaaaatgcctatcttttagatgtattttcttctgtatatataaaatttttcttttctgtatgttaatgtttacattttctatattacttttatctcttaatgtttgcagtagtttttcaattgtttttcttggttattcagacacttatttacaattagggataattctgccttttcttttctaattgtcctgtctctaattgctttgccttgtttaactgtattggataacacttccaagacaatgttaaataagtagtactgacaatagtggatgtatttttcctatttctgagtttactttatagtatttctggaataaaatttagctattattgttatatatttggcttttattcttataatattattattataatatgtaaaaatggaaacataagattggtttaatatatggtactctgtctcagagctggccaggaacaacaaaaggcttttttacattagaaagtttatcagtgatgagatttttagtttttaaattcctggtaatgaatgcatttgcacagtgtgtgcccttgtctaccctggcctgcactccatgctggcttcctctgctccagcccctccctccctcccccggacaacatggccaacatcccttaggagcaattttctcctcctgcctctggtctacattgcaggtcccttcagtatccatttgctgcccgctttccaagagtgctagctcatccctgggtgctgtttccggggtgtgagctcagcattgtgttctcttagcactcattcaggctggtcactctgagtcacaaccacgcttggagaaagagtgggaagggtaagcattcctggtagatgaacctaaaaaagactcagaaaattgtgagtttaagggcatttgtgacctaaaactctgtgaagaacaaaagtgtcgatgttagtctgaaaccgacccatggagggaaatggaacccctgaaggggttgttggcctctgtggcatcctgtactcctcctttctctctgctgtctgcaccgggtgctgaacactcgtaggcctcagcacatcaccggcttctcctcttctctgtggtgtagtacatcttcaagtactatcaaactgtcaagagtgttgcattcttctgattactttctgtcaagagtgtcacctcctaaaactctgccctcccttcttatttattactgtgagctctgtcagccttgtggtcagatgtgtgataatctggcatctggcttgctgctgcttatttctccgctcggcctctggcaagttccctattctttaactgcatgccagtgttttatgccctattttccttgctcatagtttttcttttctacaaagccttcttcttttaggtgtttaggttttcttttcttttcttttctttttttttagcactttttctttttttgttatgtttctgttttaagtttgaattttatttttaaaccattcacatcatgctatccattacatctagtctcagcttcctctctgttggaaagatttgaattttttttaacttaatgtttaaaattttatttcaacagtttttgggagacaggtggtttttgttacatgaacaagttctttagtggtgatttctgagattttggtacacacatcacctgagcagtgtacactgtacccaatatgtcgtcttttatccctcaccacccccacccttccttctgagtcctcagagttcatcttctcattcttatgcctttgcatcctcatggcttagcttccaattatgagtgagaacatatgatatttggttttccattgctgagttacttcacttaaaataatggcctccaactctatctgagttgctgcaaaggccattgtttcattccattttacggctgcgtagtattccatgatgtatatataccacattttctttatccactcattgtttaataggcatttaggtaggtcccatatttttgcaattgtgaattgtgctgctataaacgtgtgtgcgcgtgtgtcttttttatgtaatgacttatttttctttgggtagatacccagtaatgggatggctggatggaacggtagttctacttttagtcctttaaggaatcttcacactgtttttcaaagtgattgtaccatatttgaattaatttaataggaaagcctgaaagaaaccgtgggctgagttattaaaccccattttaatgagatgaggaagctgaggcaccgagaagttacgtaacatgcccaaggcagagaggcagattcatgcccagccctctggcttcaaagtgtgtgcccttaaccactgtgctgaatgctgcccatgcacacttcctttcttttcattccttccttgccttcctcatccctttcctggcctctttctgtttctcacttctctcgctcttttcctcttttctctttcattccatggcactaatgtccactcttctagtcactgacacacaggtgcataaaaccatcattttccatgctctggtcctcattttatgaggtcctttaccaagtgttgctttctacatcatggctcaaaagccactcagggtgacgctgctaggaatgggagtccagcccaagaatagcaactttttgtaagggcagttcctcagcatcgcctgggtttcctctctaaacccagctcaaactattcatctttctcctcttatactccctgtcaatgccattgcagggcccatttctcaaagaataaactcaataaacacaaaaatgatatgctcacaatctggcccagctcaggtctgtggtcttaatttttttttagtcttgatttaagatcgtttatcttgtgattcctagattcatgattgatggatgcccttcaaagtaaataaagtgatgtcttaaaagcacattatagtaggcttagagacttgccagagaacttttttcagaaagaagggcaggaagattgtttcaggccattctaagatgaacatattcacacatttagtgccaagatcctggggatatggaggaaatgtgtttactgagttttaagggtcttgagtatatctgatatcttcccacatagatttagtgaacaaagactctgaagttccttcattgttttattaacttttgagagtcattactacctctgaacaccatttacatttgtaagacagtatttcacttggacggagcttcagtatcttgttcatcatcttttataatattacttcataccactaatttactgtaagaacagttatttgttgtaataatctttagctttgggttgagctttctggataaagatatacttacatttattttagcattgctatctgtactagtatcatgaaaatatctcgagttcctatcagtctcaaatttcttataactaaatgatatctttgaagttgataatccattccagaaattaattaaaccatagtgtcttatagaatggaaaaaaataagttttctggtaaagtatatggattttttttgaaataaataattgtatagaaaatacactgagaaaaaagccagaataatcactgaggaggaaaaaggatgggaagcaccatccattcaaaaaagtttagagtttcctgtatttatagagcactttttccaagacttgaagcctcttggtgtaggcatagggttaagattgacacacaaaatactgggaaacaagtaatctaggataagcaccgtatagaaagttcacagaataacagatgtagtcaaatggaggtaagaccttttagcctttggcaatttgggtaaattaatgaagggatcataaattgagactattaacagtactcctctcataaggcatttggaggactaaccaggcaaagtgcctagcacttactgagtgctcaatacatgttatcagtgggaataactgaagggcaatggtgtgaaacagtcctagttctgtgttattagctgtacactttcacctgttagctgggaggaatgacattctgtcctgaaatggagcaatctgagcagaatacatgcctgaatagaaggccattacccttttcttctaaagtgatctaaggccgtgccaccagcaggccaaggcagtccaccagaagtggtttttggggtctgtgccactgcttggagagatgattagaaggccagagttctgtataataaaatagatgtctataattttagcctggagaaattacttatcttttctatcgtaaaagaaataattggtcagttttcttcattacaatacccactggcttataaattttctaaatcttacctttatatacttaataaaatgttttaagttgtctccactattgtccttttttttctttaaaaattcattagcctccattgccatttagaaggtaagacatacattattgagaagatctgtttaagactttccccagactagagttagctaaaaacatgagaagttggaaagtatacttaatatgataaagaagaaagtgaattatatgttagacagcactgttgtggattaaggagagaacgatgtatggcctgaatcataggtgctttcctgcagcattttccagatctttttttttcccccccccgagacacgaatttactcctaagagcatcaggacggcgtggaaactaacaaatgactattgaagacttaaatcaaattggtgaagtttactatcgcaccaagctacaggtgtcttctaacttctctctaggaattagataaatgatcttggctagcacaaaaatgttcagcctaaaaatttagttaaaaagcaaagcttggagctccctcttctaggtatacacaatcaaagtcaatgattttactgttgatgacactttgttttccgtaattgttactaggatgtctgagagattaacgtttcacatggtttttccaggggttattatctgttaccggatcatgtgtctcagtttttcttttaagtttaacctcaagggaataaaaacatttctttaaatcccaatgaaaaccgttttcttttgtcatgcctgctgtgactgctcctttgaggaggcgggtgagcttttcctctagcaactttgctgaaacatgtatacttaaccatgctctgctggtccatattttgcaaacatatatatggaaagacttttttcttgttcctgtgttttttgtaatacttttcagggaatgaaacaattgttatattttcaacagttcttcagatactgttcttattttttcaaatatgatgaaaatctcttgcagtttagtctatagaatatcttcagatagtcaggagccatgtgatactttctaagtaatggggagatgattatgataaagtattgatatggagaactttgcttgctgaaggaatgacagggttaaaaaatatccttcctttattctcatctatcattttctcaatttgacacacttccataagtacatatagtcatattttaaaacttacgctttcgtcctttattaaaaaaaaacatcagatttgctgtgttaggatacaaccttttctatggctgacaaagtcctgtttatatgaaatattggcccttttacgtttttttcatgttgcaggtaactagagctgcaataaacattgttgtcttgcaataccagtagtttgcttttccacaacttatctgatgagaaaacagcactgtgttttatctgaaaagcaaatggaaaatgagatattaccaaaaccttttaacatataaaaataactactttaattttgttttcttttcagatgaaaacagcccttcctgaataatcagttttaccattttgttttgttctaagcacaaggactgaatggcagtgaggtgttgtttttctctctcccttcttctgtcttctcttataatgtattttatataatgctttaggagacatgggagatatctttatgttggtgtacaaattcaaatgtccaggctaagaagctgaatgaaagttaaacaacaaggttttgctatttataagaagcaaattactataaatctctactatcaataaatgtggtaatttgaattttccctgtgaaattttaattttaatgacttcatattggataatttaaccattctcgtttgggtcagaatattatttaggaaaggctgtatcaaaagatcatttatatgaaaatgggttgtgaagactatatttataaatgttatcctgtggcattttaaaccatgaccttgaagaccgtattaagacaagtgatatgatagaatgctcctgacattgatgcattatcactcctaatgacttggttgaccataacatagactcattcatgaagactaaccctgagggggaaaaacagcagaatctgtcataagattcatgtttaattctttaaccttcacatctttgctttgtttatggaaatattccagttatgtatttcttacatggagtcccttcacaaccaaatcatacatagaaagagctctgctgctggctggtgctcagggcatcaggtttccatcttatttttagtttttctaatctttctgagcccagaagaccaacagttctgaggggatactggtctcttttaaagtcttagagaaagagaaagagagagcgagaaatgggggtgttgctttctgaaatctaatctgtgtcttacgtatgaggagaatgttaatacatatgttctctttttaatttttttttggtcctgctgcacctgatttgttattttggaagctgttttattttatcggttgtttcttttgaaaaaaaaattttttttttttttttttgaaattgactgctttgtcttttttacattcatttaattttttctcccaaaggatgcttatttgagatggtttccatatttctcctctagattaaaaaattcaatcatttatctttctgttttcctcttacttagtctcactcacacttttctgactgctttgaaagagtgtgaaaagatgaattacttctttttgctttttttttttttttgagatggaattttgctcttgttgcccaggctggagtgcattggcacaatctcggctcactgcaacctctgcctcccgggttcaggcgattctcctgtctcagcctcccgagtagctgggattacaggtgcccaacaccacgcccagctaattttttttttaattttgtatttttagtagagatggggtttcaccatgttgaccaggctgatctcgaactcctgacctcaggtgatccacccgccttggcctcccaaagtgctggaactacaggcatgagccaccatgcctggccgattaattacatcttgtagtgatgccagatgaacacctgatcatgtgggaaaatttcttcattttttatagtgaaatttttctgagatgtggggggtgctttttgtttttttaacttgtttaatttgttcttatcttctccgcattcagcataataacacaacatcacacacataccccacacaaactcttgcctttgtgagtaaaaaacctggcttgtggcatgtaatgctatattaatttttgtatgcatccagtgaaaaaagtttataatccatgtagcaaaaacatattttctacagtgcccagtcctctgctggcccttaggagataatcattgattgccacatgatatgcatatgatctgactctatccagctaatttttctgccttggtcaagtcctttgtgaaacttctttctgatttgcaagaagaactgacacctcagtgatttttttctaaggagcttctcagaggtaaattcagtgatgtgtgcagcctagcaagtatttgtttaatacacaacaatcctcagaactatgtggggtatggagaagccaagctacgcatagttttccgtctataaaggagattatcgtccatctgtgggcaaaggaagtaaatgcaggaatagtttgacaaaatggaattatatatatatttttacttttgtgtaaaatcctactagaacattctaattccagctccatctctgtgagaactctctcaaattcattttcttcctcatcctgcctggacatcatagttgaatgactctaatgagtactcattggcacttcaattccatcatcagcatgttcagcataattcactgtgatgtttctcaaccataggataatacagcctttgcttgaccatctcctgagcctgggatacattgctacagttgaggacaattatggtcacagttgagatactgttgtagaacacaatggaacagtcctcagttaatatgtaactcttaacactagattttctaagctttacatttccggtgtagtatcttgctctgaccacagccttctttctttccacttggtctagtttatcttcactcccattgctccagcttttttccctcaagagaaacagcctgccttccagcctacctctaggctggtcaattcctcccaccatgtcatcctgtccttggtttctctgccgtccttcttctctatttgactctctctcttgcagtgtggctgaaatgctgactcagcatctttcttgtgtctgtcactcccctgcttctgtgcctcacctttacagcaaaattccgatacttgttattacttcctttaccttcttcttcctatacctatgggatgaacacttcctaaaaaacgatcatacagtgatacaggttggtatcattgctaacacatggtcttcagttgcatctgagccccagtgctgcctttcttttagtttttttttttttttttttttttttgagatggagtcttgctctttcacctaggctggagtgcaagtggtgcgatctcagctcattgccacctcggcctcccaggttcaagcaattcctacacctcagcctcccaactagctgggattataggcgaccaccaccatggctggctaatttttgtatttttagtagagatgaggtttcaccatgttggccaggctggtcttgaacacctgaactcaagtgatccaccacctcggcctcccaaagtgctgggattacaggtgtgagccaccgcacctggcctcttttacttcttttttattgttatgtgctcagtcatttcctaggatttttttctaaacccccctactgattgccatccacttccactggatcccttcctgcttagagcagctgtgtagcacagaggttatgagaagacactcaccatccagactgtgttcaagcctttgctctgcaagctattttatgatcctaggtgatttaacttctctttgttattatttcttcatctgtgaaaggaaaataataatggctcctaccttatagaatcattgtgaagactgtatgatttagtatttcttaaaaacagttagaatagcgcttggcacatagtaggaactttgtaagtatcagtcattactgcctattttattattgaacattgaggctgttagacctcatatctctccgttttgatccttcatatctgcagttttgtcaataacccattcaatcttagtgtatttccttcattctcagaaatgatacattaagagggcatttctcttcctgtttctttctgcctctagcctactttcatgtttatctctcttttttatatatatctttaatctattccttgaagtgaaatctatactctgagcccacaagcatactaaaatttcttccattctaaaaattatatcatcattatcattattatcatctacatcattatcagaaacaacaaaagaaggaaaaaagaatattcctctgatatttcctcatatgctttctcaggtcctttcttctttttttctcttatatagattttttttttgaaagattgtgtttcccccaaggtgcactaccttctggctataattgctgatattgatcaaggaacctaatgattagatgactgtgacattcaaggatttgctttctctctttagtccactcggactctcttctggatttcacagttagccagtttcgactgtcataacataagcacttgtggtcaaccattccactctcacccggttctgcacttgtctctgacttagccttgtcttttttcataggtcttcattctatttcctaaatatatgctttcctccaggtcccatttttcaccgtgatcccttgttctacgtatgttcccgtggtaatttaatctattcccgtgatttatcttctatatttactgtatgtgccagtgactcacaaatctctatttctagcccagaactctctcctgagccttcagaccactttccaaatatttcctagatgtgaacacccataggcatcccaaattcagtacatctaaaattaaattcattatgctcccaattgtcgtattgcttctgtatttctatcttagtggatgcctgcactatcaacccaaatagcccagggcgaaaaccaggtagttatcttagagttcttcctctccattctattcagcatacaagcccctgttgatatcactatgcttaaaattgtatctcacatctgtttcttccttagtcttaactctcgctacgctaccttaatttagaccttcgttttcctttatatgagctattacaagaatctctgaatgggttttttccttaatgtcacctactacttaatctatactgtacacagttgacaattatcatactagaacattaaactgatcatgtgctgttttgcttaaactttttagatggtttccaactgccttcattttataatccaactcttatgcagtattctttatcaaccagcctcagttcttgtcagaatccctctgtgagcgtatgacacagatccattccgccatgtgatactcttctctttaatgcctacatgcttctattcccgtcctctggaaaacttttatttatttttccagacctggcccaattgctctatcttggggaagcttttcacaatcattcatgaatttcaaacatttatttactctaattttcaaagtgttttttagatggcagttatcacatcggcctggagctatttgaattcccaaatggctctatgcattcctatattcccaacactcaggacgctgcctggaacttagcaggtgcttaatgaatgtttgaatgaaatttgaactaagtattttagaaagttacaggagatagtttgtctcattggagctcagagtcaaggtagggaaaatggggaaaaaaggagggcatcaaaggaagaaggaagactgtagggagcccaaatgttataatatatataagttccccacgaagagaaaaggaagaaaccatgaagaaatataccttgtgtataagagaatattgggaaattgcactataaaaggaaaaaagaatataaataaagctctggcaaccagtgcacccaaggaatgaccagacagcaatgacagtggaaggaaaagggcaaccctgtgagaaagaaaagcctgagcagcgcagattgtcagagagcatctgcaaaagaaaggtgagagctttctgcaaaagaaaggcgagagctttctttgcaactgctttgcacatttctgctaagtaatgatgctacaaagccacacatttttccatttctctctaaaactccttcaaagagcactgagaccaagctgtattctctgtaatttgcccttagctgtatggaaaacatctttgacctacagctagtatcctatgcagaaaccttccagtgctctgctattctccagggcttttcttgcagaaaataaacaaagtgatgttctgtagaatgttgaccattattcctgttcctgaaaggtactggggaagataagtccaggacagtcatgagaatcactcttctcagttttgtaaagtggggtggacacatccaccttgcatagagctgcacagaacttccactgtttgtgccaatgtggcctcatatatataggtcagtttgaaacagtattaaatattcacaaaataaactgtacgtatatgcatgcacatgccttttgtgtgtgaacaactgaaacattctctgtttgttttcgccttagaaatattagctgcccccgtccgggcgcggtggctcacacctgtaatcccagcactttgggaggcccaggcggcatgatcacaaggtcaggagatcgagaccatcctggctaacatggtgaaaccccgtctctactaaaaatacaaaaaattagccgggcgtggtggcgggcgcccgtagtcccagctactccggaggctgagtcaggagaatggtgtgaacccaggaggcggagcttgcagtgagtcgagacggcgccactgcactccagcctgggcgacagagcgggtctcaaaaaaaaaaaaaaaagaaatattagctgcccccttagagagtctcgcagatggaaaatatgcaacagtgggactgtggccgtgatagatctgaaaggaggacccaggggccttagatctcttccattgcaaggtcctataaaatatttttaaatttacaaactttattttttagagcagttttaggtgcacagagaaattgagcagaaattatagagagttaccaaatatcccatccccacacgtgcacagcctccccagtgagacccagtactatagtggtatatttgttacaattgaagaacctacactgatgccctattatcatccaagatacatagtttacattagggttcactcttgatggtgtgtattctatgtattaggagaaatgtataataacatgtgtctaccactgatatcatacagaatagtttcactgccttaaaaatcctttaaaaatcctttgtgctccacctgttcatacctcccacccccttaacctcaagcactgaccactaatctttttactgtttgccacatacttagaatcgtatggaatgtcatacagttaaacttcagaacttatagttagaatcatacagtatgtagccctttcatattggcttcttagtaataatgcatttaagtttcttctatgtcttttcatggcttaatggcacatttcttttcagtgctgaataatattccattgtctggatataccaatttatccactcacataatgaaggacatcttggttacatccaagctttgacaattacaaataaagctgctataaacattcatatgcaggtttttgtgtggacacatgatttcatttcatttgagtaaacaccacagagcatgattgctggattgtatggtaagagtatgtttagtgttgtaagaaactaccaaactggcttccaaagtggctgtatgatttcgcatttccaccagcaatgaatgagagttcttgttgctccacatcctcgccagcatttggtgctgtcagtgttttgtgttttggccattctaagaagtgtgtagtgccatcttgttgctttaatttgcaattccctgatgacatacgatgtggagcatcttttcatatgcttatttgtcatctgtatatctaatttggtgagatatcttttaaggtctttggccaatttttaaattaggttatccattttcttgttgagttttaagaattctttggatattttggataacagttctttatcagatgtatcttttgcatatattttctcccagtgtgtgtattgtcttctcattctcttgacattatcttttttggagcagacattttaaattttaataagtctagtttatcaattatttctttcatggatcatgcctttgatgtatctaaaatatcattgtcatgctcaaggtcatctaggctttctcttatgttatcttttagaagttttatagttttgcattttatgtttacatctgtgatccattttgatttgatttttatgaaggtgtaaggtctatatctagaccgctttttttaatgtgaatatccagtttttccaacaccactttttgaaaagagtatctttgctccattctgttgccttctctcttttgtgaaaggtcagttcactgtatttatgtgggcctatgtctgggatctccgtcctgttctattcatctatttgtctctccttttactaataccacactgtcttcattactgtagatttatagtaagtcttgaagttgggtagtgtcaattctctgactttattcttctccttcaataatgagttggctcttctggatctaaaatgttttttaacactgtattatgataatgagaaaaacaaacctataagtattaaggatataaacagaaatatgaataaatatttagtctgcttctctatggatattataccattgaacataaaaataaatctcatggatatttttatgaatacataatgcacagaactaaatttattttattatagattaccctaagattctctgtggcctattaattttatgatacttaatatgagatttttcctgcaataagactgtttggacactattgctaaatagaattatatctttgaactgaatgtccttcttcagcattctttaataaaattggagtagtatcttgtcagaaaaatgggaatgaaaactgtacctggaagtttaggacatttggagtaatatcttaggacacaaaaactcagtctagaaaaatctgagaaatttaagtaagatatttcaaaaacgtttaaaaaatttctttaaagtcacattttttctgataccaagggaaagtttctttgccattcgtactttgacttcttgaaacagcatcctatttagaaccatactgaccagaactagtgaagagatattggttgaattcctaaccatgtcttgtgaagagcaacagaagaatttaggtctagagaagaaaagtcttgagggagtagaacagagagattgcagaaacaggtctaagtttctccacatatctgaagagtcattttgttaaagacagattaggctaattttctgttactttcagaatgcaaattaagcgctaattacgcataaaatttcctacgcataggaagagaataatagcagtaagatctggaccctaaattgaactacaccgagagatagtgagctccttgccccttagttattttattttatttttgagactatgtcttcctctgtcacccaggctggagtgctggggcatgatctcagctcagtgcaacctccacctcctgggttcaagccattcttgtgcctcagccttcccagtagctgggattacaggtgtgtgccaccatgcctggctaatttttttttatttttagtagagacagggtttcgccctgttgactaggctggtctcaaactcctgggctcaagcaatccacccgccttggcctcccaagtgttgggattacaggtgtgagtcaccgcacctggccaccccttggttgttaaaagcagatgtgtgacctgatgtatggaatggattcatatatttggtgaaagcttcactgtatggaattataaatgtataaattatgttccacctcactattgaacacgtagaaaatataaataacaatgaaatatccttttcacttttcagttaagaaaaattaaaatatatatgtatgtgtcttagtttgggctcctatgacagaataccatagactgggaagcttaaacagacatttatttctcacggttatggaggctgttaaggccaagatgaaggcagcagcaaatcctatatctggtgagggcactctttctggtttgtatactgccatattctctttgtgttcccacgcaacagggagcagagagatcatctctctgctgtttcttataagggtgctaatcccattcatgagggctctatccttatgatctaattgtttctcaaaggccacacctcctaataccatcacattgtgggctacaatttcaacctataaattttagggggacacaaacattcaattcgtaacagtgtgtatgtatatatgcacacctacacacatgtgcacatactcctccaatgttagggaggataaagagaaagaatagttcacattgcagatagaaatatgaatttgtcaattattatgggaagaaatttgtcaaaagccttgaaatgtacatttccaggaggtacgttcttatgtataagactactcttcgatgttggcttatcagaaacataacccaagataagcacttcacctgcatgtcacttactaagcaattgttctttggatgactggtaaggaaatgggaaaagtaggatagttaagatcatgtgacctcaagccatgtcctttaggagagcagcttgaggagctacagtatgtacataccctgcaaggttgtcctgattcgagccagggagctgggctctcatactctgcaactggcattggttaaggagtgaggtcatgtgtgggcttggaagctccatagcctgagagagagagtccaccaaagaagggttgtgggtatcagctgttagaagcaaaagcttcatgaagtcacaaaattggaaaaagaatatctggttggaacaacagcatttactagtacaaatattcactgcatgataaacatcacattgcttaagaaagcaaacgtgttaagcataacactggtaaaatacagactttccagctatgaagcggtgtgacacagaagacttccataggagttaagctgtcagataatgactactatgcgtatcacaattacaactgaaaatacactgtaaaggtagatagatacacagatgctccctgacctatgtccccaccataagttgaaaataacatgttgaagatgcatttaatacatctaacctactgaacatcacatcttagtctagcttaccttaaacatgctcagaacactcgtgttagcctacaattgggcaaaatcatctaacacaaagcctgtttttaaaatacagtgttgaatatcacatgtaatttattgaatattgtactgaaattgaaaaacagttctgtgggtatttgtgttatagtgtctgctgaatgtgtaccacttttgcaccgtcttaaagttgaaagatcgtaagttgaaccatcctaagccagagaccatctagagttataggtacagaaaatggaaagatgtaatgaccaagtaggatttatctcaggaatgtgagtttggtttggttttagaaatggtttttaacataattcatcagattaaaatatggtttgaaataacgtgatcatcttgttaactgcccatataaagtacttgataaaattcagtttacccattcatgatttaaaaaaaaaactctaaaacagtaggtatcacaaggaattgactaaacatttacagcaaataaatacagttataaaggcaaggaatcttttctttaaaatcaggagaaaatgatacccattatcaacttattgtactcatcactgtacttgatattctgcacatgatagtgatacgtggaaaagaaaattataagaattagaagcaaaaagtcaaaactgttaccattattaaatgatagcagtgttcttaaaattgtttaaagtacaaacaagatattagagctaatataatgaaagagaaaggtttctggatattaggccaacatataaaacacaacagcacccctctgtacttgaaacaaagaatcaaagactgtaaacctctgaatagagctagcaaaagtttcataagaccttcatgaaaaaatcgtgaaaccttattgaaagacataaagtaacagctaaataaataaggaatttataaaatgtttgggatgagagaaatcaatatagtaaagatgtcacttccccaaagattaatccataaattcaatggtgtttcagtaaaaagaggaacagatttttcatagactgtggtaagacgaatctgaagttcacatattagtcaaaattcccaaagatagtcaaaatttacttttctcgtaaggaggctttattttaaagccacagtagttaaaacaaagggatattcatgcagggaaagtcaaatagaccaaatgaacaaaatagcagataaatgaacccacatataaatgagtgcatcacatgcatgggaaaaaaaagatagaaaagttactgagtaaatgatgctagaactttttactgtccttaagaaaaaagatgaaatatgtgcctcataccacatattaaaaattaattacagatgaattagagacccaatttaaaaagtgtaacattttagagaaaacttagaagataaatccttaagatcctgaattagggaaggatttcgttcataaaacatacaaacttagactataaaggggaaaatggtgtattcagttattttcaaaattaaagctttggaatgacaaaacttataatccaaaaactaagtgaaaaaagtatcatgtattagagaagattgttgaaaaaacatatatttcctaatggactttcactcatcttatgtgaagaattccatagtaataatggaagcaatctcataatttaaaaacgagccaaagctctgaataccccgtcagaacaggcaactgtcataggaaataaaaaccccaatacatattaaactaactgataattagagcgtcatacgtatcataagactgatagtgtaagtacattttaagagcaactgcctgaaattgttggtggcaatacaaattgtattgaaagacataaagtaagggctaaataaagttaaaatcatgtgacctcaggccatgtcccttaggagagtagcttgaggagctatagtatgtacataccccacaagtttgtcctgatttgagccagggagctgggctttcttactctgcaactggcattggttaaatggtgaggtcatgtgtgggcatgaaagctccatagcctgagagagcgagtccaccaaagaagggttggaggaccctgacttgggggacagcagtgaaataggatgaagatgtatgaatcctatgatcctaagattcttttcctagtcaaacacactaggggcaggaaccagctacatatatagtgatattgattgcagtgcaatttgtaatagtgtaaacaaaacatattctcagtgtgtatgtctgtgtgtctgtgtgtcgttattcagtgggaattaccacttctgaatgtgtatcacttttgcaccatcttaaagttgaaagattgtaagttgaaagtcaattatggagtaagggaggtgggaagatggcatgaggccagatttaaccctgtctgaaaatatatgaaatcatgttttttaaggcagtagccactaggcttcaatgtacagtgatctttgagagatgagccataatactgccccagcctactagactgagggagttttcggggaacaccaggggaaaggcattccagtcagatcctggtggattccttgagttgaagaactgagttgcaattgggagaatctgaagtgtctagactttcaggacagaatactgaagaggagagggctgtacagagagagaattctggagatcttcagcaagtcctccttttgtaatcagctgagtactgatcagtgtgtacatgtgaggaagagacctgaggctggtgaaagagccactcaaaaggattagaagggaatgtgctgagtattcacatacgtttgggtctaacaaatgtttacaccagcaagactggaaaatctcataaattaggaggtactggagataggatgagactcttaccttagtactgggaaatgattagccccagaatgattaccagttttgtcctgcctgacaaattgtagcaagactcaaaaggatgaagctgtttcaagtaacttaactgtgtcacagaacaaagcttatgaatatttatagaaataccaaaataaccagaacctaacacagcagaatacacagtgtctggcatccaatcacaaattaccaggtaagcaaagaagcaggaaattatgactcataataaggacacaaagcaatcaatcaaaactaattttagaatggacacaaatgttaaaattagcaaagacattaagatagctttatgactgtattctagatgttttaataagtcaaatagagccatagaagaaatttaaaagactcaaactaattcctagagatggaaactacaatgtctgctgtgaaaaatatactggatgggactagtggtagattcgccatgataggagaagtagattagtgaacttcaagacacagcaataaaaacatcatgatggagcagaaaaaaaatccaaacctttgaaaagagcttcattgagctgtgggacaatgtcaactagcataaaaaaaattttgaagaaataatagctagaaatattctgaatttgatgaagactataaaaccggagatcaaagaagtgaaacaaactgagcataagaaacataaagaaaattccaccgaagaatatattataatcttatagttcaagatcaaggataaccataatactttagaagcagtcagaggggaaaaatacattgtgtacagtgtaaaaaagatatggaaacagtatatttctcatttaaagcaatataaggctaggcatggtggcttatgtctgtaatcacagcactttgggaggctgtggtcggaggatggcttgaggccaggagtttgtgagcagcttgggcaacattgtaagacaccatctctacaaataatgatgataataataataataataaactagctgtgtgtggtggtacatgcctgtactctgagctgctcagaaggctgaggggctgaggcaggaggatagttggatcccatgagttcaaggctgcaaagagctatgttcacaccactgcactctagcctgggtgacagggtgagactctgtctcaataaataaataaaaataaaataatacaagagagaaatcagtggaattacatttttaaaatgctgaaagaaaaatcaatgtaaacttttatactcagcaaaaaataatttaaaaaataaaggaaacataaagcattttcccagacatacaaaaggtgaaaaaatcaataatatcttgcccattacaaaaacagtattcaaatatatattttatgatgaagaaaaatgacattagattgaaatatgcatcaacatatgtgaatgaagggcaaagaaaatggtagctataagagtaaataggtaagaattttatcaagtctcttgaaaatattgagtgtttttttgtttgtttatttttgagacagagtctcgctctggcacccaggctggagtgaagtggcgcaatctcggctcactgcaagctctgcctcccgagttcatgccattctcctgcctcagcctcccgagtagctgggactacagacacccgccagcacgcctggctaatttttttgtatttttggtagagacagggtttcagcttgttagccaagatggtctccacctcctgacatcctgatcctcccgcctcagcctcccaaagtgctgggattacaggcgtgagccaccacgcctggccaatattgagtgtttaaacaaaaataataacatcatggtatagagtttattaaatatataaaagtaaaatgtatgccagttgaataagtccataagaatagaaatgtcagtgccctattttaagattcctatcttacaaagtggtatagtatcactcgaaagtgtagtgtgataaggttaaaaacatactataaatttgaaagtagttgttaaaatgatgaactaaacaatgttaataagccaacaaagaaaataaaatgcaatttaaaaagtatttaattcaaaagaaggcagaaaaagagttttcaagggaacaaagaatagatgggccaaagtaaaaacaaataacaagatgatagacttaaatttaatcatgtcaacgattacattgaacataactggtttaaaacaatccaattaaagagcagagagtatcagattgtatataaaggcaaagccgaagtgtatactttgtataagaaacacaatttaaagatagaaataggtaaaaggatggaaaaaagatataccatgataacaccaaaggaaaattggaatgactacacgaatattagaaaaagtagatttcagagccagtattattactagggataaagaagttcatttcatagtgatatagagatcagaagaacattttacatatgcacctcataaaaaagcattagaatatgtggcacataaactgatggaactgcaaggagaaacagaaaaatttacattataatcagaaatcttagtgcttaattgaatggagcaagtagacagaaaatcagcggggacatagaagacttgaacaatgccatcagctaactggacctaatcgatgtttatagaacactccactcaataactgcagaatacatacatttttccaaatacaaacaggtaattttccaagatagaccatattgtagtaaataaaacaaatttcaataaaataaaaataatttaaggcataaactggtaagttgattactgataagtatattctcagacaacaatggaagtaaattagaaatcaataacaaatctggaaaatcccccaaatatttgggtggcaaataatatatttgtaaatatccgtgtgccaaagaacaactctaaaaggaaattataaaatgttttaagttgaatgaaaattaaaacacaagatatgcacatttctgggatgcttctgaaattgcacttagaagggcaactcagcacccaacacatataagaaaaaagaaatatctcaaattaattgattcagtttcaccttaataatctagaaaaagaagggcaaattaaactaaatgtaaacaaaagcagggcaaaaataatcaaagtggaaatcagttaggtagaaaagaaaaacagcagagaaaatcagtgaaaacaaaggcaggttgtttttttttaattaaatctgataaatttagtaagtctctagccagacttagaggggggcgaaaagtagaaagattcaaattagcagcaggaggcatgagagtggtttcatcatgaacaggtcttcaggtatgacaaggataatagaatattttgaaaaactatatgcctataagttggacaacttaggtggaatgggaaaattctttcaaggtcacagactaccaaagctcactcaagaagaatagataactgaatagctctctatctcttaaaaaaggaatttgtagttagaaatcttcctacaaagaaaactttatgtgatgtggctttatcattgactttgcccaaacatgtaaagaagaaatgatgccagttctatacaattatcttacagaattgaagataaggtagtcatttttatctcattctatatggccagcattacctgatgccaaattttagggtgaaaataccaaaagaaaatacaaaacatggaagtattcttcatgaacataacatgcaaaatgctaaaccaagtgtaccagattgaatccaacaatatagaaaaatgtgactatatcatgactaagtgagatttatttcaggaatgcaaaggtagtttgctatttggaaaccaattagtgtaatcattatattaaaaatgattaaagtgaaactacatgatcaccttagtggaacagcaaaaagcatttgaaaacttatattcattcattataaaattctcagccaattagaaacagagggaacttcttcaaccaataaagaacatctacataaatccttcagcaaatataaacttaatgttaaaagacagatgagtcttatattttcctttggatcagggacaaaatgtagatgtccactctccttgattttattcagtattgttctggaggacttagccagtataattagggaggaacaaaatatgtagattggaaagcatactaatttggagaaaatggggttgtctgtgaaaaaaatctggtgagatcaaggaaaaatctactagaataataagtgacttttgcgaagttgtggtatacagaagaaatcaaaaattgatatttaaaaattaatatttataatagcatcaaaacatatgagttacttagaggtaaatctgacaaaagaagtgcataatctgtacaccaaaaattatacaatattgctgaacaaaagcaaagatctaagtaaacaaataaactctgtttatagatataaaaacccaatattattaagctgttaattctcctagaattaaggctgtcagataacatatacgacagccagttatttttaaattttctgtaaaaaactaatttttagcataagtatattcatcttatggttttatgtgctgtatctgttcaccctacttcaaattgattatatgcaatctcaatcaaaattccagtaagatttttggcaaaaattgacaagctcatttgataatttacatggaaattccaaggatccgggaatgcaaaaataacttcggaaaggtataagtatgttggaggactaacagtatgtgactcaagacttactataaaggtacagtaattttgccaatgtggtgttgacatcaagctagacaaatagaccataagaaaatagaaagtccaggaatagaccagcatgcatatggataactgatctttgagaaaggtgcaaaggcagttctttgcaggatgcatacatagtcttttccacaaatggtgccggaacagttgtatatccatatgccaaaaaaatgatcttcaatccataacttacatcatataacaaaattaaatacaaatggaatggattctgacgatacaatcgaaaactctaaaacttctagaaggagacataggagaaaatgtttgtgactttagatacactgcaaaagcataatccatgaaacaaatcaataaattgagcttcatcaaaagtaaaatctttcgtttttttgaaggacattgttataagaaggaaaagatcagccatagactggaagaacatctttgcaaagtatatatctgataaagaacttatgtccagaatgtataaggaactcttaaaatcaataagaaaacaaaacagtgtaacatttggagaaataatttaaatagcatctatcaaagaagatataaatatggcaaataagcacgtgaaaataatttcagcatcattggtcactaaggatatgtaaattagaaccttaatgtgatacacactattcacacaattaaaattaaaccgattcaactgcaagtttttgtgagaatgtggagaattgtttctcttctactcccctttcccacagtggtgggaaaatatagtggtaaaaatactttgaaaagcagttttccactttcataaaaagttaaatatacatctaccatatgtctgtacaaagacttgcagatgaatgtttatagctgctttatttataatagccaataagtggaaataattctaatgttcatcaacaaatgaatatataatgcatgtcacaaatgctactcagcaatgaaaagaatgaattactgatacacattaaggacctggatgactctcaagatgattatgcagagtgaaagaaggcagatgaaaagaatgcacatgtatactataggattccattcatataaaactctggaaaatgtaaagtaacttttgacagaaaatgcatcagtgatttcctgtgaagaagggatgggatggagagaggagggagggaggaaatgatgaaggagcacaaggaaacctttgagggtagtgtgcattatcttgtttgcggttttttctgatttctcatgttccgcaaattatcaaattgtacaccttaaatgtgttcttttgtactagaataaagttgttaaaaataaagtaacatgcaaattggtgagtacaatatgatcttgaagaaccagtaacactagcacacaaaacaatggaatggatctgtaggtatccaacactgataaatctcaaaaccgtaatcattactgcaaatggatatatgtagtaaaccatctgtacaaaagtttatatgaaagtttcagataaacaaaacaatagtatgtatacctaatgaatatataagcgttgattaaatgctggaaatcatttactctaaaacacagggttgatacccaccaagtgaacacagcagttactctttggaaggaggaagaaaagatgggataaaacttgagttatttctgaaatatttttctttaaaatgtttaaaatgaatttggcacgcttaatatctttttaatcttgagggcaggaatgtagctgggctcctattatgttaacttccatacttttctgtttcacacatttcacttttagtagtcatccagctctacaaggaagccaacctacctgtgcaaggaaggttctctgttcagagctttcgtacaatgaaaaagagagacacagttcccgccttcaaggggtctctcgactaggcacgaggaaggcattaaatacagaattaaacaaataactcttcagttaaattcatgaaaagtgcttctacagtgaacgtatcctgaaaacatattgctgcttttaagtctgaggatcaggaagggcttctgtgcagaggaatgtttaaggtgagccactgcggaggagtttattgggcagggtagttctgaggcagggatgtttgaagaggaaattgcaatgcgtgttctgtttgcctagctttcctgcagctagtctcttttttagtcatctgatttactgcagtatgagaagcataaaccttgatatgattaaaaaatgaattttacttttttgcttgaattatacaaagtcagcgatataaataaccacgctttgacttgcttaatacagatgtcattatgagttaaatgagtggatcaaccaccagtacgttgacacagaagggctgttttaaatgtcacttctctgttacctttctcccatctagcagatctcccatagacaccaaagtttaacgaggttgctagaaccctgcagaatctgctaagttttcacctactgtgcactaaatgttattctagaatgctttatgctcagcacgttttccactatgccaatgttgtgagcttagcaactgtttgattatttcaaaaacaagtttatgggttagtagccagtcctggtagaacaaatgaatcctgagtgcaatattctgtatgtcagaagctggccaaatggttgctgtgctccagtattcttttagaataatccatatcagacagatgtataaggtagcaaatgtttcatatttgctttactgtcaactaaggggaagccgtttgaattttaataaatgctgacctcaaatatttttgaacaacagtttctaaatcaaaatccatggctttgtttttgttggaggtttgaatgtttcattgttaggtagactgttttcataacaaaccaacatatgagcacctgctttatagaatcctccctcattattatagaggcaatctacattttctagccccaatgattcactattagaatacaatgccgtacacttttaaaacgttgtttctttggcctgagtgaggattttacattgaattttaatttatatttgttttggggaaaaaaattcagatgattgtagaatgagctctgtttctaatgacttaagacttagtggggatgaaagcatagaaagaaagcatttgtatgacttgatttttacaacataatttatccctaataacaatagaaaaattacctagtaatgtaaagaatgaatcaaagttggaaaatactaagaaaacctggcattgcttacctgttttaactgttaccaaagaaaatcatagtttaatttttttaaaattacattttctgtgaagtatttaaaaggaagcctgacattagatttttcaaaagaaaaatttaaacttcttgtttagagaagttaattgtgatattcttgttaaggattttgaaaatgacatatttctatttatatgctttgtgcagtattattttcatagtattctcctctcttacgagttgacttcagtagatttcttcacaaatactttcagtaagcaattttggtaatgcttgacttggccacccaattttgcggagatgaaaacatcaccattagtatgtttacagtgtttaacgttcagagcaaaaaaaaaaaacgatgtttgtttacatacatgctgagtcatctctccttgtgaaattaaaatgtgtagtgaagcttcaacctcaggaagtcatatcagactcacagattttctgggatacgtttgttaccatgctgtttcagttagataatttccgagttttcttaatgtggatgtattctttggtttttttttttttcttgaaataggaagagacaactacaagttttaaagagacttctactacttgtcatcaagaacctgtaatcctaaagtaaaataataataataataaaatagaaaacattgaatcagatctactgtgtttaaaacagacttcctgtgtttgcttctctttcagataatgaattctgtgcttgccttttttcttcaactactttagataattgaagacgaaatgatagagaaggatagactatcaacaataacaaaaataataacataactaacatttattaaggatgtactaagtatcatattcttttttcaacaatttgtaatttttaaaaatatttttagagacagggtcttgttgtgttgcccagaaagtctccaactcctgatctcaagtgatcctcctgccttggcctcccaaagtgctggattacatgcatgagccaccgtatccagctacatattcttttttaagcaatatgcgtgcgtggattatctaaattagtctccacaccaatctcatggtgccaatactgttgtttgactgttttatagttgagcaatgaaatacagtcaggttaaataacttgccgtaggtcagtgagccagcatgtgctaggcctggattcattcaagaacagacagtctgactccacagcctgtgctccttatagtaggctctgctgctgctaatcagcaatttggtgtgacgtagctctagaatttatcaaattgagatattcttttttaaatatactgagcaatatttaaatataaatatggtggatatagcacaataaaaaatgaactcaacattaaaagcagttttctctactcctctttaatatgttatatcagttatttttggttagtcaaaatataaggataacctgatgttaaaaaataagaaaataactaggaatctcagaggtatttttgtgtttgtgaattctcctgactggaaatcactttggattatgttacacataatcgtttttctgacatattatcaaaagtcctgatataaaaatcttgtttcaatacctgcaataatttttcctaggaaatagttataaccagggaaagatccaggttttgtgggacctggaaaaatactcaatttggggccatctttaagaaaaatgataagaattatgaaaatgaaataggcagaaatgtgactatttattgagaatgagaacaagtcacaccaaaatataaattttaaaatgctctaagtactacagtgtcaaaatgtcacatgattcagaaaataaaatgatattcttattaactacctaacaacacagttatgctttttcccaatatttttggatagtctttgattatctcttcatatgcaaaatgtttttatattttctgtagaaaaaatagaatgacaattcagtctttcctgtagcatggttgattgaaatgtatgtgtgtgcatttgattattaccagtttagaaaaatatcttttagctttacaactgataattgataatgtatatgaatttatgagattgttttcaaatttgggcaaacctctatcataaagtttctctcatgcataggctgttagatttcagggaatttcaaggtttcctgagcagtgactagccctaaatactctgaacttatgagactcattaaccagtgtgtggttgacgagagagcatatttaatatttttcattatatttgttgatactaacatgttgtgtaaaatcagcagaaatttaaggttcttttcagcatgtctatatatagccctcttctttaattggattaccaaataaccaaagtgccttttaattatttttatttaaagaatatttttctcttaataaattcagcttttagtgtgatctgaaaacaaatttggtataatttatttctaaatgttagaataatttcttttgacttgatttcattactcatatttatgacatttaatatctgttaaattttttcctgaaatttcagttttctgaaaaaatgcatttaaatatgactaaaaaagttagcctttctacacaaacaaattaagagtttataatagctgtcttgctttaactggaatattctaaaatttcatttacagtggaatatttgagctttattatttcatttctgtcaataagataataaaaatacagtaccttttaaattatacatggttgtgtgaaagagtatattcctgataggagggaactgttttgacgagagggtcaatgaaaactacatctttgcagttttgctcgtttggtatttgaaggaattttcttcaggctaggttctggctctcaaactttgtttttcccactatacacatgcttctgtaaggcatattcatattactataagacctctggccatgtgccttcctgtcacagcactgatgagttcaccaagtgggtgtgaggagaattcctgggaaccatttccgcaatatgaagtgtgtgtttgtatgtgcgtgttggggagttgtataacagtaactcagtgatacatgcaggtgacttgtaaatcacgtaaaaatattctgtggcgcccaaactaagtgtttcctcaagtcagcttccccatagctgcgtgccttgccatgcctgtgttatgaggagcactgtgacagagagaagaacagagctgaatggaaggagacatgttttctgtggcttctttcatgcaacaccagcattaagaagttgcaggagagatcttatctctctcaaagccaaacatacttactatctggccatttgcagaacaagttgggtggtatctgctctatgcatgattaaaagcatgagttaaaagtaataggataggtctaaattattggcttgtaagtgtatctttggcatattgctagattttttttaaagtagcaattcaatatgcatagtaagaacatttagggacaccttccaatcctaaaatcattatgcatattgtaatctatagagacctaaggaaggtctatagagactaaaatctatagagactttaggaaggatgtaaaacagaatgctaacagtcactatttacggtagagaaatttaaagaatgttagtcttgtttattcactttttagtttgagcttatcacagcaagcatatattactattaaaatgtaaaactaactgttaaataaataaaaacaagaacaggtactgtaaagaagctacaacttaccattgtaaaaaccacagccaccctcgtctttcatccatccacccatcaccttctaattcacctactcatgcctgccttcatctcattgcttcttgcatctcaacctttcctcttggtatacttttcttcttgtttagtagatatttcagtgaaaagactttatgtttatatgtttctgaaaagactttccgtttgcccttactgttgggtgagaatttaacttactaatagaattttaggttagtggttatttcccctatacaatttgcaaccattaatccttgtcttttggcgtttgtcattttcccctcttctttctccccaataatatttaatattttctttctttctttttttttcgagacacagtcttgctccgtcacccaggctggggtagaatggtgcaatctcggctcactgcaacctccacctcccgggttcaagcgattctcctgcctcagccaccaaagtaactgggattacaggtgtgcgccaccatacccggctaatttttttgtatttttagtagagacggggtttcaccatgttggccaggctagtctcgaactcctgacctcgtgatccgcccaccttggcctcccaaagtgctgggattacaggtgtgagccatcgcgttcagccctaatattttcttttatctatgatattttgcattttccccatcctctgcctaggagtgaaaatattttcagttcttaaattttctgttaattcagtaaatttgtcagccatttcctcttcaggaaataccttatcaatatttctttctgctttcatttttggaattcttgttagctacttaatttactgtcttttaaattctcttatttcccatggattgatctttctatgttatttcttagatcagtttcaccatatcttcttttcagttcactttctctctggtttgttatttatccagtctactttgttagtgattacattttcattttcagatgtctatgtgattctgtttaatatacagctatgtctgattcatattcaccattttgttacataattcattagttttgctttatgaatttttttcatatttctgaatattttagaagatttcaaacatatactttataagctcagttttgtttacaaataagagaacctgaccaatagtggtaaaatcatgaggcttttcctattcgttaatgagaagcctggaggaaagcagaccagatttaagattccctgaggccatcaggtgcccagcctcctcttgttctttccctcgctacttcagggtgttggtgatttttcctcttatgcatcacaaaatgtctgtctcagttcttcccctgtcctcatatgagagtcgggttcaaagtagtaaggttattgtcaaaaaggattttgtctctgcaaccagagacgaaaacctccaattaggctccagtaaatcctccctcatatctctttgatcagagagctgagtcatggacacccccatccccaccaccaacacacacactcctggaccaatgattggcaagcaggaataggttaggtaatccagcgttaagccatgtgccaaggctgggcacccagtgcccagtggagcatggaggaaggggtgatgccctttgggcagcaaccaacaaagtctgccatgtccttatttttaaatgtttttcagaagattgtctttcatttgaatttccttggaggtgaattttcccagtgtactttgaattgttttgtttgcaattttatgtttctcttcttttcctttttcatcctgtttctttctcttacaagcacttctctttctatgatagttattggattggctccttctggccccatgttccgaagcagctcttaggttgctagtttgaggttacttttgaggtattagaatttattttttttaatgggaggtttagttcactgatgagaaaaaaatataaaatgcccaagataagcctctgaagctctggaaacagggtcacctcttaagagattttgaatttacattctgtaacttaagtccctcagtggattccccaactcccattcttgtttttcttctccaagtcccattctgtaacttaagtccctcagtggattccccaactcccattcttgttttcttctccaagtgccagaacatctatctatattcacttcgtaattctgaaatccaaaaactctaatcagaaaattaagttgttgagagaaaatggagtaggagtacatgtaaggccccatctccatattagacactgtagaagtttccagttgcctcagtcatgggccaggctattggagagaagggatatgcacataaatatatgggtatgagcacccaattaaaagtggtgcccaggttgggtgtggtggctcacgcctgtaatcccagcactttgggaggccgaggcaggtggatcatttgaggtcagtagttctagactaccatggccaatatggtgaaacccagtctctccaaaaaatacgaaaattagctgggcgtggtggcgggcgcctataatcccagctagttgggaggctgaggcaagagaatcacttcagcctgggaggcggaggttgcagtgagccgagattgcaccactgcactccagcctgggtgacagagtgagactccgtctcaaacaaacaaaagcagtggccaccatacattatcagttttgagaagaatgagcatattctatccttatgtggtggtgggaaaagactaagaaagaagaagggcactgcagtggccaggtcctccaccaagagtgataattgagtattagctccagctgtccaagctggcacctgcaatagcaacattagcatgacatccagttacactgctttaataattcctgaagaaccaattgtttaaccttggctgcagtgggccctgctgacattatttattttatatttctaattttattactttgctatttttgaaacggtgattttttactttataccttgagttgttttgacacaagctttgagtctcaagattttaaaacgccttttttgaagctccgtaatattgtgggtgaatggttgtcattaagaaagtgtttgaatatagcctcatatttcaatacgtgtgtcatgaaaaatacctctgctgccatcaccactccactcatattaaatggctcagacagattttgcatctcataatctcactgacttaaaagtagatgcatctcatatgagagccgaaaatttgcacagcaatattacacttaaatccagacattcacattttccccactgcagatatgcggtcttcttacaaagaaaaataactcagattttcttccttgtattttctttttttcttgctgactcacttgattttcagattttcgtagctttttttctgtttaaattacaacaatctacaatcaacaatgtgcatgagatgctaaactatgtgactttttcttattaagcaaacaaaaaaaatgagtgcgatagattctaaggtctttatcatggtctgaggctatagccacagcagaaaaatatttgtggccaagagttgcataaaatctatttatgtcagtgtgtggcttaacattctttagttgctgcccatcacccaagaataatttctaaacttctgatcacagtttaggaagcccattcaactagcccccaccagctctccaactgcccttccctgtacattcgcctgtgggtcccacttctgaagtccttcacatgctcaaacacactgggctcattgctgcttctatatttttttagtgttctttgctctctggaacctccttgtcctgctcacttttagtctgggaaattcctacattcctttcaggatagtgaaatgtcaccttatatgtgaaatccttcacactccaccctctccactcatacacatatgtgtctttcaccttcagtggcacataacttatttagggctaaggacctaggccttgttcacattagtgcctgatgtctccctaacagggtacctgagtagacagacatacccactaaatagtaaataggacagaaatagactgatttctaaggaccctgagtcaggactcatgctgtagcaaaaggctggctaagggaggttctgttgaccctcaagaaaactagggtaaaccagtgcccaaatcagtttgatgtgatctgaaggttagagcctacagttttggtgtgcataggcagccatagatatgtataatagaggcagacactcctatgggggcaagctgagggcatcatgtgggagccagacttggacagtataaaaatcccggttataaaaagctgactagagcgttaaaaattaacctttgtgcaaatgacattgtgcagcagcaagcaggtcagttgatcagcagtggatgacaaatcactggtctgcaggctttacaggagtatatctggaaagccccctccccataacctccttttgttaaactgatgaacacagtacccatcacagtggtgaccctcattgactgcattaagcttttacatgtgtgggtaaaagtggctactgtggtgtctccctgtgggatgatgaatgcatttcaggaagagtagtttcaccccattttcgtaaaactgttatgctttagacgtgtatatatgcaagttagtctacacacatgtttttctgtgctcccttagctgagaggacctagaagcaatgagcacctctagcatccagaacgtgatttctaataccattctccaataaaaggaaccaggctcctcggagaaatggcttattctccgttattgtccatgggtttgagctagcaatacacatcatcaacctagaacatcttgtactgccataaagtaaggatataatcaaacacaatgatggggacacatgtcaaagggacacaattaaaaagtgtcaattgcgaaatctcccagtggcaaagctgggacaatttgagcaatacgatacagtagtattggattatagccccaagtatgaaataaacatcgtaagtccatactaataaaaatatgtgattgaataaataaataaatgagggaaagtagacaaatttcccatgcagagtaatttcaaattatttatgtagcataactctccattccttaagcacattgcgagtacctctaaaaagtacagtatggaattggggagtaagcttatagtggagaagcctgcctaacactacctcagccaggtgatcaaattcaacaccagtagtgatgaaccatgtggacagtttatgtgatgatgagaatggcactttacatccatggtcttcttctcagaaacccataaccccagtataaccatgagaaaactctcacatgagtagcattttacaaaatacctgatgagtatttctcaaaactgtccaggtcatcaaaaataaagtctgagaaactgtagcagccttcggaagcctgaggagacatgaagactaaatgtaatgtgtgtcttggacaagatcctgaactaaaaaaggacattagacaaaaactgaggaaatctgaataaaagtacatactttagttaaaacaacaaacaaaaatggctccttaagaatggcaaagtctttttcaatcattccgatcttcaccaaagttcaatttgaatttgaagactggctgtacctcagtctttaagaaatgatgagtgaaccagtgtccagaattccttccattttcctaaatttcctgatttgttttgtttataaaatccccctctatatttcttccttttacatggtgctgaaaattttcaatccttttaagctggatgcgttaaactctgaaacagtgaacagataaggaacttaacttcttggaataaagtagcagtgctttaaagaaagaggaagaatttatgtaatgatcctttaaattgtgatgaaaatatggttgtttgataaatgatgtttttaacattcctcttagcaaaaaaaccatccaaatgacaatgataagaaaacattatttttcaattggtatattaggttagggaaaattaaatgcttgataaccccacttcacaccacttcagtttatttcaacacaggcagagttcaacacaggcctttctatttggatgtggatagtggttcatgagggtgactcagagacctagacattctctctctcatggcttagccattccctctggcctcggacttcttctttcccagccttctggatgcagggagcggcaggatggagtaaagttgagaggactgtaatggagatttttaatggccgagtctgtaggggatatttcactcctactcccatgtatatataaaactgaaatatagtactttgaataatagaaggaaactaatttttaaggaagcattatcctttcttagaatagcatctgtttttaactgcttacaagttctataactcaccaacagatgactaagagctaggactgacactggagttcaataaacaacacaaaattatcttaataggtttttattgttttgaaataaataagccttttaggaggtgattgtaggagatagatgttcatgaatcatagtctatcagcattttttgttgttgttacagtgaaaagcctttggttgttttagagataataatggtatgttagctgtcctctataaagaggatgttttgaaccttgtatatgttatttgccattttctgatggtaggaagaaatttgtgctcatccttttggtgcagttgtgactactgcatttttctgggaggtttgccagagttattcataaagacttgagcatatatacttacaaaggcaagtagcccatgtacaattttaaccagtcactttggagaggaaacagccacactaatcagctatttgtgatctagactcttgtaagagtctctcccacctcactccatctatttcttcccttctaagtaaatggtaatgagaattcattctgaaatgacatgagcctgcaatttgcatgaatttgatgtagaaaatcttatcatcatcacatggatcatagttcaattttatatatgtgctttccggattccaaatggagattgggaaaattattcaaattgttagaatatagacctgtaatctcaagtaattgatgtcccctattttaagaaagcatgcaacaaaattcagatgcatgtgtacagtctataaatattatttttaggtgagaagttgaatttttcatgattgtaaatggaagaaaaagaaaatcagtttaggtcaaaatacataaaatggcttggatattaatttcaccatatttttactttgtttcaaatattatagtaaaattatcagagctttgccactgaaccaatctgtctcagactcatactgagtagtagctctgtaacttgacttaaatcatttgcgaaagaattcttgagtcatatggaagacatctctctctctctctcccccgtacagtctctctctttcccccatgctctctttccccttgcccacttctctttccctccctgttttctatactttccttctactactttgcaggggaacttccccattttctttttcatagcaaatatgagagaaactctgggcaaatccagtttaaaaaaagaaaagattatccctgatttctgagggaggatagacagttttaaagagaatcaagaaagagattggggattcagctggatatgaaaatagctatattcattaagaagagcaatgcaaacagctgtaaatttggataataagcaaggaaagatatttgaatttcattaggcttttttttttgtctacagttagcaaatagctcaccttctaaatttacttcagttgtgattcacccacaataagcatgtaattaaaattgaagaatgtttaccaggtgagggaagttgatgacagaagcctggagaaaggtttggaaaatatgaaaagaagggcaattcaggaagcactctgcaatttggaagatattttaggaaaggtaatgccggggaggactgcaatcaaatagatgttgctggttcaagactggcctgtagaagctcagtcaccagcatctttttggtggtgggagtgaattaattagttaattcaatcaatattgattgaaaatatattgtgctttgacttctgcaccagattctgtgagaataattgaggggaataccatttctgtaatcataaagcttacaccctagaaagggagatagaaataaaacataattaagatcagttctggtgagaagtgtagagtactgtgagcagaactgtgtgggtatgtgtgatgtaggggaagggatttctgccccagtctgggcatgggctcagcaatgtatcccttgttcttgtctccggagccaggtatgcaaataattatggcagagcatactttttgctcttagtggcaatttgtgatactgcgttgagagcatagtaggagtctccattttattatagatgtgtcatggaaggcacacaaaagacatagaaaccaagtccagaaggattggcatgagtgtgcaaattgatgtatttggggagatttttccataattttttgaataaaatctcaaaagataggaaagaactttaagtacttcagtgttactggatcctaatattggtgaagggatattataaaatgagatacacaggaaaaaagagggactgaccaaaaggaacacattttataatgtgatagagactcaatttttgatgaattaatggtgatatgataattgctataattgagaactggaagattatggctcttaatagtttaaaatgaagtacttacatgtctctacaaaaagtataaatgtttgagagtgtagagtcatattagggggctgggaaatcaatattctgaagtccagtgaacaatggtagaatataatagaaaagggcatctgaaaaaatagatactatgaaacttttgtttcagttttatagctacatgtttgtatgcctcgcatgcagataaaacatggaaattgtatttcttactgtgggttggagttaaagaagcctgaaagtcgctgtggtggaagcatccagtttctcaggtgtgtttacatgctgaggagaggggcctggagaagcagcaaaaagaccaggaactagacagactccaggctcttgctcctgagcctaaagaaagaatcatctgcatcagggcccagtgacaaaaagagtgaaaacactgatactttgcctttggtcccaaggtgacaacaatcataaacctgccagttacctccttggtgttgtgatatagataaattgagaataatgtttagctcaaggtaggtatttgccctttgtaaatagttgatgagttaaatgtccagctacagaaacttctctttggccctctggcagggtttggagatttctgggcttcttggagcaggtctgtatttttttctggtccagcctgggggaatgagggaatgggtggttgtaggtgtgtgttaggagggacgtttgaccattttctacttcatctattttgattaaatggtgggaaaacaaatctcctgtgggagctacatcatcttttatgtctgctaaccagaagttgaatcctaggaatcagttcctcaagcagcattttaatagaacacagcaagtggccttctgaggtggtcctgatatcaactgtgatacaatgtgctctgttcttagatgcagaaggcacaaccagggagcagtggtcccagaacagaggcttcaggcaaggcttttcaggataagggatgtgtgattttgatgttgaaccctaattacaggttagccaggaaacaggaccactgggtggggaagtgagaggggtatgtttttgagaaaaataaccaagtttgtaccattagcctgaaatttcaccgttccgttcaccaaactctgatagtaaagcctttccaaacttcttgaacttgctctgtgcaaatttaaccaatcctgtgcatatgtagttctttttctcaaaaacacactaggaatggcaagatggttagagtgtgtgtgtgtgcatgtatgtgtatgtgcgtgtgtgtgtgtatgtgtgtgtgtgtgtgtgtgtgtgtgtgtgtgtgtgtcgagtccagaagacatgggaaaggtgtgggaaatgaatatgaatctggaaagctaaacagggctggctaaacagccttgtgtgagaggaggaattgctgaagggttttaggtagcgagacaacatgcgttatattttagaatggttgctgtggagctggtgtggtgggttatcttggaggggtctgagatgagggcagggagattggaacatagaaactaataaaataaacaattttcccgtaatgcttatggaaatattatagcaataaaatttaaaatatttaataatttttgctgaggtcctgagcatcgattgtgactctgataaagaagtataattagattcaggtttctaagattgcctgtccctaggtctcatttcctaaatgactgcttctcttcaagacagcttctgaagccaaaagctttatgggcgacagctctgggaatgcgttttagcgttatcatcttgtgagatcaccacccaaacatgaaggcaagtgccacagacttgcctctaaagatgtagatggttttgccatcaaatagagaatgtgttgtgtcaaagaaccaggtttcttccaactctaaaagcctatgcttcttcagttatttctattttgctataaaccataaaacaagttacagtacgaatccagggagtgaagaagctcccagagctgtttgaaatgtgccatggaggggttggcatccatgttctcagagctactttaagggaagtttgtgggttgattgtcatcctgtaaatacccagcagagtgctgcctgctgcctccccctcatagcagatttcctgtcctgcgtgacagatccggtagaacgcataaagtgcaacttcactatttcaggccccattataccataactgaaaatacaacacaaattcaattctgtctttataaacatatggtctatctcccgtgtaatatcatggtacatctctattaaatcttgctttctgttgttgatattaaaatggaattctactatagtgtacttttacagttgatcttttgtgcttcaaatgatttagaaatcttttgcataagtaaatcctggttccaaaatattcaattgatgatttattcttggagcctatttttaatttatttagtgtatgactacactttatgaaagggttaacattatttgttcaaggtttttgatatttgatgccttaaaagtatacttttcaaaacagacattttatttaagaagggaaatatactgttctttgaatagccttgacactgtgccagctcataagtgttgtaatgtggaatgatgaattctttgcatatatattctttgaatatatatttttatagtgtacacataagtatagatagtccatttattttaaaaagcatgttcatgattttaagtcattcttgagaaagtgttgtggaaattagttggtattttgacctaggtttttcctattccagaaacgtgttttttaaacactcacattaaaaaattggtgaggttggccaggcatggtggctcacgcctgtaatctcagcactttgggagaccgaggtgggcagatcacttgaggtcagtagtttcagaccatcctggccaatatgatgaaactccatctctactaaaaatacgaaaaattagccaggtgtggtggcgggcacctgtaatcctagctgctcaggaggcttaggcaggagaatcgcctgaacctgggaggtggaggttgcagtgaaccgaggtagagccactgcactccagcctgggcaacagaatgagactgtcaaaaaaaaaaaaaaattgttgaatttgcttcaatatccggttgtcaactgtagaacaacgaaattttttcattataaaaatcttacaggataggtaagtatttgtgcttttaaagaattaataacatttaaatgtgcagtcctaactgaattattttttgctccatagaagcagttcagatgattcctgctgatttctaatttcaaccataaatatcacttaatttgttgttaaagtatttttccttaatggaatttttctcctatagctttaagacagcctctgacttgcaatttctttattaattttattttcttaaggtcacattattcctggcattttagacatttttcacgatctgtgactcttgtctcatgggcagaagctttgtcctctttcctttttcttcaccactctttgcagccctgaccctttagttaatttttcagaaaccttagcaactctgcctttggagtggcactgtacactgtggaggacaaaatataaattgatgtaagctgattaatgatttagctctactgctgaaaattccacatttgtttcctgttgtaccaagaataaaatctatgtctttcctaggacttttgagacctcctgtctccttccccactctccacttccgtcccttccccttattgcttcccctatgccagccatattggccctcgtgtggtttcccaaatattgtgagaatcatttttctcgaagtttttatcagcaagataaattgctgggagttgaatttctaagttaaaagatatgaaaataaatgttttaatggttaatataaaattgcctttgaaaggtactgacctatcttcaaagcacctgtttataaagaatataaagaagaataaagagtatctgtttcccaaacctgtaatgaagctctttcaggctttttgatcttggccacatattggccatctttttttaacataagtaggacctagctttgagtggattaattattttaaaaattctgagcagttaaacctttgccatcgtggtcccaaacactgctctctagaggtggtgctggttctggtgattagtaggcctaggatgtggttatgggaatgtgtggctgagatggagcaaaggaaaggtcagacaggttggggggtcagatgttcagacacaaggatgctgagatcatcaggaataacaccagaagtaggtggggtaaggaagagtgggagccaggtgccacaggcattatgatctcagtgtctcgatagatgggagagggaggaaaggatgctgaagggaagctcagtgagcagctgtctgtatgggtatattaatgactttttttaattttctgaattttgtgatatcttggcatctttgtgccttgctgaacctggagaggctgtccctccagagctagcagattcccaaatgtatcaaacaacttgcctgggagcacacttttcacttgcaaaccaacaaatccaaagcccatatcctagtcaaagcagccagctcctttctttaactctcttacaccctaagccaatatttcccctgccctgtatcatcctagggctaggtatcagacaaccaaggatcacctctacagctcagagcatgctgaaagtattcagattgtccagtcttaaccttgctcacacttaacgtaccctgctttattcattccttcctgccgtaccacaatatagaccctgggacctgctctccccttgccacctccttcactcacccaggtgcttccccaagtggcactgtaaggcatggcatagcatgccccctcctgttggggactgtgagtcacagatttcctaactatgagtaacagaacttcttttaatggcactgacgtctttgtgttgttactcagtcacctctatgaattaaattccaagaacatttaaaacagtgggagaccatcagagaattgggcaggaaaattaaatattaatagtctatgatgtagctatatttatacacagaaacacacattgacattgaaatctgatttacgtaaaagagaccaaaaaaatgggttatttaaaacagtatgtacactggtcccaattataaagaaaaactttcagtatacataatgtaagacacagaaacaaatagtccagcataaaatacccaaagtgctaaaagaagaatttgggataactttgtttatttgtatttaaaaattatcttccaagtattgtgaattattttgtgtaattccaagtcttgctgtaacgtggtgtcatttatgtatcttttgctcctttggacattagaaccttgattgcgatggtgacgtaggagccatcaattccagacacacacattaaacaatgctatatgggtgggcctacaaattatttctacaaccaacacagacgttttttggaaatggctgagtttgtgctctaaactgagaataatgtacattttattgtatgcatacatagataaggtatgaaaagtctatagtatatttagataacaatttccacttcttcactgaaagctggttgaaacccttcgttgtgaagtctatcttcctgagttcttttctcattgatcacaggatcctgttttatgtgccccctggcagatttttttttttctgttgcatttattttatcaggtcctagagtttctcaagtatatttgctcagcatttcctctaagcacagtcattgtagaggctttcctttcctctgtgtgctgtgctcataatgttgaacgccttatgtggtaactcttgattttccttttatctgtctgttgaatcaaatagttgtctacttgggtgtgtagtcctgtatgtaatctctctgccagagatttgctctgtagaatcagtgctctctgtatacccaactgaggaatattttacactcatttcgtatgtgaggatcattcatacttggggcccacgctgaaagaactttgacactgcccagtgtcaacaaaccactacgcgtctcccagatagcagtaccttagtatttattgtttgctgaatagccagggggttgttacatactcattgtcatatgtatatgtaacatacacattttagacggaggagctgggggcatgtctttcttgaatgtttaggagaattttaggtggttttgttctacacatgtacaagaaatgctaactctcagtatacaaaaaaggattgaataaactggaataatatttgcaacacgaagtttagagcacccagtgccttcctcttatcaccatgtgtactttctaaagcagaaaaaaagtacgtagttaaaatctgaaaagctgaagtgccatttgattattttctaaaggaccaaaccacttgctccttcaccccactgccttactgaagcatgcctcaccctagcttttgtggttattagtattgtaagctctggataaaaataacagttctaggtgaattatgactttttggacttatggtttattcctctgaggatatatttgttttatattccttaaattgttctataaaggcaattcacatattttaaaatccctgtaattttcatatattttagcagactgtgtgtttaagggtatatatttcttgattgtgaaacagtcgcagtggttttagatgtgtatcttttgtctttctttcaaatccaaattccgtagtgaggctaatttagttcattccaataaaatattttaaggtctttttattaaagcagaaattaaaataattatcattatttataaatactgcttaacataaaaagaactccaaagaaattataaccactttgtaaaattgaaagtaaaaagcacttaaaattcatgagtataaaataaaatattcctcgataaaaattgtgtgcatagacaacttgtattttagaacagaacttggaatattcagtttgtctaaataaactcctaaccagaaaattttaatgaaaaaaaatcctctaaagtaacaataaatatatttcttctgtttatcgacaaatagctaatgaggatcaataatgtttttatagtgcgatgcttctagattgccatttacctatgctaataaatctaccagacctacagtttccatggtagtaggtataatgtaaaaaacaattcacgtggcccaaggcccaagttatgttatgggttattatattgatggtgagtagtatttctcagtaggatcactgttggtattttgagtgagaatatccgttgttatgtgggactttaacattgcactccattaaacaatgctggccttttaattacttcacaatgattggggcatccaaaatggcccctggaaaatattatgtgagtaatacagcccctacctgaaatccactgatacagaataggaaccagcacaatttttctgtagaggtggataataaatatttcatatgtgtgggccatacagtctctgtctcaattactcaactcggctattgtggtgaaagagcaactagagtatagatggcatgaaaaagagtagctgtgttccaatacagactatatttacaaaagcaagtgctgggcagattttcactggggggctgtagtttgccagccccttcaaaagtaccacaagtccatcagtctgaacacaaagaatgctatttgaaaaacaatcagtcgtattatgttagttaggagggtttggggctgcaaataatatgaaatcatatttcctgtttctaaagatagggttgtttcagtcttgattaatttaatgtatgattatcataagagacataagcgctttccatccttctactctgttattctcagttgttattatctcccctcatagtcacagatagatgcaacagtgtcatgcctagttacaacagtgcacaggggagaaggacatgtccatatagtccaggaaaacctttcccagaagtccccagctgagttgctatcacatcttgtttggctgcatctccaaacttgagttaaaaaatagaaaaaggaaaatatcccacatattttacataggataattatgattctcctccttagcctggagagacagattcagccttaacccatacctgtagatgaccaatatttgaatgagctgtgattacacgggtaagaaagagcaggggcctttgagaggtgagtgaagaaagatgtctgtgagatgcattgttttccatgttaactaaattacactcaaatgtaattctgtcttagacggtatttgagtccatttgtttccctctgtttcccagctagtcaaaggaagcgtttcattccacctatctttggtcagaggagagggaggagtgtagaccagcattctacccactgacgacaggtcatctgtctctattattgaagaaccattgcagagcctatgctcaccttctgcgaggtcagtaaaaccagtatatggaagagtgtttggacttgcttaacaaacatcactcagcagtccttaaggaacctctcaaataagccctagctaatcataaatagttagtatagaatttgatttataagagttgaaaataatttgctgaaaagcattttcactgaaatgatgtaatcattttagtgctaaagggaatacagaagaccaatggattcttttaagctcataaagttgctgccctacaatttcagatgaagcaggtgatttatcaagagaataattttggtggctgagaggtacagatataactagaagctggttttcccactttgttgtgctgtgttccctgaattacatcatggtattcctgcagcaaaatggctgcaagagaccttatgcttatcagtagggatggctctgactcaagttctgattttttttcctggagctattcctgaatgttgagctctttaagctgtcagtactggggttgaacaaatacctttagatgcaactctatttattgtagtgacttttggagaatgatcctgtactattttgtggataggtttgttcaggagaccttgttttgcatctccctcatgtaattggttcaatttcgaaggggctgctcctttaacgccaatcatttacttatgtgtctattcaaacatatcgaattcactgttccatcctcaaggttctaagtattctagtgtgaaagagaatgagccgaacaattaaagtagagtgagatttatggcacagtcgagggaagcattatgtcctcttaagatcgagggtgacactgaacaggtcaagaagtgatgcctgagttgagtctcaaaacataaccaaagtaagtcaagtaaggaaaacagggatgaagctggcctatggaaggaatgacacaagaaaaggcttagaaggaatgacacaagaaaagtcttagaggaatgggagaatatgggatgtctggagaacagctagcagttcactaggtctagagttcacaaagacttaagatgcacaattggcaaatactgagtaatgggactgtgctgggggagagttaatatatttagaactttattcttaggcagtgggagtcatcagaggctattcgatgggacagtgacatgatgtcattcatatttgcgaaaaccattatggctgtgggataaagaagggatcagagggggtaagattgaaggcaacatgaccagccaagagggtctttcaataatctaataaagaaatgccaagagccttgattaaggcagcggtggtggagagagaaagaagagatggttgtcaatcaggtgctgatagaatttattagacttgaactttttattgtaggaggtaagagaaaggaaaggaattcgagaccatcccggctaacacggtgaaaccccgtctctactaaaaaatacaaaaaattagccgggcgcggtggtgggcgcctgtagtcccagctactcgggaggctgaggcaggagaatggcgtgaacccgggaggtggagcttgcagtgagccgagatcgtgccactgcactccagcctgggtggcagagctagcagagctggactccgtcacagaaaaaagaaaaaaaaaagtgactactgcatttctgacagggcttgatacatgatagttcttcttcttcttttttttttgagatggagtttcactcttgtcgcccagactggagtgtagtggtgtgatctcggctcattgcaacctctgcctcccaggctcaagcaattttcctgcctcaccctcccaagtagctgggattacaggcgcccgccaccactcccgggtaatttttgtatttttagtagagacggggtttcaacatgttggccaaactggtctctaactactgacctcaggtgatctgcctgcctcggcctccctaagtgctgggattacaggcatgagccaccgtgcccggccaatacataatagttctattcattgacatatgaccataggagttggaccaatgttgtggaaagatgagttcacttttaagcctgttcattttgaagtgcttggaaacctagtaactcgttgtatataggaggctggaaaccaggaaggagcgctgaactaaagaaatagatgtggggggccgggtgcggtggctcacgcctgtcatcccagcactttgggaggctgaggcaggcggatcacgaggtcaggagatctagaccatcctggctaacacggtgaaaccccatctctactaaaaatacaaaaaaaaaaaaaaattagccgggcgtggtggcgggcacctgtagtcccagctactcaggaggctgaggcaggagaatggcgtggacccgggagatggagcttgcagtgagccgagatcgcgccactgcactccagcctgggcaacagagtgagactctgtctcaaaaaaaaaaaaaaaaaaaaaaaaaaaaaaggaagaaaaagaaaagaaatagatgtgggagttttcagcataaagtaagacactgacatgaatgagaccacacgggcactagagcagacagagatgagacacagtgatggagtccaaagcagaaccatgaagggcatgggtctagaagaagagggtacaaagacgactaagaataagatgttgagagggtacaagaagaccaggagagtatagtattctattcttgaaacaaaagaaacaacaacattgccaaatatttctgtgtgatgaaataagatttttaaagaggaccctgggtatgttgaaatgatttacttattgatttttatttagataaggaatgtgtgatcattatgtaactagaatatatataaatgtataaggtgaaaaatatatataattttgaataattttgaataatttaagaatcaccctaaatcccaccacccagcataactactgttaaaattttgatgcatatctttccagactttttctatatgcaaatatattctctatatccagatatatgtctatatataacaaaatgagttcatactataaaaatattggatgctgcataaatttgcttgtcattcttccccgagaccatgataatcttctccacatctttctaattttagtatataagctgggaaatcacatgatgtccattgaattaagtaactagaagatcatttgtaattttgcaaggctaatttcagtggaatggtgagggcagaagccagattgttgtgggatggggaatgagtaggtagtgaggaagtggaacaggcattatagactaccttttcaagaagctaggctgtgaaggagaagggaagtatagaatgtcaagtgaggagtaggatggtgaaggatatatatattttttattttgtattttacttttttaattggacaatactttccactgcctggaaagagccagaaaaggggtgaaattgaggatacagaagagagagtacagttgatggagtgaggcctcagtcaggaggcaggaagggatgggatgcaggaaagaagaaccaagccccatcttctaataaggcaattgggaaggagttaagggtagaaacagatagtttcatacatttgtagatgtgtcacctgaggtgattctggtcaccttagaatgattatggctgatgcccacatgtattgagctatttgatggttttttgaactttcaggaaacaaagaccttccatattggattagatccattatctgttcacttttatcttcagagtggtatcgagagatgcatgctagaaaggtctagtcttctctgacaaactgaaaggtcaaaaatggcccctaaacactcagttatcttaaacaataccttaaggatttattatccacatatttctgtgaagtttcttaaagttgtgtattttcttagcctgttctgccccaccagacttaccacccgtgaaataacatattgaacacatttcaggaagttgaattttatcttggaaaaaaacagatttggaacaaactttggttgaattccattaaccttggaaaagcaagctttagttctcttatgggtaaaattgggataccatcactattgacctgacagcagtgtgaatgtagcataaggtaacataggtcaagtgcctgaacagtaactgctgagacagcgtgctcagcatgtgttagtgccttcctccatgactgtctgatacacatgttgttactctcagtgattgaccaaggactcccattcactccagcataccaggacttgatgatagcaacatgaaactattgctaattataataaacttcggccaatgacctgtagtgttcagtggaatcattgttgttttgaaatgtaaatatcatgaaattaatggaaaggattatactatcttgagatgtacaaaattaacaggcctcatttgcatttcctaaagccatgtagattcatttttttatatttacagaagcatattacctgaggtattttttggctcataaatacaaaattaaatcccacagatgaccagaaggaaagctaggtcattgtttctcttttttacatatgattttctgtatcaaaagcttaataagatgatttactaaggagtatatatgctgaacacaactcgtgctgaaatgtcagtcctcactgtgaaagacttctaggcaaatataattgctgtaatgtgttacgacctttcaagactcataattcaattgaaaggggcaaggctaattaaatgcaggagaatcatttcccacttactgtagctgccactggatgcaaagcagtacctgtttactttagatccagtgaatcagccagtctatgacacaggaaactgcatgaggcaggtctattaggcttaaataatttccctatgagtttctgctacttaattcctttttaactcaccagcacatgtgtagatttaacttcgacttttaaaataaaatataataattcactagagcttgcttgctttaaaaatacaagtccttaggtactaattaagtatttttataaccacttaactgttgaaaatagctcttaaatatctgcatttctttctttatatcatgattactttgtctccttgactctccatcctagagttacttggatgccttttcatagcctcggttaatttgtttcctgcattttttctggcagcaattcaaaagatcattgattattttcccattactctgttgcacaaactacttaatatggctccatcaaggcattcaaaattcggagctgccattggttacctgggtactgcctgatctaaatgccaagttgaaatgaaatgatttaatggtcccagagatgcccatctccagcagagctcactctgtgagggctgccctcttggtgaatggttcctgcttttacaatctgatgagtcagaacaaagctcatctctctaatcaatattaagcatgtctaattcactttaatgtttaccacatcacctaactggagcttgcacacaatgggtagttagtatataggcattgaatgaatgatggatggataactgaatgaaggaagagacagaaaacttttatttaacaatgcattatgggattgcactttttggctagaatatcaaaggctttcaaggaaataattgagaagcattagattcttgcattaacagtaaaatttatttatataaattatttgaaaacactgtaattaaatttgagtttctaatgcattctggacataagtcctcattaaaagtttttttttcgtttaaaattggttgtctaacttttaagtaaagatatcttaatatgaaaattactttaaaaattaacttttatgacttggttataatttgagggttttcaatgccttgttgaatgggattcaaattatattgtggtaactattgtaggaaatttgggttgggttcaaaaggattagttttagtataactcaaatgactctagtaacaaaataaaagctacattttaaagagagaatatcgaaggcattctgaagaacacttatttttccaggtctgtagcagctaaagtggtgcattcagtaaaaaatctccttcctgcatcagaacatttgtattttattttaactataattgtgtgtgtgtgtgtgtgtgtgtgtgtgtgaagagagagagagagaaacttgaacgtggcaaagaatcaagcccatgagtactcatagcattttgagtaacgcccaacactgctaatcattgtgaaagtgaagatctctgttcctgaatgcattagaaggcacaaaacttaggtaaatcaaatagataacaacacaggcaacttgtattcaaatcatgtatttgaattagaattgacttaaagtcgttctaaataccagtggaattcagagaaaagaaaagtcactagggcttgtgtaaacagggagacttcctaaagaggttgggacctgagagggtcttgaagacaaaatggaatttgagtcagtgagaaggaagacttcctaggaggcattgtgggctaacctgcacagcttgaactatactttgcacaaagttactcatgtggaaatcagaactgaatcaaatatcactagtcttaaagttactttttcctgaacaaaaatggggtacaatttaacacatgttaaataagctagtatcctgttctaatatgtactatacatttttctgaaatacataaataaaagtaaacctgaagtataaattacgttctctaaataataccaagatgtcatgtgttttcagggtctggggaagtactgaacaaagaatatgtctaagaatatgtctaaaaatatttctgaaagatattttaaaagctattattctctaggaaatagacccacaattgaaaagataaagaattgatacttgaaaagtacaaataaatatttggatatttcatatgttcacatttaatcaacaacatttaggaagggcctaactctctactatatgctgcagatgacagaaaataaatgaaaaactgaatttatgtcttaatgagtttataacctggtgggttatgtcaaactaatgtcaatttcttaatgagccagttaagaaaaatgttaagatcttctgttactgactgtaaatacagtcttgattcagggattatgaaggtgcaggttaaggatgtcagtatttggatattggaggatgagaaggaatgtgtcccaggtagaaactttaggaagaggcatgaaccatgtgttgtaatgttataccctgatcggagtagaagacttttgttaaagaaataagatccaatagagcagggtcagaaagtggaatatctgcctggttacaaagagaagttggggcttgttggaaaagagaattaagcagttgttttggttttctagaaaagcaatgtttaggataattagtttgggctaaattttacagtgagactaaaggaaggcagtttggtggctagtttgctataatctaaatatgaaatgttgagattctggtgaagaattgagatatatagttattgcacaagaaattctaatttataggcagaagaacaaagaataaattaattgccaaagaagctatgttcctattaaataatttaaagttacttttggactgtaaagataattcctcaagatatgttacctggcatactaacagttctgattttcagttgttggaatctactgtccaaatctgaattgcggtgttgctgaaggataataagcaagttgaacaatgttaacctttggtcaagaaatttcatttagacaatttgggtccctggtgggacactggacacctcacatggcatatagagtaagcactacttacctgaatatcacataggttgatactcaagtggaaaacaacccataatttaggagtagactgagtctgtatatgtttccaaaatgaattaaaatgataagactgtgaatgcagtgaaaagcaaggaaatgaatttgacagatactaaattttattttcaatttcaaattactggctttctattagcatactccaggagtggtgaatttctataaaattggcacggagtattaaattttatgagtgtgctattgtaagtataaaaacccatttcagtgagatatggacatggttatttctttttactcagcaaactctaggccatgtattattagtcttaacttatcaccttgaaagacttgaggctttggagctttctttgtatatatatttgtggtaacattttgtttatttgggtagaagaaaaaggagattctgaaaagggtatactagtttgataagtttattaaagcattctttaatatgcatttatgctttgacattgagtattattacagtaatattttcaaattattacaatgatatttttgttcagcagcacttctttgagtgttttgttaaaaggtgtggctttaccaaaaatagaagtcttgcaaatattgtaatatttgaggaaagtacttaactacactttagcaatagcggagatacccgcaccccaccctgccttcactgcaaatagcaaaaactacttagacattgcatatcactgcaattttgaataaaaggggtgacagatcctgtaattacagcagcagcttacatcttggatcccctctcagttcactgagccagggctttgaatggttattgtgtaaagaatagtgatgggtgatacactacctcgttatagtcaaagttaggggaaatgggcttagattgagcagagttaatggaggaagataagaagcagggctttcccatagtttgggcaccagaccaggcaattttcatacacatggtagcaccaggaagagtgacaaatgccatcttcctcccacctccatttggacatggtgttgtcatggcagagtgtattctggtgggagccaggatgccttttactctctagggctatgtagataataatacaaaagatttctcctgttttttttttttccctcaacttctgctcctatctgtgatacatacacacagatactctcttcagcgccagaaaatagcccctcttacaatagggtatccacatcctagaggtactttaaaaaaaaaattaacaggccgggcacggtggctatgcctgtaatcccagcacttggggaggccaaggcaggcagatcacaaggtcaagagattgagaccatcctggccaacacagtgaaaccctgcctctactaaaaatacaaaaattagctgggcatggtggcacacgcctgtagtccaagctactcgggaggctgaggcaggagaatcgcttgaactggggaggcgggggttgcagtgagcctagatcgtgccgcttcactccagcctggcaacagagcaaggctccgtctcaaaaaaaaaattaacagaaaattagaaccactatcatagttcagataacatatttggaagacttagttttatggtccccaaataaagaggtattgttcttactggtcatctggtctgagcagagatatcccatataactactcccccactggcatgtgtggtgatggttcctgattacaacagtggttcttaaagtgtcgttcctgaaccagcagcagcagcagcctctggaaatttgtcacaaatgaaaattatccaacccaccctagacctaatcaatcagaaactcttggggtgggtcccggaatttgtgtgttagcatggcctctaggtgattgtcatggacacacaaatctgagaactatttgtatttgttttctattgctgcagtaaaaaagttaccacaaacttagtatgtggtaacttaccattgtattaccacttagtttttgaaggtcagaagttcaggcagacatggctgggtctccttctttggctctctcaaggctgaaatcaaggtattgatagggctgtgtcttactggaggctctggggaagaatccacttctcacctcatttaggctggtgactgaattcagttccaggtggttgtggaactgagacctccatttctttgctgactttcagctagaactcattcagctcccagaggccacccacattcttttccatgctttttatgtggcccctctagcaactaggttaagtttttctcaattcaaatccctctgccttttcccttagccctacccgtcttacatcctcttctgctgtatctctatcatgttctcttccaccgatagccaggagaaagatctgatttttgttttgttttgttttgttttgagatggagtctctccctgtcacccaggctggagcgcagtggcataatctcggctcactgcaacctctgcctaccgggttcaaacaattctcctgcctcagcctcccgagtagctgggatcacaggtggccaccaccacacctagctaatttttttgtatctttagtagagatggggtttcaacatgttggccaggctggtctcgaactcctgaccttgtgatcctcccagctcggtctcccaaagtgctgggattacaggcgtaagccaccgtgcctggccaaaagatctgctttttaaggggtcatgtgattacattggttctacccagataattcgggataatttcccttttttaaaggccaccgattggtaaccttaatcacatctgtaaaatccccttgatcatgtaatgtaagatatttacaagcataacacaagggggctgaggtcactgggccaaaattttgtctactttgcattacatctcacaggttccttctcttgactttgccaggcccctgtgttgctcactagctggcccagctttacagccagcatcctactctcaccatataagaccaatggcaacttggggaaactgacctcaagacctgctctgtctcaccaggaaagcagccacattgcacatgagccccacgcatgcattagaacacctgctgttggtgtctccctcatctagtctaacattcctttatatctctctcttgcctgttcctctctcattctccagaaatggctggctcctctttttttcatttgtgtccttacctctattgcctcccatgattcagaagctccagggtgtaactaagccttgggattcttctctaaaagccgtacgccagagtggttttgagcataaactttgaagtcaagacaatttaggttcaagttttgttttttgttttttgttttttttttgagatgaggttttactctaacatccagactggagtgcaatggcatgatctcggctcactgcagcctctgcctcctgggctcaggccatcttcccacctcagcctccggagtaggtaggactacaggtgcgtgccaccatgcctggctaatttttgtattttttgttgtagagatggggtttcatcatttttgcccagactagtctcaaacttctggactcaagcaatcttcccatctcagcctcccaaagtactgggattatagacgagagcaatcgcacccagctgaggttcaactttgatgaccatgagcaactttctctactgttttatactgcagttccctcatttataaacgggaggtaatagtaaaaggtcattaagccagtattattttattcatggaaaaagcaatttaatgtacaggagactcagtactaataatacctgccaactaccctaaataggggagaaatttaaagaaaataaatgcaaaaaaggcagagaaaaaagcaattcagggttttcagacttgattcttgaaatgctgaagaaatttagaaaattcaccttatctcatctctctccctttctcaatagatctgtttttgaggcatcttgtcttgtgagatttccagtggcatccctaccccaattggtgtcttgaagtttaggatgatactcatgtagacaacattgcaaagaagaaaaaccatcacttttgcatgtgcaattattctaccgattttcagaacaaatcttttaataatataatgttatcaccatccttgttttacaaacaatgaaaccgaagcttaggtaatataactgactcaacatcatacgtgcagaggtaggtgaattatctccacagctctatgataatgacaggcattatcagtcattagcttcttctgaatttgtatcaactaaagctagcctatcatataataaagcttcgtggagtttgatggcagtagtgcccagtattggtgaagaaaaaaattcatgaggagaatctgaagctggagttccatggagagaaaacaggtttgggtggtccccttggcaactggaaagcatcctgggctattgtgctgctatagaacagtagaaagaatggagataatttagaaaggtgaggcagagaattccaaagacattttccaggaaggtttgaaaaggagaatttctgcagtgaacgatgcattgtattaacatatctggcatttgaaggcattccttggggtatgggaactcgagtcagtttctccttatcaggacgctgtccaaggaaacaagccccttaacccttggctgcttcacagaggagcccattttactctgacttttcttttctgtcaggttttgtattttctatcatgagtgacaaatagctgatagcatcctggcctgtgcctctttcttaccaccacagaaagaatatgaaattatctgaagtattaccaggtgggctgtattattaccttacatggaaacacaatttaaaacttttctttctgtcttttttttttttttttttttttgagaaaggatctcattctgttgctcaggctggagtgcagtggcacaatcatgactcactgaagcctcgacatccctgggctcaagtgatcctcccacctcagcctcctcagtagctgggactacaatattgtgccaccatgctcacctaatttttgtattttttgtagatattggtctcactatgttgtccaggctggtctcaaacttctgggctcaagcagtccactcactgtggcctcccaaagtgctgagattacaggcatgagccactgtgcccagctaaaacttttcacgaagaaactctcctcagaaattcaaattctaggagctttctcataggcttgtaacattgtgctgtatggaagaagacaaacttgttgtcttttgttatttacaatcttgtttttcactctttgactgtatccagtctgtattctaagtctctctaccaaaggtaagtaaaatataaatttttactttgaattcaaatcagtgagaagaaatttatttgctttatgtaaattttcttttgtgggcaaacagacggtattaattgcacagatgggattgagactatatatcattttatcctcagaaagatgaagggctcgtgagactgcacacttgatctgttctcttgttttctcgtttgtgtcaatttggttgttccacatagaggagtgtaaatctggatctctattttaatgagtgtttacctgttacttcagagataaagaattgccaaaaaaggaaatttaaatttgggaaaataatgacaacataacaataataacaaatatttccaggaatgttagcatgctttctatccattaagttatttaatcctcacaataagcctataaaatccttattatcctgatttttcatttgaggaaactgggactcagaaagggcaggcaattgaacagtatcacagagctaataaattgcaaggcttcaagttttttttttcagtatacgttccttatttgtttattttcagtctttccctccagagtgtgatctctgccgagacagcagatatttttgctggttttgtccactgatgtagccctgctacctagaacaatgcctggcccagagtatatgataaatacttgaatggcagggcttcaatttaaacaaaagtctatttgataccattgtgttagctattgctgattaatagttaatggcaaaatctcagtggcatgcaacatacaacagcaggcatttacttcttgatcatgtgttgatggtttggttgggagttggctgactaggcttaacttagctgtgcttggctccagctccagctcggattcaggtgtgctccatgtgtccttctttcgttttggaccagtaggttatatgtgactcttatggcagaaggcagtagcacagaggagaagcccaattaagtaagcacattccaaatgtctactcacgtcatatttcttaacattcctctagccaaagctcaatagcaatggaataggaaaatattctcttctcatggaggtgaggatgggaaggaaatgactatttactgaaaaatcctccaatctacctcaaatgcctgtgcattttctctgtccttcctaattcataaatattgaatgtacaggcgggatgacattctcagttaggagtcaccttattgtgtgtgcttgtcagaggggccacataccaaatcatcaattcatattttctgactaccattgcctccctttttgctctagaggatgtttgactcattttgccttctctgccctaatttgttcatactagaactctggaggcaaagatcattaatgagtgattctagaagactatggttatgattactatcctggaacagaatcttttttttctgttttcatgcaattccaattggccaagggattttttaaggaaaatgttcctactacaaggtctaatacagacagcagaaagcaatccaatgttttacaagtagcaggacatgcaggatgggaatactttttctagaaacagcaaactgtaaagatgataccagctgaggtatcacaggcaggggagcttcttaccttcttctaccttgtgctcaatggctgatatgaagctaaaatgccccttagaggcaactcaaagggaatcttacatatcaacatcatgggtttagaggtggggattttgcggtccccaccaccactccttttgttcattgctaatgtggttagtaaactaaatggtgaaaagattatggggtagagacagaattcctggttttagtctcaactgtatcagaaacagcatggctggaaaacagcatttcacatttctatgacttatttttccacttcaacaaattagtaccgtgtaaccttttctttgctactgaattttacctttgtcacaagaaatgactaaaaagattgatcctcaaaggaataaattaatttgagtgatttgtctgggaactattgttcttttatttttagagttagaagggctctgtgaccttcaggactgaaggccctaactaacacttgcttcttggctcatagttggcttgagatctttgtttaaggagtatctttcacttctgcttgatgcatgctagattcatgtctctgttgtgacttccccagcatttttgtgtcatgttttaaaagttacataatggaacagctataattttatgtgccttccttgatctatcagcgtatgtctacaagcatgcccatgttataatggaaattctctatgcagtcttacccagtacctgtcactatcatgttacaatgaccatgactgagtatccagctttcctacagaacttccgtgttcatcatcattattatgccacttgtgattccattagagtttgaaaaaggttctcagggaacttctccagaaacttgcaacagctgtatcataagtactggactaagatcacttaggtaggtctggcttcagtagggatgaaggtatcccagtgtctgcaggaagcatctggcatctttatccttctatggcatgagaaggtgtgttgcccagcggcagaattctgtatatgacagagctgctctatggcagttggtagtgtgaatggaaaatgtgtaaagtgtttttaggtttttggaggacaggcagcatgtcggtgccaactattgttgtgatgaagaaacccaaatctaaatcggtctgtatggttggattgctatgcttagtttatttaaaacatggcatttggagagagttaaaataccagcacactgtgtctttgcctctactttttttctgaagcaaattggttgggtctatttgcaaaagctttagctgtaagagagccagtaaagaggcacatttctactagtgcctattgtgataggccttctttgtcgtgttaattctagtagaaataatcatctacattgatttataaggttggaattgaatggggacattgattcaaaataaaagaacagccatggacattttgatttatgttggtattaaggcaaatcattcagattcggtttgtacaatctaaggttgcttgtccagtggttagatgtcagaatgtatttagcaatttcttgatgaaagaaacaaacccctgatagaatgtatactttttcggggggggggggggaggggctagaactgtaattttttgcttgttgtgtggagactgctacctgcatgtcagtggttcttaggtaagagaggattgctttagagtgaaataaataaccttatcagtcactgattttatgggacaagaatgtaaatgtagtgagtaatcagagagcatgtaaatagtagcagataatttttcagaacattggcacttagtttgaagatgtctttcatatttaagagactgaaactcttgtcccaaggagtatgatattctcaggggtcagttatgatgtgaagaaaaaagtagccttttgttataaaggggttcctacatctagtaatcattggtggatttactttgcttcctgctattctttgttgttctctccagactgacattgatgccccttcctcacctctcccatagtcctctctgtgtttctttttttttttttaaatgtatttatttttattatacttcaagttttagggtacatgtgcacattgtgcaggttagttacatacatatacatgtgccacgctggtgtgctgcacccactaactcgtcatctagcattaggtgtatctcccaatgctatccctcccccctccccccaccccacaacagtccccagagtgtgatgttccccttcctgtgtccatatgatctcattgttcaattcccacctatgagtgagaatatgcggtgtgtggttttttgttcttgcaatagtttactgagaatgatgatttccaatttcatccatgtccctacacaggacatgaactcatcattttttatggctgcatagtattccatgttaaaaagtcaggaaacaacaggtgctggagaggatgtggagaaataggaacacttttacactgttggtgggactgtaaactagttcaaccattgtggaagtcagtgtggcgattcctcagggatctagaactctctgtgtttcttaatcacaacatgtgtcacactgagacctaattgttcccatatttggctatctctaactttaaacattaagctacttgaaagcaagactgaaacctttcgcagcatatagcagataggtatgcatactcattgttgagtaaatgaaatatttcagtggctattgggtcccaaaagcaggcctaaggtacaccagtatgctgaggaggcctcagtttttaatctgattccaacattgccacctcacagtgtactggtctggtttttccatctctaatttgaccaggttggaccagagaggctatcttccagtatgttctaagtttcagtgatttacccattttgaatcaccaaagttacaatttatttcaaagatgattatttctaactgattacatgtgttcccatagggagcatgacttcggcaacttcacctatcattctgaaatgggaccccaaaagtttggaaatccggacgctaacagtggaaaggctgttggagccacttgttacacaggtaagggatgctttgaaaccactttgttatatatgtgtttctattgtgattatatcctgactcttggaaaaacttagacatccttaaaagagaataaatcatgccatgattccgattactgaatatatattactgcctgaactatgggcaatctcattgccctataacatttgaagtggcttttaaaaactatttgtatgatttttgaaattaagttgatgagataattgaagaggggtccttggtgaagggggccctcatttacggtaatgggttcaaagtctaaataaactattcctcctgcactttcagatgctaatgcaccattaggaaaaactgtgttgactatacaacagcaatgtatatttattgaattacttttctttcagtttacaaagcagaattcatcctgttggagtgatgagatgttccatttttgtgttgtcacagttgtcacatttccacaagataacggtcaacagaaaaatatcatcaggatttttaagtgttataagttattttttagtgtcttgttaagcatgctctttgctattttaactctgagattcctgggatgtgattttttttttttttttaccaaattataatagaggcatttgtattgtcctgtggctgctataacaaattcctatctacttagtggcttgaagcagcacaaatttattattctagaggtcaaatatcctagtcaaggtattggttggcttgcattccttctggaagctctagaagaaaatccattttcttgcttttcccatcttctagaaaccacatcacttctttgacccctttctctatattcaaatccagcaatgtagcatcttcaaatttctcttgcactctgacctttgcttttgtccttgcatcccatctctgaaattgtctttcctacttccttccaataaggacccttgtgattatgttcggtccacccaaatactccagaaaaatcctcccatctcaagatccttaacccaatcacatccaaaaaggcttctattgccatttaaggtaacatatttacagtttccagggatttggatggagttgctttgaggaccattattcagtctgccatagtttgccctctggctccccaaagattcagatccttcctttatgcaaaacacattacaccacattctcaggtctccaaaagtctcaaccaatcatagcatcaactcaagttcaaaatatcatctaaatttcatcagcttaaaagtcccaaatctcattgtccaaattatttaaattagatatggctgaggatctctttataatctgtccttgagcagagttcctctccatctgtgtagctgtgaaactacaaaacaaattatatgttcccaaaatgcaatggagggacaggcataggataacagttacagacattcctacataaaaagggataaagtggaaggaaaaaggagttgccagtctcaagaaatgtagaaatctacatgggaaaattccattagatttcaaggcctgtgaataatcctctgtggcttgagtctgctctctgggcctagttcagaattatttcttcattttcatgaagggttgcacatattttcaaccaggtattcttgtcatccatctcctacctgtagaattttgagtgtccattcagccttcgtgcatttcatcccttttctgcctgtatcagtccaagctgatggtgttaccaccgttgtaggattctcaagaacattgtgattttactatgcacatctccaggattcactccattagaaaaacaggctcctctacagatctttcttggataatttcatctccatttttggcctctgttgaagtggctgaggggatccatgaattacatgcctaatcacttcaaagagccctcctttcacttggaccttttaatccttatatggcactaggaaaatgttatccagacataaaattggctttctcttcaagtatgctttcttgaaagcacgtctcctaattttagccttttgaagtcttcatacgttgagaattttcccaatcatcaagtcctggtttcttttggcttaatagttattccctttattcatctttttcctctcacatttcactataaacagcaagaagaaaccaggccactctttcaacactttgcttagaaatctcctcagctaaatatgtaagttcatcacttgtaattctgacttccacgtaattgtaggaatccgtccagctgagctttctgccactatgaaacaaagattctcttttctccggtttccaataacatgtttctcatttccttctgaggcctcaccagcatctcctttaatgtccacatttctaccaacgtctatttatggcaacttagatactccccaagaagttaatggttttctctaccatgctcctcacttccttctgagtctgcaccagcagagcctttaaccaaatctttatttttaataacagtctgttcaaggagatctataatttttgtattatgcttctcaaaattcttccagccttttctcattaccaattccaaagccactgtctacatttttaggtatttgttactagcagcgccccacttccaagtaccaaaatctgtgttagtttccaattgctgctataacaagttttcacaaatgtattagcttaatataaaacacatttattgtatagtcctgggggtgaaaagttctaagaccagtgtggctctagggaggcatctagttccttgcctgtttcagtgtctgcagtccacctgcatcccttgtttgtgtcaccttcttccattttagagccagtagcacaatgctccagatccctccgatttcagcttaaactgttatatttccttcgatgaatcttaactctactccttctctcttatgaagaagatccttgtgattacaatgggctcactcatatattccaggataatctctccatcttgacatccttaacctaagcacatctgcaaattcccttctgccatttaaggtagcacattcgcaaattccagggattagaatgtggacatctttgtatgtaattggagaacattttatgagattcatgcatatttttcattcagtcatgactcttgttagttctataaaaatttctgcaagaagcacctaatactgatatgcttacctaatactgataggaagtatgttggccacctactcagattgtaccctgtggcctagggttgattcatgaattttttatggtctgcagtaagaacaaaattgaggataaacacttgaaatttttataggaatttgacagtaattttttgtctgctgaacctaaatataaaatatggacttataattgtatatgtttaatttttaaaattattcatgatgttgtgttttataaaatattggtctgtgagatattggaataataaaaatgtagcctttcatcacagatagcttgagaaagactggcttaggagatatgttggagtcagaacaatctggtctaaaaggtacttctgccagatcagttaaaaagtgagtgaccttttcctagccttggagtttacacttaagagtacctataagtatatttaatccttatcatacagattaaatgaaagaaaatattagaatacagtacctggtataaaacaaacattgagtaaatgtagcttctgtttttcctgtttgatggctatatattcaggctcatgctagtcataaaccaatactgtgtaatttatgagaaggatgtaagtgaattaggcatgggctagcacaatattacacttatagagccttatgtgttaaaatttatgtacttatattttacccttgaatttagcttatctaaatcatagcacatctaagattataattaaaaattctttttggctgggcgtggtggctcatgcctgtaatcccagcactttgggaggccaaggcaagaagatcacttgaagtcaggagttcgagattagcctggcgaacatggcaaaaccccatctctactaaaaatacaaaacttagacaggcatggtggtacatgcctgtaaacccagctactcaggaggctgaggcaggagaatcacttgaacacaggaggcagaggttacagtgagccaagatcatgccactgcactctaacctgggcgacagagcgagactccatctcaaaaaaaaaaaaaaaatgtctttttcatataccttttagtccagttatctaaagtccttctgttgcagacaaaagcaatgcattaaaatattttctcaaattaaggacagtgaagtggctaattcatatttgttcacataatacagtagaatgcttaaaacttttcttgaatttcatacagagatttggcactgtaagtagtcttaacatccttccagtcccctatctatatgccttatatttcctcctagtattccatactgatttaaaaaaattaaatatgtgaattttaagatgggattttccttatgatattacttccctacaatacatgactgtgttatcaatactaactaattcttcccttggaattaaaccttcatgataggactgatgtgactgttgacccttaaaagacttatgaataaggaagaagagataagggaatattagctataaacttcttactcaacatttaaagcaaactggaactgtgagagggaaccaaaccaaggccccagttgtatcaaacacatacacacaactttatgaattgaacaaaattcatagcaatatgcaatgatacagtttgctcatagctatcccacagtttctaataaggatggataagggatgaaatgaaaaacagaagttatggggttctgagtagaattctttcactgtcatgagaaaaatgacattaggaatttactgttgattaatatttaaaatatcccacaaaaccttaccttatatcaataatgatatatatgaggcctatacatttattgtataatgttgaaatggcaagattccttttggagaaattgtacattattaaaatgatgaaactgctaatgagaagagatattcatcttaggaagtttagtccttgaaagtgtctgaactttttataaattcaaaaaaggaaggagtttcaataggtcacattctgtattaagaagccttattagaaaactaacacaatttattaggcaactttattacaaaactaaaaaaaaattattaggaaattaagaaacactcttagataactcttagaaccaaagggaaattacaactatatatgagttaatgaaaaagaagatcccttcctaacaaaataggcacatccagtaaaagctatcatcagtatagaattttagctttagatagctttgaagaaagaaaagatataaaaaataaactatgaatcttaaggaattaaaaaaaatcaaaagaaactaggaaaacagaatttaataacaaggaaaactggaatcactagaatagaatgcaaatgtaaaaatggctaaataaactcaaaatttggtgattctttgaaatggccaacataaaccccttgaggcacaaattatggaaaatatataaagaaagaatatataaaattgtaaatgagaaagcagaagtaaatcccgaaacaagaaaggttaaaagaagtatagtagaatattaggtgtggctctgcagtgatgaagcatgaacatctaaaggaagggaatcagttcctagaaaaaaataaattactaaaatattttcaagagaaagtagaaaactgtagtattccatttaaatactagagctgtttaaagatcagttatcaaaaaagcaccagaacagatggatgtttagttgaatattaccagacgcttgtagcgctgatattccagtgttctttaaatgattccaaccatagaaaaatatagagaacattaatcattttttagagaatcataattttaacattaaaagtttaagtcacattctaaaactttttaaagaaaaagacagtgatgattctatgtcatttgaaaatttaaatgcaaaaaagaaacctacctaagctattagtaaatagcacccagcagtatatgaaaagatcagcataagtgtgaaaaaaaataggatttttaaagaatataatggtggcctatatttagaaaacaaataaaaatactttagtatatcaatagattatatcattagatactaaaaagatatttaatagaattttgcagttatttctaataaaaattctaagactaggatcaatcttttaaaataatgtaccacgtaaattttggaaaaggactaataaagccctctttgggatataatttttatatcattacaagtaatatgaaaatgaggttaggttgctagatataagataaatatacaaaaaataattttgtatctattcaaagggaaagaattcaaaacaaagatatttctttataattgaaaaattataaggtcaattatttttttctgtatgaagtgcatattgatgttttaatttcatttgcagttttgtaatttattatatcattggagcagagattgtggatgcataggctttagagtcagagaggctcaattgtaaatcctgtattcatggtgatagcttcagtagtttacttaaccgctccttaaatgtaaaatatagataataataatttctacatcataacagtattgaaaggacaagtgagatggtttaaagggactagaaatgcctaatggtatgcttacagtaatacaggcttgctttcagtaccattttctttaccatttaatggtaatggctttcgcttaataaaacataggtgtcatatctaatacagggattcatttggatactttttagaaaaaatattttaatggagatttataaaaacatggatttgcttattgcattaacaaaagataattaaaacggaaacctgtgaagttattgagagttcaacctttaccttttcaggaagctaatgaagcactggccatcaaaatgagttggccatcagaatagaatttgctgaaattttgttctttttttttaatagaagatgaacctgaaacttaataaataacactaaacatctgataaaagaatatcattgatgtttaatgagctgttctaaagtagccaaatagggaaggaacctcctaagaagaggagctctctttaatcatttccagtattattttgagcaatgttcgtggggccctgtgaaattaggctctggtgaattttatagttgaaccattttaaattttactccaaaatttaataattatctcaagctaattagcactttatatattttaaaaacattttaaaagttaaaatttcaattttatatttttaaaaagtaatcaattttctccctctttatatttaatttattataacaggagtaaattttctgtgagtcacaacaatagttcattactttggtgcaattaaaatcagggaaacaggaggttcagatttaaaattagaagatttagagctgaaagtgattccagaaataaatgaacacttagaagcaaagtaacttctgagagttgatccagtgcctctttttttttttttttttgctacaccatacactttcttatagaatttacaaaatatagcattttatgcaagaatttactgaaataatcaaaatataaagtgaggcatcattatagtcatttttccatctatccagagaatatcattattgagagtcaccttaattcatggtttattcatgatattgataaatgaatacatttgggtggtttctatggtggcactacagtgttaccataagttgtgcatgcatttttgtcaaagaattgaaattgcatgaaaggtaaaggatgtgctaaaagtgaatgatgtgaactccattaagactgtttgatgtttgatctaattcatgtatagtgtgattaacccatttccaagtatattttcccatttttatttatttacctttgttttcatactaggttccattttcatttttgaatgatatttttcttgccttgaaaagtatttcagattatgtgtctttaaagaaagttttggggccaggagcagtggctcatgcctgtaatcccaacattttgggaggccaaggcaagagcatcacttgaggccaggagttcgagaccaacctgggaaaaacagagagaccagtctctactaaaagtttttaaataaaagttatccaggtgtggtggcacatgccagctgctctggaggctgagacaagagaattgcttcagcccaggagttccaggttatagtaagctatgatggtgccagtgcactccagcctgagcaacagcatgagatcccatctctaaaaagaataataataaaacttgggggtgaatgaagtaccttaagtatcataagtttattgaaaactgctaaatctctgcatctttccttgtcaaataaatacatatgtatatatacatacatattacatacaaatagcatgtgcaatatacacacacaagtagtatgtatgtatgcaaatagcatgtttacaaatacaaatactatgtatatatagtatatatttgtatatatgtatgtatactatatatgtgtatatacatatgtatgtatatacacatatgtatgtgtatccatatgtatatacatatgtatgtgtatatacatatgtatgtgtatgtatactatacatatgtgtatgtatactaaatacatacacatatatagtatacacatacatatgtgaacagaatttgaatataagtaactaagttgtgatttataaatttacctgtattacatatattaatatttaattgaaagactataaaatatttttattgttttataaatatggttttgtattttaatataaacatttcttaagttgctatgtttttacagtaggtatgtatacccaaagtagttaatatattggaaacacttctttgaattgaggtcctctggtagtttgttcagtagttagtgtgtttccacttctgaaataggagtttaattaaccagtgtgtagtctggaattagattaatttctgttttgggattatgctcaatattttaatgtctgccaccagatgggagtgatactctttctgttatatggccagctgtgttggccatgttttgaaacttgagtaatgtacagaacccttttaaaataaggaaaaaagggaaaaaagccccaaattccaaagtgggcttaaactagtataaacatggaattatgtaatgcatgtatgtttatccataaagaaatttataaaataagtacaaaaaatacaaaaacaaagcaattaaaatcaacatcaacttgatggatgatactgttttgctgaaattaaatcactgtgtatgatgtaaatgttggtggtgactgctctagctccctgtcttttgtgtttggtgaacacacaccaccctgtgccatgtgataagtcacttctttcctcaccttcagaaccacctactgcaaatcacagctatttagtgcaccatggtatcattgcactctgtttagcataaatattttcacagttaacatgtgacatctgccctttttcccttcttattagcctagggagatgaaagttaagtagcaaaacttgtgatagttttagaatacaagctaactatattaacattgataaaactacctattcttccatcaaaatatttactttaaataatttctagtataaacacagtgattattttatgaatgctaataagagaaatgccatttagtagaagataaaagaggagtctatgaaatgactgtgtttaatgtactactcaattgattaaatcttatttttaatttaaaaagacattcttggggtttcccccacaagatactaaggcccagttcaccaatcctggtttctcttattcctcttacaagttataggttggggctcacccataggggtgatctaagatgctggactagattttcaaaactactttgattagaatctttgctttgcacactcattactgctgtggtcttaggaggagctcctctcaatgagtatgcaactgaccacagataatccttgaagagaaaaaggggaaaggtgctaatgtttcttgagtaggtactaaatgcctggtgctgacctaggcatttccattacttcttgtgtcaacttggtaaggtcagtatagttttattttcttacagattaaaaaaaagatagatcacataattaaaggtctaaggtgagttagactgagtagatctgaagctcctaaggaaaatgtggactgaaaatactgaaatggtaagttgggagtacattaaccatggagaatgtgaagggtaaaagggaagagagtaaggaaataaataggtgagaagggaagagctaccaacattaaacagacaaaggaaaggaaacaagcagaagatggaacagatgtttagagtaaggatttagtaccttttcttgtttgtatcgcctaatctttgtccaaatctgctgtttgctgacatgcacacaattcctaaacaaatcccttgacattcaaatgaatatattaaactaaaacccattttttcctattaaatggttaatgcatatgaatatgcactcttccttttattctgttttgcgataaaatcaaaccttaaaagtattttccatttcagtgaatacttagcaaatactgtcaatgggaaaaaaatggaatttaaaactacatttaaaatgcaagtaatgtcagagaaaaataatgatatctttatgtgcttgaaatgggacaattagtgaaatcttatgcatgctaattcaaaaatttcaagggaaagattgggggcggttagctaacaaaattgcttttaactattttggacaatgtagaaatattatctgaactggagaccaaaaaatccattacaccaagcaggaaaatgcctacgaagtgacagaattgaatttacgcaggaagctctcaactagcaaactaattaaagcttgtcagagatctgagataaaggattggggcatgtcaacacactggcttatatgtttcttgtcatccgattgaaagtaggaaaggtaagccctattttcacataactaaagagggaaggccagcacaagcaataaaaaaactaaccagtgatttttctttcattctgaaaacaaaactctaagtctttcttgtaacatggatatcttgactttggtgtcaccatctcatgggatttatttcctcccccattagctctgccttctctttgctttactgtttcctggcctagcctttaaatgttcacgctgttcaggcctccgacttggttggtactcctcctttctttcttctgcattttctccccaggtgattctacccatccctatggcttttattatcatcgatatgctgacagcactcaaatttgtatcttcagcccacagtttttcacagagccctagtcacacacccaagagttctccttagctcttctttgctcagatctgccactttccaactctgctgctaaagtcctggttccaaacacaagtcctctctcatcatgatcagtacagtcaccaaattatccaccaatcccattcttactcactacctatacattctctattcggcaaccagagtgatcattgaaaacaatgcataatttgatcatgtcattctcttaagaatctgcaaatgattttcattgcatttgaggatgaaattaacactcctaaccatgtcctgatttgtaccttgctgtaatcacctaatgctggtggcccttcaatcacaatgctcaaggctcagagcccttctttcagtttcttggacatactgagttctctctggcctcaggatttttgtgcatgctgctctctctgcatgggcggatgctgcccttctactgctgtgactggctcccttacatctttcggctaccatgtatcattctcccgacctcacagagaccttttctgaccactctttttttttaaagtacatgcctcctgccccaccttttatatgttctctgtgtttctttcagaacacttgttactatttgtaattgtattaatgtgtatttgtgtgtgtgaattttctctgactcctccaataagcaggaagtctcatgtagatagaaatgatgctagtctaattcatacatttatctccagtacctttgacacaggaagtgtttgataaatatttgttgaacgattaaataaaccattctctttcaaaaaatgcaacttgtgtattctcttttagtctgcctcgttttcttctaaagttagctagtagtaaaatgtaattgtatgttgcagtatttgttttacgaagatgttgacaatcaacaattgtttattgtgcattttaaaagataaatatatttattagcttttaaaaagtgtgtatgaatgttttaatactcagcgacctcactaagcaatgaaatgtgtttttgtatgttgaaatgtgtaatattttatcttcataataaaaggcatagtataaatacatttcttatatattgcatatgcatgtgtccacatagacaaaattaatgagtcttttcacattgtctataaataatctctatattttctttaaaaattagttttgcttgacctcttgttgaatgaaaccttcatttttaattattactgttcaaaggaatttatgaaccttaaatatgatgttagacaaaattatcatcattaaagtttctcaaccattatgaactttctgttattccaactggcactggaatacagggacaatatatattcattatcacttttgtgccacttagttcattagttaaataaatcttcccttgactacctcttgaccatggtttccagatttaacaaatacaaattcaagacccgcaggtaaatttgaatgtcagataaataataagccaatgtgttgtataattacattctatgcaatatttgaaacatacttatactaaaataaattgttattgtagtttcatctctgaaaccatatattgctaatttgtaaattctggagaattcacattcttcttttttttttttttttttttttttttgagacggagtctcgctgtctccccggttggagtgcagtggcgcgatctcggctcactgcaaactccgcctcccaggttcatgccattctcctgcctcagcctcccaagtagctgggactacaggcgcccgccaacacgcccggctaattttttgtatttttagtagaaacggggtttcaccatgttagccaagatggtctcgatctcctgacctcgtgatccgcccgtctcggcctcccaaagtgctaggattacaggcgtgagccaccgttcccggcccacattcttctttaagatttttcctcatttgtctttctttttgtttcctttcttgtcactcctaccttgatttccactctcaatccagaaagaagttctttcaatctctaaaaccctgggtctctcatttcacaagtgtatgaaaattttctcctatttcatttcctttgtattggccagcacccatgcatccttttgttcttatgttagatgctgccttctgattttttgacacccacacaactgggcgtggtctctgctctgctctcagaccttgtgcaccttccctgttatctcacagtgttttgattcctgatttgaaatgtgcatgtatgtgcatgttttagtatgcatgcatacttgtatgtgttacatttattacccataagaccataaattttctgaatatttctgcctcggaatggcatataatagtgatttagtaaatttctgttgaatgactagaagaatgatttctttgctgacacatgaaagtgccctcctctgagaaatgggactgtctcttgtttcccagtctctctgtcttcactaaggcaagacaccaagttaagtagagctaagatacagttctggagcaatagaaaattatactatcttttaaaaatatttttaaacattaatgggcttagcagaatgtcattttaactgttcagtctttttattagtaattttgtgctttataattttaagagtattgattatcttgaataatgttgccatattattatctgggcttagaaaaaggaaagagtaggaaacacactttattttttatttttagaatctcctggaacatgttagttaaatttaaaaatgtaaagaagtatcaactacttgaatatgatgttattaccaaatgtagctgttattgtaaatgtactatggagccctgtggtaatggctgaaatggtaatttcattctaaactgtagttttcaatggcttatttaacacgaactcccagtttacactgttgactgaaacttctcaagcttgtttttatccccgaggggaattttatagagatgacacaaaaatctcttttgcagactttttcaagcacagtaaaaatgattttcctttaactattaaaaatttcaggatattttagtgacttttgcattttttaaaaatggtttccaaacttttttcttcatatgggcttctttcccagaaaaaaacaggctctgtaatttaataaagtttcaaaaatgtaaaatcattaaacattatagaaaatcaatgttttaattgtagaaaatgatttcttagtgtggctcctatcagaccactttggtagattaatattaaagttgccaaatttattttcttttgtgaacttctttgcattaatagataatcagtttattaatagcagaatttgtgattgactttgatgtcatgggactctttttagtattttcatgtgcatttttgtctttgttctattcattattagatttttactgttcttttagatatccatataccacgttcatctgttcattgtagttcgtgtgtgctttctggaattgtcatcattattcagaatctcatagatgtttaaccacacaaatacggatggtgcttgataagtgctgacacaggagattttcagacgttacttcaaattctttttgcattgagactgagctaggttgcaaagtggctaaggaatgtatatgctaagatctggctggaaagttgataacttcaggagtaagaaatacttgataatagaataagaaacttagtggcttacataagaggggtttgttttgctcactttagcttaggtcggttgagcatctgagcagagtacatctccagttcacctgtcttctcctggagacagaatggccacctctcaagcatggtgtcctcttacagaaacctccagagatggaagaaagggccaagaccttggcttctaagtctccttttttttaagatcaggaaggaacctcaagaaggagtctgaaagaagaagcaaaaatacttaaagatcaacaaggtcactcttccacttctttgccatgcaaaccctaaagctgggttcttcaaagtcatcgcttggatgaccagaactaactttggtaaaatttaatatctgaaatttcttttaaagataaactagccatctcttctatatctgatttacaatagagcagcgcaaaatgtagtaactggtggcagccttcatgtttgagagtagtccctcttgggccgtcatgaaggttaactttttgtgtgcttgcaggagatcattaaagcaagagcaatcagtgttttcttttgtttttggttggttgtttggttttctggtgtgtctttgtattcatattcagagagatatatagacttgtatttcaaaggaatatccaataggttgcttttacctggagggttcttttttgctctttagcatgtatttggagttcttttgaataaatggtcctccagtttaaactcattgggagtttattgaattgtttttaagtaaatgaaaaatctgtatttttatacctaacacaatctggtaggaatgggttaagtccaaaaactttatgatgggaaggcatacaaaaggtaaatcctcaaaatagaattatagttcaccattgaagtcatattattctgtaacatgaaaatgaattatatctttgtatgctaatagcaggttcttttattactagctattcatgtagaagcataatcaatcctagcatactgagtggttactagatattgagttatttccagaagacatttattaatgtattcaggtttgcacagcaaattaagtacatctatgaaaactatagaaaggggtgattaaactttaatgcatggtttgtagtattttaattaatcatacattattctgaagtcctataccaactgaaattcatactagtaaaaacttgaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaggaagtggagcttgcagtgagccgagattgcgccactgcagtccgcagtccgacctgggcgacagagcgagactccgtctcaaaaaaaaaaaaaaaaaaaaaaaaaaaacttgaacaactttctcttctctgtcattttggaaaatcatggaatttctttcctcatttatttctagccaggtggattttttgtgatttaagatatttaaatgaatgtatgagctaattcatttccctcacatcttttaaaactctgttagttttttttaacacttactaccttttgcatttatacatctacatcagtgaatgatagtattaagtttctcattaatgttcagcatggctttaaatccaggttgtaaggaataagaaccacctccttgaatattcctttcttttctcaagatagtattctacttacttttctcataaagaaatgcacctcttggacacagtgagtcactatttatataactctttccacaatttcactttctagtaaaaaaaacttaaacttttgatgttaaaaataacacagtgtcaccaagttaagtgagcaaaaaatacctgctgtttcagaatgcagatgcagccacaatctgtaaattgtgggtttatttttagaacataagacatagcagcttggttgctatgctgttctcaatttgtaaatactctatattgtgtgatcatttaaaccaaaagtttccaatcaaacagaggaacacattccttattctaatcataaggaataaataatcacatgcagtttgggagaaaggtggatgtagtttttgcaagtctcaccttcaaccactgtgtgctaatcccagcaggctgggtgaggtgtgtagatggtatctcacgtggagatcttgcagggtaaaccttaagatctactgacaaatactgattccagttggaagcattagtacattttgaaatatttaataattttaacttttcttagatatgccccacttggggactatctttaagggccatgaaaccggtatgatagtaattcttaagatttttaaatgaagaaaagcaggagaaatgttggtaataggatcagtcaaatatctgctagttgaaaccaccagatgcaaatgttttaagtttcttcccactgctactttccactctaatatagcttgttgaaagaaaataaaatttgatcatgcgggctagtcaggtctcttaaagttacgagacctctggggtgtcgatttttctggctggaaacctctgtggccaaaacacctttgcccgagttcttgtcctgcatacaggaagaatgaggtgcgcagacaattgaagggtgaagaagaggtttatttagtgttagacgagctcagaggagtgggcagctccgctctataggcagattgtccagtcgagtgttcagctcttagcagagagaaggccctggagagggtggctgctgactgcaggcaagtcatttggatgtctctgcaggtctctgaagttctcagcagagaaggtagctcctctctgctggcaggtcgtctctgcagctctcagtgaagagggtgctcctctctgcagctggtcaaggatggtcctgtcatctctctgtcctctttgtcctctggccatgctctgccctgttctggctgagcccagggcttttattgaccgcagaggggaggaagtgcatgcccattggtccatgggcggccagcaagaggcaccagaagtctccactcctgtcagtgggactggcagcccagcccccagccattccgtggcctgtgggtggggccttactggggaccccaaccccactccaagatcagagcagacgctgggaggagagaggccaggctgtgggagcagacaactctgagcctgcaggaacagggttgggggatacttcctggggcccccgagggtgcaggctgcagagatgccccagtcctgtgcctgggagggcagccacagctgcacccgggagctcacgccctgccaacttggaagaggcagggcccacacttgtcccggctcctagttgcttcctggagtgggaagcccaggtctgcagccgggtgtccagcagctgcggctgcacatggaagggcagatcctgcccattcctcactccctacaagagcacagggaggctcgatccatagctacagtttagggagctgtagccccgccctcctgggtagggctcctgactgctccgtggaacaaaagacctgggtctgcagttgcgatttgggtggctgcagcggcagggggagctcccgtccggactcagaagactgactccatggagtgtgcagacccagggcgcttccgtgctgcagccagcatgatggcagcagccactgccattattaacaggctgaaataaatgaagaaataaatataataataattgtggtttaccagtttgggtgccttatttctcctacttgtgagttctttagtggattttcttctatatctccataattttaattttttaaaaacctaatacttagtttttggcaaaaaccaatatatcatcacagtggttctggataatttgagtttggttcattgaagctgagttttgtgattaacgcttttgctctggatcacgtgtttaactctatcatgttctgtttgcttacattttggaggtttatttcgatttcaagatatttcattttggtttaccgccttgctttgtagttcatgtttccttttcttcactcaaaatcaagactgtaaagaagttttctcacaagtcatggaccgatattttaaaaatcatcgcaataaataaaaggctgaaaattggaatatgtgtaaggtgaaatctttcttcctcacacctctaagaagcaagaatgcgactgttaactgcctacagcacagacaggaacagtgaatgcacggcgctgtcatgagcacgtgaatgagattggcacttcgagagaagcaggcctgtgcactggatccttggggaaaggatgttgttgcctggctgatgacctcttcttacactatatctaatgtgttaaaatgttacaaggagaaagaaatgctacagtaagccaaggctggatcacactgtggggcattttgactagctccagctccgcatagctcagataagtgatcgcattagagcatagaatggatgctttcatgctagtaccaccttcaagttcctgagtactttttccccaataccctctgcctctcaagcctgcctatgcacttgtctgttttgaaaaatgtgtaaaaagatggcaagaagctcttatcaataaagcacatagttttgacctagatactttcatatgagaaggaaaaaaaagataaggcaaaattcagaagaaagcagggaatcaagactaaggcttgaacatgtatcttttgaaaaggaatggatttctcaatggattcctttttaagtgccagaagaaacaatgagaaacaaatgacataatgcctgggaacctcttactgctcggcaaatagtaaatgcttaatgcatttttgctgctgttaggtgaagaagggacacatgatttgtagtataaatttaggataaatgatatctgaaggcaatatgagagtcaccaagtttttgagatcttgttctggattactgtttagccgctaagagatggaacttcacattgcatgtggattacctgtgtcataggtgattctatcagctaaaggtaaaaggttttcttttctgtaggcagattaacaatatctacatgtatagcggaacataaataagcataaggctggaaagttaatttacagctcaaatgagcaaattcaattttctttacatacacactttataacctgaacaaatacctattttcttattttattttatttttatttttaggctgtgcttcatcttggtcaaaaatgcctattttctataaaaaaaagttcttttaaaaatatgtttttcaacttgataggcatcaaaagccttgaagtcaagatgacattacttgatggttaacaaaatccctggcccctgcgttgggttcttgaagttcgtagttattttcagccgttatttaatacatctgttagccctggcatcatgaaaaggtaaccaaaaatatatttctctagaaacaaaccaaactagaattttataaattactcactctgatcgttaacaataatcacgaacattaaagcaaatttaatcaagttaaatagaatagaacatgaatagaaatgtccaattattccctttttttgtaatcggttctaagaaaattgccactttcatgaaatgccatgaaaaaagaaaagaaaaatttcgtaatggaaagtgaactttaaaaaaagtcaacaagtcaacattgcaattatcctgtggccttttaatattttaatcatatatttttaatcacctaagttaatgtatgttttttaaaagttgaaaatcaaaaaaacttagaaaataaaaaataggataactacctgaaacatagattttttcctaatattttccgatgcaacattttcttttttctttttttttttttttttgagacggagttttgctcttactgcccaggctggaatgcagtggcacaatcctcagctcactgcaacctctgcctcccaggttcaagtgatttgcctgcctcagcctcctgagtagctgagattacaggcgcctgccaccatgcccagctaatttttgtatttttagtagagacaaggtttccatgtaggccaggctgatctcgaacttctgacctcaggtgatctgcctgcctcggcctcccaaagtgctgggattacaggtgtgagccacagggcacggcctctgtgcaacattttcaacatgattgaggttaaaaaaaatagtttatattgtcaatatttaccaatgacattaaatattcttctgtgtgaatgttcagtttgaatgttattatattgtgttagtttctaagattttttaaactgggtttttattgattgaatatttagttttgctctattacaaaattttgtacaattaacatatttttgtgtgtgccgtgattggttgactttatagagcaaagttatacctcattattctttcagtggattccttaaaaacttttaggtttttctggggggcgggggtgaaaacactgatatattataaatacattttaaagtgaacggttacctttatctttttaaaaatataaacttgaatttccatatattgggattaaagtacaataataaattatagctttgtaggagatcaggttaaatttactatgctaaatgtaaaaggcagcaggcaagaacatctaatcatttcgttccttaaaaaattgaccttggctagaaagaactgttttgtcttcctctgtgaatacaaaataaggaaacattttcttcaattacctctttcagcattttttggcagttttatgattttgtaaataaatgaatgaccatttgcctttttcaaaaaacactcttgttttatcttaatatttttttcctattagagaaagagagtgtgtgtgtatgtgtggttctagcatttcttttgagtgtttgattacttctatgatcctttttgtgtgtaattgcaatgactttccttctttaatgtctgctttccttagtctccctctgtctctgctccgtgttttatttcctaataagccacagtcaatctttgtgctcatgttttctccttctgaatatattctttcctgtgaccccagacactaattattgaacttcaaactatttattgaacttcaaacatgcatagatctgtgttggaagttgtgaggcactggttcttaaactttaatatgtagaagaatcactgggagctcatttaaatgcaggttccaggtcactgtttactgaatttctgattcagtaggtctggggtgaaacttggcaatctgtgttttaaaaaattgctctgcacgatctgagacatgtggtccctgaatcacactgtcaaatggtatgttcaaataaatatgagccctagacttccatgaggttgtgaatgtcagtggccctattttagagaaagcttcttaaagcaagaagatattgagctgggccttgagggtagaattttattcttttgagagaaggtcacagttaattttaaggataaacagactgtgttacagacccctgtcatcttccatctttgctgattggagccacctctgtaacttcagtttgtttgtattccattaactgactttgttttctattgtctaatccaggaatgtaacacttttcaaataattcacaggatagaaaaaatatataagaaatttctaaatggcatgaccccatcactaaatcatcataaaaatgagaataccctattagataatagggaacttagttaaatagggaacttaaaaaagttatctagtgataagatctctagtaaatagaaatatctagttctctagtatgtagaccgcctatgtaagcgaacagatgaaagatataaaagggaaatggctaaggagagacaacttaaaggtagttaatgccaccaaaaaatacctgttatgtacactaagctattttcacttgatactttttgttattggcaaccaaaaccgaaattcaagaaacaatcccattttccaaaagtgctttgttctgagagttattttccaaggtttctatattttattgtcagttgagtttattctcatctaaaatgagcacaggatatatttatcaattgcattttgcttatgctcttttcaataatttctagttgttaacaggacatgttgacattggctttctcatttttaaatatcttgtatggaacagtagttgttatgtttaaaaaatcagaggctgagatattatcagtgaatgctttttagttatatatctttttgatcagctgaaataatgatcacctattccatgatataaaatgtgggaataccataaatgtcattaattatccaaactgaattgatttctttacaatttactttcaactgaagaacaatgggagaattagttgcctaatgcttgaatagaagccattgtaataatggagagaattggaggtatataattggtattgattcaaattgtacaaaacccatattacctaattttatggcggtggacaatgcctatttcttcttaaaatattaatagacttaggattctggtaaagagggtagagaaggcatttaggtaaattgaaataaggcacttagtcttctaagaaagatgtatgctggacatgactcagaaacactttcgggggcttgggaattatatggctgctctgtaacttacagaaaaccaaacatacctctttacctgattgctgaaacatttgcacagaacgcagttttaactacataaaattttattttctaattatttttaagcatttggtatttctttatcaaaatactcagttgcattatgtaaaacgaggtgcttttggggatccatggataaaaacaccgaatggaagtcaggagacttggatgtctgtctgtttcattgtgtgatctttagggcctagaacagtgctcggcatgtagtagttactgaataagaatttccagaattaatgcacgaatatgtttctgaccctgttacctttacaaggatataaaaaatgtaagttcttctttcttaaatttaacttctattttaagcccttattcctttgggcaagataaaacatgttcctaatcaatgtcaggtacatcctatgtcccactggagttacagccaagtactcaggagtttgtggagtgtcaaggtattggatcagctgtctcaccctcagggtcatccgtaggtgagggcatcctgagagatgcctgttgacccagctggtcccagctcttggtgcatgcaggtctgtgctgagttggtccttgggctttcatattacaatggctgactgagcacatgctatagcctccctctcctggaaggctgggaatgatagagaagatattttaaataaataaatatctatatagctgagttcaaatattggaaacttttagtggatcaagaactgtaagtaatcctcaaaggataggactggattgaagaaggccttctgtgagtgccaacagcattagacctaagccagggcaatgaggggctgacttctgggagcagcagccaggtcacataccagctgtcacacccctccctggactcggacacttactgtggttttctgtatccagttgagagcagcaagtgtaggagcttggtttcaggggtctagggtggtacccacggtgagattcatggagcacatgtatatccatagcctggaggaatacagtctgcccattcccatgcctaggtgatcggctctggaagtgaccgtcaacagcaacaccctaccactgtccttgaatactctgtccagatgccccctatggcctctgcctgactagtggatggcacaagcagaaacagcagacagtccaaaaggggatttcaactataaataggagcacaccatcaagactccacaaacatttgaggaaagtgtacactgtaaaggaaaataaactcacagccaccctgaaatggaaaggattcattctgagatgtgagaaattgtgaaaagctttataaatacatcagctatctagataaatttcttctcaggagtctttctttttccctagagctttgcttagaaaagagatacaggttccctccaccttttgtgggaagtgctattcccctgtcatcctcaaaggcttagggtgactctccatcagacctgcccaggtctgagtttgcacttggctaactgcaacctccaccttctaggctcaagtgatcctcccacctcagcctcctgagtacctggaactacatcaccacacccaactaacttttggatttttttgcacttgttttcaaataagttacagttattcatactgtctcttttgacaataaatgatatgattattatactcaaagattatctgagagacagggacaagttcctgggacccttttctcagagtcttgtgactgcgacacactgtttcccctttaaagtccctgccttccttcaggctacggagtcctgtgaggaggagggttggggatggagagactagtttttcctcctcaaggaatctgccaagcctattgcctgtccactgagtcccttctttggactctttcttccctctattttctgctaaagccgtcctaatcttaaatgacaaatctagaatggcataggcggatcaaatgggggagaaacaataggtaaaatgtggagtcgtaataggaaacacacacacacgttaatattttaaacatggttacatgacagcccacttagtatccatatggcctttgggaaaatcacttattttaagcatctgtgctgtaatctgaaaagtaccagaattgtaagatttcactgaactctcataataaaatcatcaagcttagagtttaaaggaactttggagatgaattagctcaaccttccaccccctataggccttctttccaaatatctttgccatgtgattatccagccactgaaaggaaatgttaaagaataaagtaagaagaggagttaagaataacaataatttgtaaaaaataaatttaaaaggtgtgttggatggaaaagaattcaggagacactgtgtggacatgtgtaacatgggcatcctgtcctccggaaagacatttaagatgttttgcaactcactgaggaatagatgaaattaaacaaaacaaagcaaaaatttgacctagtacttggttcatagtaagttcacagtaaataacaatttgtttttatttgttgctatggtcatgacggtggtggtgattctttaaggtctggaaaggacactgtctacagaaagcaaattatatacagaaggcagatagttacttccagattcgactacttcgtgctttcccgtaaattgcctgattatgaggcaacagttcccagctgatcgactcctaattttaatgctccagtttcaagtatcatcacattttaaggtaaaaggtctctatccccatgctgggcgcggtagctcactcctgtaatcctagcactttgggagcccaaggtaggcagatcacttgagctcaggagttcgagtacagcctaggcaacatggtgaaaccctgtctctacaaaaaaatccaaaagttagttgggtgtggtgatgtagttccagatactcgggaggctgaggtgggaggatcacttgagcctagaaggtggaggttgcagttagccaagatcacaccactgcactccagcctgggtgacagagccacaccctgtctcaaacaaacaaaaaaaaaaaaaaagaaaaagtctctatccccatagtttcttcctttgaccccagtggtaggctgtgtccctgtctgagttccaggaagctagtctcccattttcattttgccccagctgcagatccctccctgtctgactgggcctatattaaggggtcattgacctctacctcctgggtcttttgcatctttcaagacagaattgtggcctcagtgatcttggagtctcgttgaatagcattctccaaattaggctcagagaaaagtttatatttctcttaggcctttgggcattcttgaaaatactcacttgcttctcttctccactgtaaatgcaatttacagctccttaaaatctacagcatcttctgcaacactttctgcatctataatggaatgtttctgccaccactgctttcactggctctccctccactgttcagatttgtggggtttttttagctcagttgtatttatctctatataacaatgtatacccgtatgatctactttacagaaaattaagataaggaaatgcatacatataaaataaataatttagggagaattactaacattataaaactgtgtttcgcctcctagagcattcactgtaatttagttttaacagtgggttttcctggtgtatctaaaatatagtttaactttctttaaattatttgttttacacctagaaaataatgtatcggatgaatataaggaatttgtttttcagatgtgcacatattccctaggccacaaccaactgggagatataactagaggtgtgttaattataaaagcctcattggtgggcgggttggcatcccaccttgttccccactccactgcctcttagcctcaccatgtccccgagcccttttttatcccctggcagatcccaggtggctcacacctttcaccatggcggtcatgaaagacttcctgctctggagtctctgccctgttcccattgcagccatcctgccccgcagcatgcagctgtaaaccgccccatgctggagcccctttcccatctctgtggtcctggccttctgtttctgttccatggcagctgacaccgcccaggggagttagggtgaacgtttgtcgcattactgtcttctgatgttcctagtattttaactctttcaatgtcctgcagcctctgcttcctacgtcactgtaggcttgcaaaacctctgtttggaggaagacaggagggaccagtgagtgtttaactctcttcttattctgggtaaggtctctgtgatacagtgtgaagagaagtcctcctgcgtcttctccccgatcccctattggaacacagagacagtctccatggcatctcatccctaggcccactaggcagtttttgcaccagattaggctgtttctacactaaatgttacaacttggggattcctccaggtatcacctcaggaactggaaatgttttgcaacaaatcgggaaagggggatgagcagcaagagaggaagagaaagcaatggtaaaatattcctgatttggaaatttttattttattcttatttttggactgacccttattgcctctcggtggccacttttaccatgaatgtttttggttttggtgttgttttaaatgaggcagcaaataaacaaaacagaaaatctcgggatttagagatttatcttcccttaggatatccctccttcatgaatatttataatatagatccagctaattctttcaaactgaaaaggtaggttacttgaatgttatttttagtttgagtccagtcaacaaaggacattttctactgtagatgctcctgttctgctaggggcctctcaggaggggaggggacagtcccactgatgtacctgcatttcttatctcttttctcacattgaaaagagttcacagaggtgtcaaaaaaatgtgtgatagacaagaaaacattgagtgtatatgtaaaatgaaggcttttccttgaatgtaccacactgagatagaccctaagctgctgggagtcaggaccttctcactggagcctcttgaatttttgtagtaccagaaacactactaggcctcatggaggccattgtttcagaatttcatcagtgaggtactattgattcaaaagagttccagggaatcttactcttagggcattcttgatctaaatgctttctctaaaactgctttcagtaatgtgaaaagtcaacctaaatgtgaagtattactgctgctcctgctagtgccagggaatcattgtaaaactctgaaaagaggtaaactggctttttcatcagagcaaagctttgcttgtgtatcacaaacgtcctctgtcctgaatgactgctgcagtgtggaactgggaccttagccaccgtggaacttcaggacagcaacaggagactgaaggaaccatagaagtttttgttttgttttgtttaaaaaaagaaaaagcaaaattacttgggtggctggtgcacacctgtggtcctagctactcaggaggctgaggtggaaggcttagttgagcctcggagattgaggctgtagtgagttaagatcaagccactgcactccagcctgggtgacagagtgagatcctgtctcacatacacacacaaaaagcaagtttcactttcctatcatccatcacctttaacacttttctactaatttttttagagggcactatttttctcctgtcccctgatccaatagacactctttggaggcatttcttttgaaagattttcctacttttgaataaccttcttttctgttactagaccgccttccagtgagaccacatcagaacagctgttgagtagacagcttttggcctcacactgacctgttttccatctacctccatgccctagacttttgcaccagtgatgtaatctttctcttttctctttcctgtaatatgggaatggtggtagtaatagtatacacactattgggttttacaagaggtgaatgagacaagcacaaagaacatggctatttgatcaatgtccacaagtgttattagtgcattcttagcagaatgaaatatggaacaagtcagcttcacacatgcatcaaaatcctttgcccaaatttcttgttatttcaaatgaaaccatctcttaagacataattgcatggttctgtaccttcattttctacttaacttcattaatatagatatggtttgcatgcaaatgagcagacttattatgtacaagtaacatggaatatatttgggaaaaacttaccgcttcagaggggaaaaggcacgggctttagcaatactgtgagaaaattctttaaatctccctcagtggattaaacaaagtatctttgaggtttattagaaaatctttgttagtgagaaattacactttaaattttattcttcttcctacgaagtggagttaccattcagattaataaattcaaatgagcagaaatgtttgagggaggactggatttctctggattaatatctactttctgtttcttgtatgaaacaatctttaaaactttttaggctgaatatttatacctaagaatttgcttgaaaaatctgaatctggccaggcgcggtggctcacgcctgtaatcccagcactttgggaggccgaggcaggcggatcacgaggtcaggagatcgagaccatcctggctaacaaggtgaaaccccgtctctactaaaaatacaaaaaaaacttagccaggtgtggtggcgggcgcctgtaatcccagctactcgggaggctgaggcaggagaatggcgggaaccagggaggccgagcttgcagtgagccgagatcgcgccactgcactccagcctgggtgacagagcgaaactccatctcaaaaaaaaaaaaaaaaaaaaaagaagaaagaaaaatctgaatctatattggtttgaagtaatgtggttccattcttttggcaagacttaagatatatagcctgaacaaaaggctctgtagctttcacagtttcaaatatgctcataaaaccccatagcataaataaaacattttagaatgttctaacaatctagaattataaatgagtcatgaaatataagggggaaaatttatatacaaattcagccttgaaccttcctgaacttactcagagttgagttaaaaaattttaaatggagcttatcacgtttgtgctttggtattttttatttttagtgtaagtaaaatagatacatatatgtgctttgtgatttttgatttttcatttacctctctgtaaattgtcataaatgcctgtggatttgtgcctaagccttatattaaataaaaaaccaagttgtgggttcactagcaagaggaatattacttttcctacttgcaaaaatacaaacaaaaatacaaaatattttattttcagaagaagttgtaggaatagtataaatggcatttattaaaacacgagtattagactaaagtctatacatgcaggttggtggtttttgaaatgacttgattggttctttacaatttggtgattgtgttagtacttccttattttggtgggaaatctgtgttcctgaaactaagaaccctctgtgggagttagactttcagagtctacctctctgcctgcttaatactgggcccatcccctacccctacatgccaggtaactggtacaagaggttaatgggccctgctttgagaaacagcttcagagattagatccactcatctccttagggcctttctagaatgctccatggttttccatctcctagaatgtgtttattttcattacagttttaggacttaaacatacagaaataataacaatacacagtactttttttctgcctcaatttccctgaagaagtccgtctttggaagtcaaagataaaataatttgagataccagcttgatgtaagcaccaaaacacctactggcctcttttgtttagaagtgttgtttctgttgagtatgactgttctccagccatcattcagggaagagtatgtgatgtgttttctatatttataatgcttagaagatcattagcacatattagccacaaagaagcactcttttacattgttaagtgtctgcactcaccagaggctctactttgccaggttagttccctttgttcacctctgtcattgtcaattttttgaagtggaacttcacacaattgtgagagagttcccacaagttgcaggagctgcaggtgctgggggaaaggcattgacaacacagatgcatacaggcaaaggcaaccaagtctatggagtggtgggagaaccaggctcaagattttaaaagcacttggagtctttgtgttccctgtcacacaacttgaagacctacttttataggtggaaaacagcaggtggccacagagacataggatctgctgtcactgaaggagagacttgttcgtagcactgtgccctattgctaatctttcctactccataccactgaaggagagggggcagtctgaacccagggtgtagccatccagatgaggctcaaagctggacaggatgtagtgaaaaaatggagccaggataatgaacaattaagagcacacttattgcacctgtggctgtgcgcaactgagtaggggtaccttagaatgatgcatttccaaaatttttggaccagtctacacttcaatatatgtaaccaaaataaaagttcatgaaatatcatttatacatattccatgcaatactttatgatattttctattctatcttctgccctgttcttttcttgtataatttattctacatagctattaaaataacatctgacctcaaatcattaaattccttatgcaacccactaatagatcatgacctatagtgtgaaaaactgtagtttattcttaacatatttagctaaatatgaataacgtgaatcaaaactgatgataggcatctactggattgtgtttaaactattttcagacataatgtatgtaaagtgcttagcaaatactctggcacaccctatgaagtcatttgttattggctgttatgttcaatatataaatcaagacagttattttcatgaaggattccaatactttactgtgttatttgaaaaccaaacccaaaaaaatggtaatagcaacacctgtaacatgtagaataattgttttggagacggcataggggagtttggaccattgttcattgattagtatgtgcttctttatttgccatgaaatgactatacacatttccttttctttatttatgtctgtaggagagattgaagatttgtccaaatttcctttaaatgtttaactttctttctcactaccgagctgacctctttcctatcccttctggcctctgtgagctccgccctctttcccagttcatcatgagctgggaaattcttacatcaatgctgacagaggaaacaatgcacctacttcataagagaggattaatttctttcttttgctccaagttttcaaccttagagtgtttatatttttcatatactttgacctatggaatattattaatagatttcctgatattaaatattcctttactctgtaattaaaattgctaatttatttatttatttaaaatatgacttaatttcttatgccagcatatcatttggaatttttgaaattatattcataaactagattagcatataatttctgattcctggattcattcattcacttactaatttatgtatcattgaacaaatatgaatcgtgcctggctttatggaatttatagtccagtaatagatacatataagtatccttgaagaagtgacatccaaactgacctctgtgttaattagaatggggcactgtaacacagagatctgattatcttaactgactcaaatgagagatagaagtttcttttactcctacacggcagtctgaagtgaagcatataggcctagtggggtagtcacaccaacctcaacatgcgacccccaaggttagctccattcctctgcctttccaggccagccatcaagaatatgtacacggagtctaggacaagtgtccttacggagatagcctgaaagttgtacacaagtcttctgctcacatcctatatccacacttagttgcaagggaggctggcaaatatactctgtattgggcagccgggtaattggtgaaactgagggtaccacaaagaagaaaggaagactggataaaggagagcaattagcattcgctgcccaatatctaaaagagtaaataggaactaatcaggggaagggtatagggagtaagaaagactgttctatccaccttgcagttccaaagaggatactgagaagcaaatgggcagttttgtaatgcagtgttggaaatacaatgaaaaggtatgtgcagcgtactgaccactgaggggcacatgtgaggggcacctaacccaagcttggaaggcaagatgagaggagctttcctatctaggctgaagtctgaagagtgaagtcaatcacccaataattgttggaggacaaagaagcatgaaatttgaaggccctgacataaggctgagcatagagtgattaagaaacgtaaaaaaattagtttggctggtagacccattgcagggaaagtcatgacaagaaatgaggctctgagaggttagctagaggaagatcatgctttactgaaagctaaggagattggactttattctaaaggcaagaaggatttgttcaagggttcaactcaggagaaggatggatgctatttattatacaaacccagtctgagttatagctgccacactaattcctgtggccgaaggaggaaggcacaaaatatgaaaacttcctgctcaaccctctagaataaagctaatataaatgcttacaatacaccttaatgtggttttcatacaaactacttagctgcaaaatacttcatttagttaatgataattgaatttctactctatttcgtactcattgattgaactacataatgtgcataccctgagaaacaaacaaaaaatcattctacagtgacataaaatagagccttataaatatatttatcaacagaatgagaggaagaagtaataaataaggaagaaagtacagtagccattaaacaaacaaatgatggaagacattaatctggaagtgtatattatggtaacatctaaatattggatacaggaagataccctgtattatttttaaggcatttcacacaccctgctactgtacagtgtgttcctgatgatgtgggtgtcccaatttgaaaaaaatactaatatgctcaatgtctagagtgagagaggcctgagagataattagaacttatgaatgaactagggaaacaccccaaatgccactccattaatttaaagtgaggaatagaatggttgcacccagtggaaatgcttctgttagcataatcagcttatgtcttatgtcgctctttagtcaagctttatgggaagccaaatcatagtcagacatcacttcatcaatttcctgggagaaatcactgtaattcagactagaaataattgtgacagcatgatggacacattctgtgctcatagacaggcttatgtgggaatggggaggttgcttggtgagcagggaatcaagagtgttggttgaataaaatgtaaagaccccttggtgagagaatatggtgaccctggctcactttagattttggtggcagttttctttattaaattttagcttaattctgaaaaagtgatactcaaaatagtattgtcttttccaagttctaaggagcacagtagcctccaatgcttataaatatacaaaagaaaatttgagttaagaacaaaaatattttagatactattatagtactgaggagcagcaaaaatccataaaaggtcatttggatctgcttttttttttttgtaccttcagataattttgattagctttcatttttatttgcattacccagagggcacacactggaatccaccagaactgaatacacattgttttgtttgccttgcagtgcatttttttttccaccggatatttcaaatgaaaatcacataaatctgtattgctgactgtcatcttgaaaaaggatacctgttgaattgggtaactcttttcatgaaaataacttaaaaaactggatgaaatataaaagcatcttttgaatgtattgtgacttttggaaaaaataagatatcccaaaatgctgaaaattaactgaagatgttcggcttgaaatacaggcgccaaaaatggatttcacacttagggtttctggcaagccctgattcagtttttatttgaaggatgaatgtcccggaatagataagatatgaagtctagattgtgcttcagatgggaagttgaacaggagaatctccgtatagagtgggaatacaaaaggacaacaaactataaagtgagagcatcttgtctgtgtcaacttcgatttgagaggagggaaaaaaagtttcctctgaaaatttgagttggccctaaacaaaatttcagccaaaattcatgctacctgtgtgaacaaactccaaatagagaatttaatttaaggtggtcccaggatggtagtgaaataaacagttggcagaaacaaattttctagaaatatgaagtttcttataaggtcttaaataatttccacaggtgtatttcaagaaatgtgggcttaagccaaaaaatatcagtaaagctcataaacgagtgccagtagaacaaacagcaaaacacaggagaattacatctataaaagctacatatattggaattatgagacataaatataaaaaataattttgtgtactctgttttgagaattaaggctttaaaatggcaacaaataaagagatattaaaaacaacataattaaaaacaaatcaaatagaacttttggaaattaaaaatatatatatctatatgtgtatatgtaaatcactatatgtatatatgtatgtagtgatttaaattaaaaattcaatgagaatgagatatatctgctccaaaaaaagagaattaatttgttccagatgaattatctcaaccaagaataaccaaatcttaaaatataataaacatttttatagcactagaaaagtactaagtgaacaagattctcttctggaaagagaataaattcagaaatgtgaacattttccaattaaagcaatgactgagcaatgagaagctgagaagagcttcgggcagtttcactgatctggagggacagaaattgaagaacaaggtccagaaggcacctattcccatcacgcttgctgcatacaaattatcccaaatgtagtgttctgaaactattttctatggtttataaatttaaggaagtcacagcacatagcatggtggcttgtctctgtgccgtggtgtttgaggcctcaactagaaagattcaatggctgggggtaagaagactggaatcatctggaggggtattcattcaaatgtgtgagacttgatgctggctgtcagctgggatccgtcttcccaaacacaactgaagacatcatcccaaatacaagatatggcctgttcatctagtatctccaaattgtcttatttgggattcctcacagcatgggctttaaggctgagaatatcactttaaaaaagcagaagtacaaggcatttttgtgatctaacctcaaaaatcacatgtctggatttctgtcattctccatcgacagagttgtcacagatcctgagcatacactcaggatcaagggaaatagacatggttaaaggcagattatcgttggaaaatagaatctgtcacaagactctgggcttttattttggattctgaaatggctgaaacatggaaatcagacatcacaaggactgaagcccagtttcaaatcagctgagtctcataatgcattaagatgccatgttccttctacaatattcttctcacagcaaagaaaatttctctctggaagaaaatattatcatccataactttctgtatgctctgcagttaatacacagtgtatgacattaaataaaaaatgagatatgcaaaaatatataatggccaaaacaaagaaaaaggtagcaaaaaagcaaaccacaaaagatgtagatattagaattatatctacaggggtatttaaatataatagatcgatgtaattatgcattaatgtaatactatagaaattaaatgacaagatggagaattatagcagaagaagagagctgtagcaaagaataaaatggaaatcctagaattgaaagttataataattcaatgatttgaatcatagttttaacagtagattagacaaagctaaagaaagaatgtgttaactggaagatgaattaacattaatttgtagaataaaacagacaaaatgatgaaaatccagaaaaaatataagacataaagcatagttaaaaatatcttgcatatacatacctaaaatacccatagaagaaaagagaaataaagggacaaagtcaatagataactggtaaggattttctaaatctgatgaaagccattaagccacagatttaagaaattctaggcactgcaagaaaactgcatgtattagtacttatttcatattaaaatatctaaaaccacaggtaaagagacaaagttaagtgcaattagagatttaaaaaaagatgttagcattctgggattaaagtgatagagatgtctgacttttcattagaaacatgaaaaccaaattcagtggaagaattattggaacactgaaaataactgatattctattatttttatactagcaaaatgttactcaaaaataaagttgaaataaagacactttcatataaagaaaaccttagaatgtgtcaccagtatttccatacgaaaggaaatacttccagcttcatccatgtccctgcaaaggacatgaactcattcttttttatggccacatagtattccgtagtatatatgtgccacattttctttatccagtctatcgttgatgggcttttgggttggttccaagtctttgctattggaagtagtgctgcaataagcatacgtgtgcatgtgtctttatagtagatcagctaggtatgtattattcgccccattttgcagatgagaaaggaaagcccagagagagtaaaggatttgcccaagttcacacagagaacaggtggtggagcgaggatttacacccaggctgcagaggaagtgggggcagaagagatgaacctgcattttatatcatcatcacacttgtttcttgaatttatacagtaggttgtgtgttcatatactgaaaacattcacgtatttatacatggggttaacaggttgcattaggtggtgagaatatggttattttgtttttatttgcatttatgtgcatccaatttatgtacccattatgaacatgatatcatatgtaataagaaaaaatacaataaatgcaattttgaagcacacacaacaaaagaaaggtaacacttaagagtgttcttcatgcagaagagatacagaatgcagaacaaacaggaaatatgagggtagctccaaatgactgttgactctgtaaaactataataactactttaaggtgaaatatagaaagaactgaaatatatgacagagcataaaaaagtgtggtcatacagtaagtagaagtaaactagcctaaatctgcattatctagaatgtgataaaagtagtaatttgttctatattcctttttcttattattttccaaatcatttaattatttttagtcagtgacctcctacatttccttgggagttatacattatttcagtactcatttagtggataccatagagattatcatctgcagtttctgcaaagaatgaatagtaagatatatattagtaatggcataacaatagtgactcaaagaggcaaaatactccaattaaaagacagactttcagactatattgaaaaacaattagaaaaaaaaaactactttaaaattcatacggaaccaaaaaagagtctgtatagccaggacaatcctaagcaaaaagcacaaagctgaaagcatcatgctacctgacttcaaactatactacaaggctacagtaaccaaaacagcatggtactggtacccaaacagatatatagaccaatggaacagaacagaggcctcagaaataagccacacatccacaactatctgattttgacaaacctgaaaaaaacaagcaatgagaaatggattccctatttaataaatggtgttgggaaaactggctagccatatgcagaaaactgaaactggaccccttccttacaccttatacaaaaattaactcaagatggattaaagacttaaatgtaagacctaaaaccataaaaaccctagaagaaaacttaggcaataccatttaggacataggcatgggcaaagacttcatgactaaagcaccaaaagcaatggcaacaaaaggcaaaattgacaaatgggatctaattaaactaaggagcttcttcacagcaaaagaaactatcaccagagtgaacaggcaacctacagaatgggagaaaatttttgcgatctatccatctgacaaagggctaatatccagaatctacaaagaacttaaacaaacgtacaagagaaaaagaaccacatcaaaaagtgggtgaaggatatgaacagatccttctcaaaggaagacatttatgcagccaacaaacatatgaaacaaaactcatcatcactggtcattagagaaatgcaaatcaaaaccacagtgagataccatctcatgccagttagaatggtgatcattaaaaagtcaggaaacaacagatgctggagaggatgtggagaaataggaatgcttttacacggttggtagaagtataaattagtttaactattgtggaagacagtgtggcatatcctcaaggatctagaaccagacataccatttgacccagcaatcccattactgggattggtaaattacaaaggattataaatcatgctaccataaagacacatgcacacatatgtttattgcagcactgttcataatagcaaagacttggaaccaacccaaatgcccatcattgatagactggataaagaaaatgtgacacatatataccatggaatactatacagccataaaaagggtgagttcatgtcctttgcacggacatggatgaagctggaaaccatcattctcagcaaactatcacaggaacagaaaaccaaacaccacatgttctcactcataagtaggagtttaacaatgagaacacatggacacagggaggggaacatcacctactgggtctgtcggggggtgggggggctaggggagggatagcattagcagaaatacctaatgtagatgatgggttgatgggtgcagcaaaccaccatgacacgtgtatacctatgtaacaaatctgcaagttctgcacatgtatctcagaactttaagtataaataaaaaataaaaattaaaaaaataaagctatatactatatgctacttattagacatgccataattataaagatgcagaaaatttagacataaagagttggaaagacattccatgccatccctgatataaatttttacactgaagaagaacaattaaagttaaaatgtgtgggaagaagtacaattaaagtcaatgctttgtggcaataataggaaactagaaatggatggtgttagaagtggatgaggcattcttttaagttggcaaaaatttcattaagattttttataacattttattatgaaaatttttcaaaactatggaaaacttgaaagcatttgagaattgatgtttatgtccctaatacctagagtctacacattttgctgcatttgcttcatgacatacctattcatttttctgttcattctttcatctattttttcaaatttcaaagtgagttacaagcatcagtgaatacagtatgtttttgtactaatgggaataattcagaagagagaaaatcttttgatgattctaagaaagagtgggaaaatcactggaacaatgtccttgaaaacttagggtgggtaggaatcgtgtgagaaggtaaaagctgtcaggaggacctcaggcacttgatcaagatggaagttccatgggggaaagtcagagtataaaggtcaggggcaagtggtgggcagaggtgataatagggtatgtggatgttctcacccattctaccttctccagaaatattaaacatgatgtaggaaatcagcagcagggaataaagttggcaaagacagaattggattcaggattgaggaaaagctgtgaagtaatcatggggataaataaaattaggattttagagcatccctaaagcctacttgaggtacacggttatgaatattttcttatggtaccaatgtagatgacttaggaagaattgagagcaatggtgtttttacaaatattgtattattcatatagtgtttgcacatacttatatgaatagactaataatgtttcagtaacattattcaaagacatggacaggagcatcttcttctcacttagacaacctcacagcaaccacaaacttaatgtttttttatagtgctgtcaaattgcgtcgcctaatttagaaatgttacacataaaactttaatgttaagggagacatttaatggctgtgagttaggaaaactattcataacatctttttatgctgagtaaagttcagaaagaaaaaagtgtttagactatccagtaaataaaaaatgtattatgaaagaaaacactcaaccatttgattttctgacattgtttgggcatcatcgtgattgcaataatatctccagctcttttattctccagaaataataaacaagatgcaagaggttttagaatttatttttgattcagagcaaggaatgctatgcacttctttgtcaactatttgagcttaactctgtatattttataaaacttagtatttaagtttcatttctgtgttttttttttaacattggaaaataatttcacatttgaatagaggatgtcagggaaataacagattataagcctcaaatcatatctagtgattctgttgacatcgtaataggctgcttgagtgttagatgttagtgaggactttttggaaagactctctgtttttctgctgtgtcagttagttactgttctaaattctttcatgtccccacataaagaactaaaagtaattttaatagaaagtagagaacaagtggcttccttaaatcttcttttgtctttaagaacttctgagttaacaatgtctgggagtctagaaaagaacagatcctcctttgctcagttgtgaattcttcggtgattcatggcaaactcaagaaaaaaacacaggcatctgttgttacaggaaaattacctgctttatatcagcctaaagcggcatcatttagtgaggtctcaaggccgtatgaaaccaagccttacatttttttttttttggggtattatgtgaaaagaaatcttctctttcacattacttttttttttttaatgttacatttgaagaagtactaagaagatttagaattttaaaaaactgctaagctccattccattatgtttggaaggtcatggatttatttgcattcacttacaagcacttggggttagggcagagttgtcatcttggacacactttagtgtatgcaactactgattaaaataatcctagaaccaaatttaaatcattagaatcacattttttagtttcatttaaagtagaagaggagattttatttcttatgaagggttacagcctgcaggctggctatcctgacaggctggtaagccagacacaaatacttctagggatgggcaaaaggaacaggaatttatgttgagcagggtggctgaatatacatattcaataaactataggagcagtcatgagtatttatgaaaggagaaaatgcacatgagcaattcagctttaagcctctccatgggtcccatgtacaaaaaatggcagccttaagatgaactgagagtggagttttcagccctctgtcttcaaaacatgaagcagaggacatgaacattcttactgtgtgttctccatagactggccaggtccactccatggtctcttatcaggcaaaaaaggaggggcagcatgctggtttcgttttagcccttagagaagaaaggttaatggaggttagagagggtcagtgtgtataacgagggatgtctgacctgctatcttgtcttggctgagaactcagttttcaagattactatggggtcccctaccaagaggaggtctgctcagttggtttgggggcttaggattttattttgatttctcattttctctcttttggccaatatttgccagaggcagcattgatggctaaacttttattttttcccatatcattgccaggatggtgtggctacctgccccaggtctatcctgtcccttggtggaagccctatagacaagggacttagagccaaaagacttacagccaattaaacactctaggtcagatgggaatggaagtgggtaggcattcatcaacaaacaatataaaagccaaaaaccgaagccaaaaagcaaggttacaaagtcgctttgtaaattctgtgcattgagctactgcaatcttggaattagttaaaggcttgtagccatttgctgtataaaacataagcattctgttaaaaccttttaaggcaaggaattcagagacctttgttgtgccacaatgctttttgcagtctccactgatttgtcctaaggtagcttaaaaatttatatctctatttgtataaaacccataactgggaactgcaacagccagaagactctgtcaacaggtttcttgatatcctcttggtaattgtcttttaagtctatgagaagcaggaaaatgtttacggttggcatggatgaaaaggggccacataatggcccaagaggcagtttctcaatctttcagttgtttaggcatgtgtgtgcccatccttgatttggagggtctgaactaattttaatccctcaaagccagcacttacaatctcacatgcccatctccttcttccgcagtactccctgggcctagagggaggatgcttctttggttttagcgatagggaattggcaatgaaaatgagatcagacccagtgggattccaaatgtgggagatttgcagccttatttgaatcatctctaatctttagagtaccttgagaatcacttgttgttggaagacttgtcttctatagcttaattttggcaaatcagtatgggtctttgaactaagaaaagcaggtttcaacagagttcagattcctttgtcataagacagacattcaagagactttaattgctatctcttctaatccatttggtaaataagatcacagatctaaaaattataaagttggagggtcagaaatggtcaagtcaataccctcattttacagatttctaatctgggaccaaagataactggttttctcagggtcacatggccagttagtaaactcatagtcatatttagaacagagggcatatcaatatgagtcttaacaatttaaatagaatttaccaaatttcatctgaatcctaattttaaaaatccaaaatcaccaaaatgttaagtttaattagagtgtgaaaatagttcctccatagttatgcaatgtcactcctgacaaactttgtagagctgccgtctgaagtcagtcactgctactttaaacttccgtgcattaaaaacagaatcagagatgcatctccatttcttgtgtattatacacccacatgttcttctggaaactctgcctgcagttctgacagtctgtcaacacaagccatcaagtttagctccttatagtttcctggatatcaagcacatgtaagtagaaattacatatttgagttgccttttcaaatgtgttgcaaagaatagtcagtcttcaggtttgtgatttaagtgtttgattgcattgcagacctccttgcctggctttctggatggtaacttttgtggcattaagccaaactgtgaggccaggtatagcctcattctcaaacacatctctttctcctccaaagcatttgaaactttgtcaatgtagaatcattcctttggttcctaaaataagccctttcgttcttccagagtctgttgttaaaaaaaattagtattttgcattgttatacagatttacaaattatacatcactttcacatatttttttcagttgaaactcaccaaatagattttcttcataataagtggcataccacttattatacaagaggatgtggttgaaacagtctgccccaggaacaaccaataagaaggtatactctagaaaatttaaaaacaatgactttaaaaacaatgacaaaaccattcaacattaacttgctttttatttttgttatgttatagcaattctaaacagtattcgtgataaaatattcctgtccaagaaacctttatttatttatttatttttggtggctgcgcttgctgttgtgctgtgataacatatatgtaagcttcggatgagtatattttatattttaagcactactttttttacatgggagttagtttggataattctgagttatactgttgatttgtaaactatgtgtttatttcaagagtacgtttaagttcttaatattttggaattgttcaagttctgtttggatgcagttcatgtctccacaactaatggtactatatattcctatatttagacagtaaattggaagtggaaaaatgatagtacagggattttaaaggagaaaaaacagaacttgaatcgtttcaatactttcactgtatgtgaccacttgaattttgtgtttcaaatttgaaatagtgacacagtgtgtgagttgcaacaaataatatttcatttggtaagagaacatttaaaaatgattatacgtgcaatataattgtttagtccagaggggtgcctattacaatggttaaactaagtttgcccctcttcaggagaataatatttgggggtaattctttcccaaaatattagtgaaaattgtttgctagttcactcagcacatagttctttaggaatgaggtaacacacaagaagcagagagcaagataccaaaagggaatgtgtgtatgtgtgtacatgttgcatatgggtgcatggtgtttatgtgatcttgagataaatgtagcctattccacactttggccctgataaacataatccccattttggaaacagaaaattaagatcagattggctaacaagacttttctgagaatatttatctcagcaatacagcagtaaagggcagtcttctactagcctgtcacgtttgctgaagtttatcaaaagtgagtagaaagcacctaattctatttgatcctcctatgtgatgaaattgagtggtgaccaggatttttggtgaactgatacatttttggcatttatttgttagattgtgatttggctcagtaacttgaataaattttgtactataaaatgtagtactaactaaaaaactaaaaagccacctttcccatatgcctgtaggacatactgacaagctagttttcataaactttccaaattaaaatcataatgaataaaattataaatcaaagtagggaaatatagactgatgagcgtaaatgagcaacagcaaggctctgccatttacttgccctgtgaccttggagaatttacttcaattttccattcctgattcattaataagatgaggatcataaaaacatgtacctcattgttttttgttttaaggaataaattttacacatagatgatagataagtggatatgttggttcttagtacagtgtaagggcttaatattagctacttattataaacaatattatggtgaaatttatcttaaattcaaggccaaaagtctctatataaaaattatgcaaagatccatatttatagaataatggaataaggaagtggggtattcccatatggatccaactttgcaaagttcttttttttaatcaaaatattttatgttaagagacctttcaaaaagaccctccatgttagacatcccaacagtaccttggacctttttggggggatcttttttgtattttttttcttcttaaatcaactaaaaaattttgatgctaaaagccgggaaatattttccaatgaaaatttagtccaaaaagaaaaaaatacacacacacacacacacacacacacacacacacacacacacacgtgtgtgtatatatatatgtatttatatacatatgtgtgtatatatgtatatataatacatatatttatatacctatgtgtgtatatatgtatatataatatatttacatatcacatattttttatatataatataatgcatatatattttatcctcgtgacaggtgaggaagggcaagatgctgccaggaattcaggaggtatttggttttcttgttacatagtaaggagaatggttttgctgaagacagggacacattacattattcaaatgtaatcaacacccaacttgtatccatttgcaatgatagcaattaactaatcttgctagtgagaatttcagtgtagctggttatgaatataacatatctatgcaataatcatcaaagtattataggtagtattatgctcatcataaaatttattttgaaattttaacactatgacttgcatttttcattcctatggcctaagggaatagtaaggtttgctatcatagcatttctgatgctgatgctcttctgtttagccataactacagctcaagagagagagacagatgggacacgtagaaataatggaggtgccaagagagtcaggcttcagtagttagttaccatacagaaatggccatctccagtcccttcttccccaatatcagccatggggacttgacccccgctgggatcaaggggcctaaagacagccttgtttcctgcctgccctccttagaatggcaacaacaacaacaaaaaaagagtagcgattgggatgccataaaatgagcaaatggcagcaaggctatattaaggacatattcaatgcaaagcaccccatgtttgtcacggctcttgtttattaacaccacccagggaattgagggaatagaggtgggaaaaggaaatttaggatgtgatatagggaaggcagcattccttcttatctctctttgcttaggctgttctactgaatcatcagctctgtaccctcagtcagccacttcgagtatttcagtgccatatgagaaatctaacagcatacactacatattcatatctagagaatcgtaaatgtgtttatgtagctgcagactagcatggaggagaaatctgttctctattttttgttccatttttcctaattggattggttctgcttggacaagttgtttgtggagttagtcaataaatgtattgatgaaaaacaaaatataggttcccacttttagtttttagaatccatgagaatagagtcctttttggctgacatcagtactaataatagctatgatttgttgatagcttattgtgtgtcaaccactatgttccactagtatgaacacatttagttcttatgaaacagtgccacttgtatcccacagatgtggaaattggggtatagaacacttatactacctgcccagaatcacataactagtgagtagtgggtccagggatcagacaatttgatgtcagggtcttatgccatactgctgcatctgaacagctgtgatcatgcagctaaacgggaccttgcagaaagcaccccagcaccccaaaggctagtctaactttcttaccaatgtacctgggtccccttgtcactgtaatgttcttcagatcccacctttagtcatgcattcaacaatatttactgagcaccaacttactgtctagacacaggagatctactggacagcaattctgattcaacccatactgggtctaggactagacacaatctcactggtcctatgatactaaaaacctagttatctggcatattgaaggggcctcaagcccagtcatgagggagaccggaaggcatctcagggaagttaatgactcctgaaagatgaactgaaattagtttgttaaagaggatgtaggccggacatgatggctcatgcctgtaatcccagcactttggaaggctgaggcaggtggatcacttgaggtcaagagttcaagaccagcctggtcaacatggtgaaaccctgtctctactaaaaatacaaaaattggccaggcatgatggtgcatacctgtaatcccagctacttatgaggctaaggcacgagcatttcttgaatccgggagatgggggttacagtgagccaagattataccattgtactccagcctgggagagcgagactctgtctcaaaaaaaaaaaaaaaaaaaaaaaaagactgatgtggaaagagtattgcaagagaggtaacaagaacaggcccctgatacccaaaataagcatggcatgaatggggtactcaaagtctttcattctgtggaatcggagatgatgactgagtgagtcgggggttgcagtgcaaactgtgatctgtggcccaagtcctgactgctgtctgcttttgtatggcctgcctttttacatttttacatgattttttaaaaataagaaattgaactgtataccatgatgtgtgaaaaatatgagattcaaatttcagtgttcataaagttttattagaacatagccatacccactttattttcatgttgtatatggctactctcatgctacaatagcagagctaagtagttgcaacagagaccatagggtctacaaaacctgaaagatttgctgtctggccttttacagaaaaaaaagtgtgctgactcctgctgtagaggatgagaggttgctatagagttagatcatgaaggaccctatagttcacattgagagatttttattttgattctgaaaggcaatggggagtaactaaagggttttaagtgccttcatatttcttaggttggctgttagttaatttgcctcctttcatattttcttgtactaggttcctgggaaccgcttttacctacaatgattttgttgactctgagactgtttctggagttttctaagtcagcagtcatagcatttataggttgccccttttataatgtagaacttacctaaattgactagtttcctgttgaaagtgggactaggattcactattatccattttagactgtcaccttatgttactgctacgaaagtctaaactgtgggcttgattgtgatgttaacttctgggtcctaaagatgtgtgtgtcctcgccctctctgcagcccttcaaacacaggagaggccagtgggtattactggtcaagaatatttgttgttacccttagagaaaacactccatgcagaggaagcactgatgaaataaacacagggaaatagagaacagttgtgtccagacatctaaaatctgaaacacagaagagaaatctggagagcttgtcatagctccctaggggacaattagtctttctccaacttagcagagaggcttttttctgctacatttgacaagtgggtgagttctaatctgcatgtttattttgaaatgttgcttacccaaggattaaacatctggttgaaaagcagataggttcaaaaatctattacttgacattagtagcttaaaagattgtaacttggttcttagttgttttttttccccaaacttggaataaggtgattgtaataagttgaactgatggatcattcaatttctcttaagtgttagcatttctgaacattttcttatcgcttacctatatggtaagtgaaatcctttctcctagtacttatttgctctgggtctccatagatagagagaaagttaatgtgggtgccaatgttcatatttcccctgcatttttacagttagaatgttaaattaaactttccattctgaatttttatctactgccttccagttaggtacatctgtcaatcctgctgtgttaattttaatttttgttcttctcagttattaaaaatggagtaattttgaactgaattatttgtatttatttgaatgttggctaagcttttaatttagagcaaatttttaaatattagcaaaaaattttaaggacttctacattaaaatctcttattctggtaacagaagtcaatgattaaaacttttaacatgcagtccagaaatattacagtattttgtatcatagtgaatgaaagaatatatatgtttgcctagtaataatttccttttatattttcatataaatttatatttgaataaactgcaaatataaatcactttaaatttatgtgataagtttatatctcttttatctaaattaaagttattattactagaaagttggcatatatatttagtagtaaaataaattacattaaatatatgacatgtttatgcacatacaggtacatacatggagatatatacattcacacatataaatatatattcatcattgtatttttagcctcaaacaactgacatataatttcataaacataaattttgcaaaataaatttggggatgtgaaaccttcacttaggtcagccttttaagaggtttattgcctagtgaatcttgtgtataaattaataacattttttaaatgccagagacatgtgacttcttttcttcctttattgttactatagcagaggattcccttctgtgggtgaaagaaaatatattttgactttacagtcttttattgtgtgatcgatgttaaacttttttgtgcatattttcaacgtgatcttttcaaatctcaatgtttaacggtaaatatcctagagaaactgcaaagcaccgtctggcatatgttctgagcatattcacttgtgcttcttttttttttttttttttttgagacggagtctcgctctgttccccaggctggagtgcagtggcacaatctcggctcactgcaagctccgcctcccgggttcacgccattctcctgcctcagcctcccaagtagctgggactacaggcacccgccaccacgcctggctaatttttttgtatttttagtagagacggggtttcaccgtgttagccaggatggtctccatctcctgacctcgtcatccacccgcctcggcctcccaaagtgttcacttgtgcttctttaaaatcgaagaatcataaaaagcagagagttttcagcagtgccctctctacccctttcaagcagagccctgcactttgtctacatttctacaatgagtgctatttcatatttctttaggaaaaagtattctgatgctcgaaagtatgggaaacttctgatctacaccagtgcttctcaacctggggcaattttaagaatctcctcgccaccactggggacatttgtcaatgtctagtaatatttttgacgctacatctgggtgggtgctacaggcatctagtgggtcgaatccaaggatgctactaaacatcctatcatgcgctggacggttccactccctgctccccacaaacagagttatctgacccacaatgtcagtagtgctgaggctgagaaatcctgttgtagaccaagtacagtagttacccccttatccctggtttcacttgtagtggctttggttacttggagttaactgtggtccaagaatattacagtattttgagaaagagagagcgagaaagagagacaccacatttacataatttttattacagtttattgttataattgatctattttgttattagttattgttaatctgtgactgtgcataatttagaaattaaactttatcataggtatgtatgtataggaaaaaaaacagtatacatagggttcagtattatccatggtttcaggtgtccactggggttctggaacatatgtatgtataaactcaggagtttttccaaaacgactgtactgatttcgctgatagggaaactagacaatgaggtggagagatgtgttcaaatacacagtttattttatgctggagtccaagtcttgattttccttactttatgctgtttgtcctttacttgaggacctatgtgaaatggcaatttggatagaaaaataaaatcaccaaaatgtaaatattaaaaaataatacttggtactgcattgcatgggcttcattgcaataaatatttctctactatctagcacactgcctgtaacagagattaaaaagagtatgcttctttgcaaagagctatccagctggggagattaagagataaataattatgaatcaataagtagttagagaacaagctacagagaagaggtcatatgtaagaagggacctgaacagtaaactgaagttagtcaggtgggaaagaagagggagtgggcattcttggtaaagataactgtatgccagaggcatggaagagccgaaggccttcgtgtggtcttactaaaaattagcatgtgtgggccaggtgcggtggcttatacctgtaatcccagcactctgggaggccgaggcaggcggatcacgaggtcaggagatcgagaccatcctggctaacacggtgaaaccccgtctctactaaaaatacaaaaaatatgcgggcgtggtggcgggcgcctgtagtcccagcttctcgggaggctgaggcgggacaatggcgtgaacccgggaggcggagcttgcagtgagccgagatcacgccactgcactccgccctgggcgacagagcgagactccgtctcaaaaaaaaaaaaaaaaaaaaaaaaaattagcatgtgtggattcccgatttgcctacaacaggttacttgagggtaaatgtgggtttgggggaaaaaacctttcaccaacaaagattcccacttatgtaccatagtgcttgacgtttcactctcggaaattcttcccatttggtttaaaaatttccctttccttgccatcatctttaaggagaaaaggtatgtccagatactttatgtctctgaaagaccttcagggaacaaaatatatttatgaaaatgaaagtgactcacatggtagtaagagtcccagatggctgaggaggtaaaaatgagtacaagcagggacttgaaagtataagaaaatcttgggtggtgggcaggcacccaggtcatagatgcctaattcctacttttacagacattgagtgggcattcttgtgatattttatatttttggagctgtgtactttctttcttactttatttctttgaagttcattgcccagagaggaataagcatctttatccaatatggtaaggtatgctgcttacctgatctggtccctctgccacagaatcctgactacacagagcttgtcagtcaaaggaaatttggtgcaaatatatatttaacatatgaccatgaaggaattcctactttgtatgttataaaacacaggatcagaactgccatttgcacatttggggcatttttatgaatcatggaaaggacccctctggatgaccattgagaaaggcactgctttcacctggctcagcaacatctgtgcgaggacacatgtgctggctccagttactggcttggtgaaaagaagatggtaggatttcagacccactggtaccccctcctactaaatgcctttgtgcacaccataaactaacatggtacaaagggaccctgacaaggatgaattgagaggccataatccatattgtatatgggtaatatacacagtgtaattacatgtagagagagaccaggtgtgtgtttttctgagggcatgtctgtgtgagtccctgtgtgtacagaactatgtcaactattaacctctcacccacctcgctaggaaagtgggcaacaacccaacagatgtagctttggtaacttcttcagtcctagtctgtgtatttcctgcattggcatactttttactttaactaagccctttattactacacagaggagttcctgtgactttttctgcagtggcatcctttgtacagtgtctttatcaataccatttctaagtttagccatagtacttatatctgttttactccttcagcactctcgttaagaagcccatgctttgtctacacattacttgtctgcacagttccagtgcactgtcttcctccccaccacacccatcctgataacatcatccagtgaggtcgtggaaatagatatcttgcagccaactcttccttttgacaattcgagagactttccagcttgagtgggctctggggatagctccttacattgtttcaatgacactgaactctagataccctgatcctgtgtatcttctctaaacacatgtctttcctcaagccatttggaggtttaccatgtcaattaatattcaacaaggatttgagagcttactgtgtgccaagtcattaaccagtaaattattaaattatagacctttcacttctataattttgcagtaataaaacattctaaaaatgcccaagtattgtggtaatgcccactgatttttagttagatcaagtgattgtagaggaagttacattatgccatttgatttctcacggcgtgcttatacagtgtactatgcttatttcagtgtttcactcttgccccagtagttcaagttgcccttctgaaagctgtaataaatattcctatgttggcttttatctctttgattacagcatgttagttaacacccccagtaagtaggcgggaacttgtatgtgattgttttccttttcaccctatttatattccttcttctctttctgtgatggtgagtagagctttatttttgtttttactttacttgatctctcagtgtttcatgagatctgtgttctggtttctcagttttcacaccctgttcagccactttaaatgtcttaaatcttttgtctatgctttcataaataaacattcaaaatggttcaaaaatttaaaaaactacgaaatgctttaatcagtaaactttcataaaattgtacatacctttacatactatattaaattaaaattatattatttaacttgcaattcatatactgtaatttttataaggataatttaggagaactcaataagaaaataaatcttcagaaaattgtatcatttttgtaaagagttaccatatacctgtctttttaatgacaatttttgcaaattaatattgatatagttcatcttgatcaaaatatattgacatacaaggactatggctttagatctgttctccttttctatgagaggtggcagaacaggtttggaaatcatggcagccttcctggccagagataataacgtactacttaaccttgtacaaaatcgtcttttcctttctcgaattgaacaacaatttgaggagagtccttgatactcttgacctattatggttttacctgtttaatctgaggatttctatttcagttaggagtccagagtggaataaaattgaaaagtaagataaatgtatatcctatactggtccttacacattacagctggggcctttaattaccatatcagctaatgaagtgccatctatgtcttgaatcgagaaggttttgaccctagggaaggtgacagctcttacatttaaacctagcaccagcagagttctaacagttactcaaagatcattttctctgaggatgaagaatttaacaaagaaacaagtcctaatatcatctgctttaaaattactatgaaaagagacagagaggggaagaagaaaaaacaattacttatttaataaaaatataaggaacactgagtacatgaaagatataccagggactcaggtcaatgggaaagtcattgcactcttctgagcctcaatatttctgtcagtaatatggggatgagaggcatgtcggacagggttactgtagggatgaggggtgatatgataaagtacttggcaatccaaaacaaagccaattttggctgttattactcaataataataaatatagactaaggagattgcatttttcttgtcagcagtgggggtctattgaaggtttttgagcaggagtgactactgcagtatgccagacctcagaaactgtgggcatgttttacagagggcagaaacaatttagaagacaattgcaatattctcagcaggaagtggtaatggagaaataggatggggtagggtggggtacagagcgagaccaaaacaaggaagagtaagagaaatatcaaagtcacaaaatcaaaggtattgcagccccttttgtgaggccagatggggaattgggacaataacagagacattaacaagaacagaaaacactggtcaggagtgggcattcaggggagaggagaaagtggaatgagctctgatttggacatagtaaggtcaagaatggcactgattggctgctaacactggactggtcatttttccccagagtagagcttggtgaggaaaaatcccgatacttgtccctcttgaattctgaaacccgaaatgatgttttctgaatcatcctgcagaattggtgggaagacgttaggcactgtatctttgagcctgtcagcttctgcctgattaattctgagtagttacatttcttctaaaccattattaaaaaaaaaaatggatgagacttcacagttgccttatcatatgaagatgaaaagtacatccttccgtaatgttgctattgcttttatccacgttacaactaatgattcaatctcacatatttcatatttaaaaatactatatttctaatatgcttacactgaattagtggctcaaacctttataagaaagtgcttacacctattttgaactgtctaggaatatgcatgaaggacagatctttctgtttgtaggaagaaatgttatatttgttagtcatgacagagggattgtgaatagaagtgtttccatttccacccagtggagagtgtttcgagtggtgggagacacgttatacctggtgagaacattgaggttaaacattttatttttattacctcaattctttttaataaggatgccacagaggtgtttgcagggcctgtaaattagttttggccacaagccaatcagctttcaaacctggtgtaagaggagaaagtagatgtgtgtatgtttgtgtgtgtgatgtgtgtctgtgtgttgtgtgtgcatatgagctgtctgtgaatgtacatattcctgcttagtgatataaacatcctctactttcagagaaaagtctaggtagacttaataccccacatgaatatttccattattttttgttttccttttcaatttgagctattgtttatccacaggctttatgagctgaatgtatttttagcaaaggaatgcctttttgcatgaaacacaaccatatacagtgctgctagctgaacaagaggaaaagaaatgttggattattcataaaatgcgctcattttctcctttttgttttaaaggctagatattgtttctaaagtagtggtatacaaaagtaggcactccatgtacttactttggctttgtgtagctgtaaagtggaatgatatctccagcttagttttaactttgtttgaaatgagaaaacctatggcagtctctcaactgatattatttgatttattccttatttttgtctggtgggaatgagaatgggatgaagataaagtggtttcaagactattgttgacactgcattttgctcaatggtgttgcctcatctcttctgctattactttgcttggattccagatatgctggaggaggaaaaagtacttggtttctatgctctcatctgattaatagcttttgaacttgaactggcctgatttctctctttctcctctgcccaatcccagaaggcagaagggaggaactgagataaaatagctaaatacaaaagacaaccgagtatatcgcaggtcttcataactttccctaataatggcaattgtttagtctttcctatgtcatatttttttctcattttgttgcaaataagaattggaatgggtatatacaaataaggtagaaagcagaaaagaccctgacttttgcatagctcatcagaacactgtagattattaattaagaacagggattggagaacttttttttctgtaaagggtcagatagtgaatattttatgctttgttggctgtatagtttctgttgtggctgctcaactcggctgttgtggggagcagctacagacaatatgtaaacgaataggtgtgactgtgttcccatataacttatttatggacaattaaatttgaatttcatactagtttctggtgtcatggatcattattctttgaattttttagccatttaaaaagatagatagcattctttactcataagccaagttagaaacaaggggtgggctacttttcactcagagctatagtttgccaactacaggataaaaagaaagaacattatactgttcatgaggcattgataaaactgacaataactgcatttattgagcacttactatatctgaggcattgtgctgactactttatatgtcatcttaatcaacctgtaaagcaattctgtattagacattattagctcgatctttagtgaactaattgaagctcagagaagttgaaaaactttccaaatatcacactgtttggagagtcaaaagatttatgttcagctcctaccaagcaatgcaactctagaaaaaaccctttgcttccttggattttcgtctcttcatctgtaaaatggatgtaccattcttactttcattgccatgcagttgggctgaggcttatgtaattctcaaagctctaaacagctgtgcagctttagaaaattattattaagactatcagagtaatgtatgtattaagttgttttttcctctagctgtaacatcctacatcaattaatattattatctaattgcgaaggaaaaatcattccccaaatccttgggatgaggcagtaggatgaggcaatatgtcaacaaatgaaagagtgtaaattcattatgcaattggtaaggagagacactaagggagagtgaagaatggcagaaatcagaaaaaaaattatagtcaggtaaagcagcttttaaagaataagatgagctggccatggcataggtatattaataatgtatattaaagaatcaaaaatatttctgattgcaaatttctactattggcatgtataattgagtcataccatacttgtttttgaaatttgaaagaatttgtggatgcagtcttaaggataatatttaagatctaatggataaattaagtatagacccaaagctctagatttgccataattttcacaaaataagaatacgttaattctagaaactgggattggtatgcctaattaagatgcctagcaatattcatcaacagatttttaaacagcatgtatgtgagtcctcaggggaaaaactcactggtatccaacctgggctttctttacaatgaaaagaaaaggaaataaataaatttagttaaaattgatttctctttataaagtggacttttaaaacattgaatcatgctatgcttattgaatatcatggcaaaaatcattgaataaaatgttgggtcagattcttggttcatttctctttaacaatctgagatagcaattctaatacagttccacaatttatcacattcccttgaatcatttggtcgttctaaaaatatttagcagccgggaactgtggcttatgcctgtaatcccatctactcgggaggctgaggtgggaaggtcgcttgaggccaggagtttgaggttgcagtgagctgtgatcatgccactgcactccagcctgggtgacagcaagagtaaaaaataaataaaattttaaaagagcattaagaacctgttctgtgctgggaattgctaaaattgcatgcagtatgttggtaaacaaaactcacccaaatccctgccctcatgggaattacatcactccagtactggttctgctgcttcccagctctaccaggggttcccacagcctttgttgctagtcacttcctgtgacacagtggtcttgataggacactgcacttgggcaccaatagaaaggtaagcagggaggtagataaatttccactgaattccctgttcatttaaatttttaccattactgtagagaggcttgtaaggcttgacagaagggctggctcagttgaagaaaattagtgtgtgggataggataaaaactttagaaaagtacattaattattacttacgcccaaggtgaaatgaaaagcacccaagaatttaaattctacctaggagcccctcattgatttctttgcttatctgccctgctcccttgcctgaatttactcatatgtctttatgtacgaacacaaaaagctctcccttcctctgggtgatccttgacatgggctttacgaagtagagcaagaactgaattccaccctgcttgtccctccacctggtgcctttgtgtatggcacaacctgctctactctagcatacagccttgcctttcctccaacagggctcatttccaaacatgagttatacacactggactagagctccagagttccttcaagacagtccatgcaactgtccgggcagttctagagatctgctccacaatgacgggcacataattaatactacagtactgaacacttaacaattattgagatgatatatttaacattatgtgttgtttaaccacaactttaaaaaaaaaaagctgtatagggcaagtgtggagtcaaggaggttgcttcccactggagaattgcagtcatgctatttattttctcagtttgtcttcctgatctcaattctattagacatgtactgacttctcagtgataaaatatggctatcatagattatgctggctcaacctaagaagaaagagcaataactttctaactaccgctttcctatcaatgtacaggcaaatgtgcattccatgtgtgtctcaatgcccaatctttcacccagctgaacttcaaaccatcactgttaggggcctaattacattcttagattttgactatcaatcatcttcaaggatatctgtgtagggcactgggggtaaggtggagagaaagctttcatttatccagtcatgacaggatgacatctgaattgtgatagataagaaactccttgaattctttattaatctgtccacttttgaaacattaattacagctctgttttttgtataaattataaaggatgttaatcaactagcatggcatgcattcttagaagggcaagtgtttagggaaagatcctaaaaaccacagagaaggacgagcgcggtagctcacgcctataatcccagcactttgggaggccaaggcgggcaggtcacctgaggtcaggagtttgaaaccagcctggccaacatggtgaaaccccgtctctactaaaaataccaaaaaaaaaaaaaaaaaaaattaaccaggcgtggtggtggatgcctgtaatcccaggtacttgggaggctgaggcaggagaatcgcttgaacacgggaggcagaggttgcagtgagcgaagatcatgccattgcactccagcctgggcaacaagagcaaaattccgtcaaaaaaaaaaaaaaaaaaaaaaaacccacagaggaagagttaaggatctaggggtatttagcttgaagaaagaggatgaaggaacgccttgctaacatctgcagatatttgaaggactgtcatggaaaagcactgtagaattgttctgcctttctttatatggtagatctaggaccaacgaacagaaatacagacaggtagatttgggggcagtacagtaaagaatcttccaatgaataaagctattcaaaaaatgaaacagtactttcagatttaagatgacaaaagcaacaaaaaggaaaccaaactccaactatgatgaaatcaggggacatctatagtctcaaaccacagtatacatataagggtaagcaatggatgcagaaacagcaaatgacttcacagtgtgggaacactgatgagaagctacatctctcccacaaaacctgagaaaggcttaggaattaaattcatcaattagaggaaatgcttggagggaggggactaaatatgaaacttggtaaaaagaaatatatgtataaatatggagccattggaccgtcaggacccattgctaacccactgaatgcccagaaaagtgagtgacccacatcaatatatactaggatagatacgtctaatatcaagcataagtagaagatcctgagatagagaccaggttacctaaaaaagctctagagtaagaattacatccaacgtatcaatgctgacaaagtgcaatcacgatttcaaaatttggaccaaaaataaatttcatcattgaattttatatacagccagttaatcgactataaggattgaaaaaaaaaaggcattttcagacaatatcttccccctgttaggaagccacagggatatgctccacctagatgacgtagtgaactaattaagaacaaaattgggtgtacagggccagggtggagttgtgggagagggcaggatgggaacactcagatgacagcaaaaggaagacttttaaaaatttttttgccaatacaccaacaatttattttaattttattttatgtcattgatttattatttatttattttccttcaacttttaagttcaggggtacacatccagatgtgccggtttgttacataggtaaacatgtgccacggtggtttgctgcacagatcattccagcacctcagtgttgcatccatgcctggcatccattagctatgtaagctatgtaagcccagcatccattagctattcttcctgatggtctcccttcccccacactcccctccaacaagccccattgtttgttgtccatgtgttctcatcgttcagctcccactgataagtgacaacatgtgatgtttggttttctgttcctgcattagtttgctgaggttaatggtagtcttaaggctgaagggatatggcagccctagggaacggcagttcacagtgaactctggtggtcagggagctccaggaggggtgtcctgggaatacacaaacataggatattctggtattttatgagaattttacacagccgttgaagagtgtaggaagacttagccaatagttgcaagaaaatcaaattttaacaggaggtaccaattgactgcagggaaaaaaataagatgtacaagaaaaaatgtagtcatgttacttgtatcagaaacaaacaaaaaacattgacaaaggcatgaagacactgaaagtggttggaaaaataattgtgctttaatgttggaaggaaaaaaggtgctgaaattttcatcattgtaataagaagtcataggggacatctaagattgaataattaagggatatagtatatacataggacatagcaaatataaatatgaataccagaagaaacaattttaataaatgaaagccatttctatttgtgtatgagccctggagaaggaaagagaattatacaagagactgctgtttttggtgtaagacttttggcactatttaaatttttaaatttttaactatgtaagtatcttattttgataaaagtaaacattcattggatggaaagaaactccacaggctaccttggaaataagtcagcttcctgatttagaaagattcatgcagaagtttccttccatcactttttctcagttttgttaggtgtccttcgacttttaatcactgtgaagaaatagcgaaaggcatgacttttggtactgtcttctccagtcaacctgaggcactgtgggattgctaaaggaagtgtggttcaggctgcatgaaagcagtctgggtatgctaggccagggaggaggcagccacagcagcggccaagagaagccactggagggattcctaggtggctggagcttgacccgatcattcctaagattccattgtcctgagccatctaaacagcagtgtctgctattctataatgactctgattccagaactgaactgaccaccactggtcacatggtaggaaaaaattaggtgtaaatgtggtcaaaatataacagaaagtgaggggcagaaaaacagttgaagtgtcagaattagtgataaggtgggtatctagggatagcaggccagggggtagggccaacgtcagagactgtatgggacatagttgtgtcaaagcatggagagagtgaatgctgcttcatggacttaaaagtggaacctacctttcactctgtaatatgtgccactgggggacctaagtcagcagagtcgttatcatttttgtagagccttgaagtcccagatagttaggtgtatccctgttaggtggatagctctcccaggactgagatttcctgcaacctcttgaagaccatatggctttagaacttctggataaactcttgggtcaggtttgatctttggggaatgcttttgtttacataaaagggaaaagaaaaaagtcagcagatgtgataacttcctatagtaatagtgtttcccttgcaggcaactacatactctgatttcctctttgatacgacttttattacttctcaaatgaagttaacaagtacgtttatgagatatctggcctagcttcataaaagaattttctcttttcttaaaaataaaaactaacagagattggaatgatcatattcagtatattgtgagcatatgagagacttataatatgcttagcataaaatttgacactattaataaattaattattgatgaaattggttcattagttctaaaaattttatttcctctgactcaggtaataaacagaaataaaaatgatctgctccccactttattccactttagaattcttgccacatttattcattagtttgagaggtcatgtaattccggctgtgccttaaagatgaagcctccagaaatgaattttatctaaaaattagacctcacttgaacagaagacatatctctttccctttggattacccttgttgtcttctttgttggtttataaaaaatagattaagaccgtatatacacatcgaaagagtagccatcatatttattttattgcaagtaaatatgctgatgtatagcaaagatttttatctacaatgcctgatgctttcaataggagagttggtaaatgtacagcaaatatttaaggcacctttttcccacttgtttttttttttttgtggtggtggtggtgattgttgtttgacctgttttaataaggacagttaaatacctgtgattaaatagttgtttgatttttttcattcaatttttatttctgatacagggggtacatgtacaggtttgttacatgggtatattgcttccaggtagtgagcatggtatgcaataagtagtttttcaactcatccttcctcccgcccttcctcctcgctctagtcgtttacagcatctattgctgccatgtttatgtttatatgtgcttagtgtttagctcccccttataagtgagaacatgcagtatttggttaattcacttaagattatgttaattcactgtccctgtgttaattcccttaggattatggcctccagctctatacatgttgcttgaaggacaggatttcattgtttttatgactatataatattcatggtgtgtatgtaccacattttctttatccaatccaccattaatggacacctaggttgattccatgatgttgctgttgtgaacagtgcagtgatgaacatatgcatgtgcgtgtctttttggtacaatgatttattttcctttcagtatataaccagtaatggggttgctctattttacattatttgggaaatctccaaactgctttctacagtggctgaactaattgatattcccaccaacagtgcataagcattctcttttatccgcagcctcaccagtttctgttgttttttgactttttaataatagccattctgactggtatgagatgttatctcattatggtgttgatttgcatttctacgatgattaatgatgatgacaattttttaatatgtttgttggctgcttgtatgtcttcttttgagaagtatctgttcatgtcctttgcccgttttaatgcggttatttgtgctttgcttgttggtttaacttccttatgtattctggatactagacctttgtcagatgcatagtttgcagatattttctcccattctattagctgcctgtttactctatctactgtttcttttgctgtgcagaagctctttagtttaattaggccccacttgtcaatttttgtttttgttgcaatcacttttggggacttagccaaaaattctttgccaaggccaatgttgagaagggtatttcctagattttcttctagaatttttatagtttgtgatcttacatttcaatctttagtccatcttaagttaatttttgtatgtggtgaaaggtgagagtccaatttcattcttttgcatatggctagccagttatcccagcaccatttattgaataaggggtcctttccccattgcttgcttttgttgaccttgaggaagatcagatgattgtaagtgtgccattttattttggagttttctattctgttccattggtcaatgtgtctgtttttgtaccagtaccgtgctggtttggttactatagccttatagtatagtttgaagtcaggtagtgtaatgcctctggctttgttctttttgcttaggattgcttaggcaattcagactcttttttggttccatattacttaaaaatttttttttctaattctgtgaagtatgatattagtactttgctagaaatatcattgaacctctaattgctttaggcactatggtcattttaacaaaattaattcttccaatctataaacatggaacgcttttcatttattcgtgttttctctgaattctgtcagcagttttgtagttctttttgtagggaaccttcaccttcttggttagttgtattttcaggtatttcattttctttgtgactttgtaaatagcagtgtgttcttgatttgactttcagcatggacaccattggtatatagaaatgctactttttttgtacatatccaggaaccttgctaaacctgtttatcagttctaatagctttttcacagagtctttagggttttctagatatagaatcatatcttcagggaagatagttttatttcttttcctatttggatgcttttctttctcttccctattgctctgtctaggacttatttcccactttgttttaacaccatacaaaagcttagggaaggaaaggccaaatggaatagtgtacttatatgtgttttataaaaagaacatcatgtataaattaatatggggtttaagagccaaaatttatactttaaattatcattggcccagaaaagtatgattttttttttttttaaatcacatcatgcttcttgttcaggcggaaatctcaaccattaagctcagttcatgtagtttgcagtttggtattttttgtattttgtgtctagagacttctgctctgcatatgtcttagtctgttttttgttgctataacagagtatcacagactgggtaatttataaagaaagtaaatgtatttcttacacttcttctgggaagtccaagatagaagatctggcatctggtgagggccttcttgctgtgtcataaaatggcagaaggcatcacatgttgagagagcaaaagtatgcttctcagatcaagtctctctttctcttcttacaaggccaccagtcctaaaatgggggctccatccagattaccttatctaatcctaattacctcccatttccaatcaacatatgaatttggagattatgtttccaacacatgaaatgtgggggacatattcaaatcctagcagcctgtacgcttcatatcattgccagacctactttgccttactgtttataaattgcttgcagatagaaatggtattatctatgcacaaacacacacatacttatccctgaatatcatctaataaaatcactttctttgtaattggtactaaataatttggactgctatcaaaaccttttaatatagcagctcttctactgaatatgttcgaatttggttctcaaatcagaggaagtcctcattattagaaaagtgtactgccaccattgtgcattatggttttcaatttaataaatttgaatgaaaatctgaaacaatagcaatgtttttgaaaatgtattatgtaatacagtggaaaatgttttctgtttttacaataatagaataaataccgtgcagatgggcttgaatttaaataagaacaaagaaataagaaaaaaaatgaagcgtgtttataatatttctcaatattttacttttcaaatgaactttctgcagcagaattacacttgaatttgattcaattttctaaaaactgaattacataaatatttggaaggagcatgtgtcaccactgattcattcattcagcttacattttttgaacacccactgtggttcacgctctttgtaaggctggggacatataatgatgagcaacataggcatgggctcatcatcaataagcaggcagaacatatttaacgtatttcatatttgttttattaagccaaatatgaaaatgggccagccaaaagtgtgagggggtgaaatgggcttaattgtattgtctgatgtggcagccttggttggatttgttttgttggaggaaaagaatctaaggaagggatgaacttgctcacagaaatgtacgttcagttaacatgaacaggtgattagaggaagtgttaacctggggtctagagtggttagcaattactttagtaatatataatgcttctgacagatctcacaggatctctgatatcggagattatctaacccaactcctgaagtctttcctgaccacctgtttaaaagagccctcctctcttctattctgtctcacagtacactttttcctttatctcactggttcagatttgtgtaacttatttattacagtttacttctttaatgtttttgcccccaccactagacggaattgctacaaggacatgaactatgtctgttttgttcacctgagtagagtcattgcctgtgtcctaattggtccacaggcaaagtaggtgatcaataaatatttattaatgactgcaaaatcagtttctaaatgtaaacatccaggttgtgacagatcatgattatgtagttgagagttgtgttattttggattgctatgctgtgttttactttaggatctttagcatttctacaaaagtgaaccacctttttatttttattttgaaggagattatatttcatataaagcaaaatgaaggtaagtaaatatggtgaaataagaaagcgaaagagtaagagaaaatattgcaagatttataaaaatactttatttttttaagttttgctttagtatttccataagaaaagttttctgcctaagaaacaagcagttaggtgagtgtctttcctaccccctatagacctgcgtagttcatctcactactcctgcacaagtcctattggtcctggagaaaatggatggctttagagaaaaattaaaaggtttagaccagggatctctaaaaaatctactattttctttggcaatactttctcatttgtgaagaggaacttttcagttgcattgtttatgaagaggcatttccaaatgtaaattgcttttccctactggtatcagtgtagctattgggagttaaaacatgcttgatacatgttaggatgttaatatcttactctttctttgaactcagaagacagctatgccactcatcaaccgactacctcttcatgagctacatctgcatatactctggttctatgcagaagtctaggcctgtttataacaggaagatcttggatggattaaaggcagaatccccatgtagctttcagatcagtcataatagaatcttaagcataatcgaatcagtaagcattctgaaacatgagctctaccttatagattagggaactgagtcttgctgatcatacatatggtactttctgtccaggaaatgaatatatgtgagttctagcatttctccccaccccccgctctaatggttcgatttttagaactgatcttttgattcattttccctgcatcttttctattagtgctgaagtttgtctctatactaattcctaagggaatgaggcctgaaggccagttgcattcctgcctgtgtcttttcctgcctggatgagaaaacttgaatcctgcctctagatccctcagctactgccttggtcttgcgtctgatgcacatattgctctgactcatcatgacttcagcaccaactgttttgtctacagtatcagcagtctggaattcctcaaccaccatctcagttctggactgcctcgttggatgttactgatgttgacacttgagaagctggtttcaccagccaaatgtggagcatcatagtgcctaatagcttctggtggccttaacttccttctccagttggtttccttcaggtttttttccattttcttcttttggctctgggtttggtctagtatgcttgttcatattgtgacaagtgacacctttgggaaaaaaacaatacaaaacaaaacaaagaaactgcaagaagttccctacaagaagaccccaaaatgcgtgttagggtttgatgctctgtgcattccaggagatgtgttcatttaatttttgctttagttggtggtttctctaggaaccttcatgaacaacaggaggatggtctgctgttctcagataataaagggattgagtggactcagtattagccactcaagatgttcatgttcaatgctagcgccactttaaagaaataatgggctggcgcggtggctcacgcctgtaaccccagtactttgggaggctgaggcggtcgcatcaggaggtcaggagatcaagaccatcctggctaacacggtgaaaccctgtctctactaaaaatacaaaaaattagctgggtgtggtcgtgggcgcctgtagtcccagctactttggaggctgaggcaggagaatggcgtgaacctgggaggcggagcttgcagtgagccaagatcatgccactgcattccagccggggcgacagaccaagactccacctcaaaaaaaaaaaaaaaaaaaaaaggaaaagaaaaaagaaataatgagtgagttatgacttagaggcttgtctgcagcacatcagcacgtctactctgcggtactccctggtctttaccctgctcttgactttctgcctttctcctgcaagtagcatactacttgtagcatgtcacagcaagtaggagctgtagaaaagccttggtccagcactctcattgcatatgttttatattttgtagaatttaggtccatagagggagctacataagctttcattgtaattaagtttgtgatttcaattccatgatgatatatgtctttcagattaagcttaccaaaatactcattctacctgagtttatatcatgaaacagaacatctctgtctaaattgttaaaatctatttgatatttaaacataaaataaaagatgatcaggcccagatggtatggtagagaaactcatatctggctacaaaccctggctgcgctactgacttctatgtgactttaagcaagaattcattgaatgttacttcccctctttgacataggttaataccattgttcaagacagttgtgcaaattgagagaaagcatagtaagtgcctatcaaaaaatccatcacaaagcacatgctccaagagtgttctttgcttactggagaagggacactgttgaatattcacttacatctttctaacattcaaatcttaatgataaagggataacataaagcttggctttgggtaagttctgagagtttttttggatctcataactatactcattcaaggatcaataaaatctaatcatgtccttactataaaagactgtctcttgtcatttcctgtcctctttttccatccttcttcacatttttatttctttctaaattgtcagtgcatgcaccttaaaaccttgaagatgctccccagttcctttctacaaaaactttaccacccatagattttttccatagatcatttataatccctctttctcctgctgcctgcctccagcatctgttctatgagtccaggaggaagtaattgaaacacagtgagtgaatgatgagagtccactgatcttactaaggaaatgcatgtgaatccggctgtctgggcatttgtccctctgccaggtgaccttaggtctgcagatgtccaaatacagggtgtgagattgagctaatttggatttaggcacatcggccatataaaatttagccagcagtttgcaattcaccaggcatagcctttttctaaatctgttttcatttctagaagacaaattttaacctttgacactagattggtgtaatcctagttattagaaaacactgaaatggacttctgttgaatttcatgttcacatctacacagctttcttttggtccatcagtcaatagatagatagagatatgaatgtatgtgtatatataatatatatgttatatttcatttgtactattatagtttgtgttttaagtagtttgtggtttaatgcagaagtccccaaccccggggtcatggaccagtacctgtccgtggcctgttaggagcccacagcaggaggtgagtggtgggcaagtgagcgttaccacctgagctccgcctcctgtcagagcagtgggggcattagattctcataccagcacgaaccctattgtgatttgcacatgtgaaggatctaggttgcatgctccttataataacaaatgcctgatgatctgaggtggagcagtttcatcctgaaaccatccctcctccctccgacacattcccccggtggaaaaattgttgcccatgaaactggtccctggtgccagaaaggttagggaccgctggtgtaatgggagaataataatgtacactttacagatcaaaataataatatttcagtatatgatgtaactatttctttggaaaacaaggcaatattttaaaatggggtagagagattctatctgcctattggcatagttaggttgattgatttacttataaaatgatggttagaacatgaggaaatatatcagacttcagactacatattaggttttggatttgttattgttggttaaaaaaattccttggctataaaaagtgagtcggttttaaatagtctaattaggcaatcactgtgttgcttatctgcattcacaaacagcaaatgaaaaccggaagtgactacatgttgcttaattagtccaattaaacacctgccttagacttccttgcttagcaaacccaagacttctcaaaatcactagcacattgctaaaaatatgactttaatttgaaaaattgttttgcacattctgtatgaaaaatgtaaagaaaatacatgggaattatgcattgcttaaaacaaaagattagactttgtaattaagctaatttagtggtactatacaaatatattcagattgaaagcttgttaaaaacacatgaaaaccaaagaaagtgtacatatgaagaaaagcatggcatgtgttgaggaattccatcaaatacttggatgaaagacagcagtggtcctcagatcagcaggactccctgtaaaccccagaatggcttcagcttagccacctaaatgacttggaaagataccagaaaaggagatctctgatattcttttgtgaatccctcttaattttgacgtaaaaattcattgaaaatcaatactatcccatttattttagtctatctcagtggatacagagaacagatttcagatatttctttttttattttattttattttattattattatactttaagttttagggtacctgtgcacaatgtgcaggttagttacatatgtatacatgtgccatgctggtgtcctgcacccattaactcgtcatttagcattaggtatatctcctaaagctatccctcccccctccccccaccccacaacggtccccagagtgtgatgttccccttcctgtgtccatgtgttctcattgttcaattcccacatatgagtgagaatatgcagtgtttggttttttgttcttgcgatagtttactgtgaatgatgatttccagtttcatccatgtccctacaaaggacatgaactcatcattttttatggctgcatagtattccatggtgtttatgtgccacattttcttaatccagtctatcattgttggacatttgggttggttccaagtctttgctattgtgaatagtgccacagtaaacatacttgtgcatgtgtctttatagcagcatgatttgtaatcctttgggtatatacccagtaatgggattgctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcactgtatcttttggctgcataaatgtcttgttttgagaagtgtctgttgatatccttcacccactttttgatgaggttgtttgtttttttcttgtaaatttgagttcattgtagattctggataatagccctttgtcagatgagtagattgcgaaaattgtctcccattttgtaggttgcctgttcactctggtggtagtttcttttgctgtgcagaagctctttagtttaattagatcccatttgtcaattttggcttttgttgccattgcttttggtgtttcagacatgaagtccttgtccatgcctatgtcctgaatggtaatgcctaggttttcttatagggtttttgtggttttaggtctaatgcttaagtctttaatccatcttgaattaatttttgtataaggtgtaaggaagggatccagtttcagctttctccatatggctagccagttttcccagcaccatatattaaatagggaatcctttccccattgcttgtttctctcaggtttgtcaaagatcagatagttgtagatatgcggcgttattttctgagggctctgttctgttccattgatctatatctctgttttggtaccagtaccatgctgttttggttactgtagccttgtagtatagtttgaagtcaggtagcgtgatgctatataaaacttaccatcatgaaccaggagtcaagaattttattttattagcacatagaatgtagaaatttgaagtaacttaaggataatttttaatttatagctgacaaaaatgaagcccaaagagattaattgaactcaattttatacagcgaataagtggctggtctggggctcaagttcaattattctgacctcatgtccggcaccctttccccttgtggttgtatgttcaatattatttgttgaagcattcctttggctacagagctaagttccttaaataaactgtcttacttaagcctcacagcatccctttaaggtgtatattattgtcttcacttttcagaatgggaagctgagtctcagattcaatcatttggcacctaagtaagaaatgggaagttccaaattctgtattgtttctgtcccctgacccgtgctgcttcctctcactgacatttcactctgcagtattgaatgcttccatactaattatccagggcccattctgcaatttcagaaatgctaataccagttttaaaaagaaataatatcctgaattagaaaatgagctgctttctttttttgtgtgaattgtccaaataaaggttcacaagaagaaccttgacaagcataattgcaacctgttcatttcccctttaagtcatcaaacattcccgagaagcttgaggcctctaagaagtgatgcttaaggaatgcagcttgacaatatggcagtgcattcaagtggaaggctggctattctatccatgaagatgaccctacagtaaaataccagtgtggccttttttcatgtcactggcattttaccagcagtttgtaatttaatggaagaataataatgtacacttacacatcaaaatcagaaaatgtcagtgtatgatgtaattgtttctttgaaaaacaagggaatgtttttaaaatggagtatgtcctgcatactgtaataaaattatgcagccacatcagttgtcttgccataaaaccaattgattttagttttaaaaatttgtattatatgtaaaatgagacaaatatgtgctgatcattatcttagggtaataaaccacaagtgtcggacaaattaaaacctgaattattattctttgataggctttatgacttctggcaggcaaattgctcaaagctttgattttcttatctgagtaatagggataatacttttatttccttgttctcacaaacatgtgctatatgtgtaatgagctgagcatacctggagaacacttagtatttaacattctattaagcaaagagcaaggtggcattattaatcatggtttattttaattctagagtagaaactaatgaacaatagaaggatgagattttgttgagatttttctgcttctaatttttggaaaaaactgtttttatatatgctaatggagagatttttttttcttagaacttagtaggcttgtgttaaacttatctccctgtggctttcaagtataattttcttcataggagactagtattgttggttttattccaagaaatgctaatggattatttatatttttcattttagtattaattccagctattaatttttgagcttattaagaatctaaagctccttttcattatttctaaaagtagcttgaaattcacattttcagcatatcatagttaccatgatttgataaagtatttttaaaaatatgtgtcatatgacaaaaccatgaaactcaaggtagagtgtactcacatacgtacatacacaggacacaaatataggctagaattcctttcatgctacagagagagagacaaagggagaccaaaaaataaataaataaaaaacaaatttagtggttactacaaaaaaaatgagaaaaatgaataaatcatttttatttgatgcaatgaggtttatatccatactttcctgcttggatgtttctttcaagaaatttaaaagaaattaatatcaaggaaactaatatcaaagaagaataaagaaattaatatcaaacactgttactttttaaggtcagtgtcacttaagctataatttcccatatcaaaatatgggtttgtttgtttgtttacattactagaaattttctttgtttcaaaatgtgttacttttgattgttgcctttacccgctatacttagtaggaacaaatactagcttcagccaatgaagtaagaatagacagggcatagtgataaagtacttgaatctcctgtgtttcaacgatgattttgatgatttttcattgatgatttagacttgtttattgaagtgtggtctcagggagccctgtactctcgagtcatctacagttttaccaaatgtggttgatatctgttttctgaaaaactttttctgacttctgaaactgactaatgtgtttttctgtatcctgaattaaaactgattgataatccctctgcaaaacccatacaggtataaaagacaaggagatgtgatagcttgtggctacccaccagaactatttgtgctagagagatgtgagttcgcttacatgttgggttttgcttatcattttcatccaaaagaaaaggatacattgagatgcgtgtgagtggatagaaatagaaaattcattgctagtggaggcttggtaaggattttagtgagtggaaaatctggctggttgtccgtgaggttcatttgggctggaagtattgagggagatgatcagacatttgagatatctttaaagcatttggcaatagcccttaatgtgctctcaagttgagaaagtggcaggaaaatatttattctacaactttatttttgttttttttttttaccatcaaatgcagtttgtctctttaagagcaaaaataaatattcagacagagtttctcagttagcagaaatcactcattttctcctaaaatgacattaaaaagagtaaaagcttgtaaagtcctcaagtaacattaaaaaaaatttataaatacattggactatatacataccgactatatctacctgtttttgtaagcttatttaaaatgtctatactagtgtcataatttactaaagccattaactgactgtttgaaatttcattctcaataattctttttagagtcagtagttgggtttttaccataagaaaaagtttgaaatctgacgtgaaaaacttcagatttgtgatgtttgtctccatgttgtttgttttctgctctgagagatgccaacaagtggcaattgagttattcccaggtcattgaaaagtgaagagaatggatttctagaactgtataagaacaaggacttgacgatttaaaattttttcatataaaaaatgggaatttgttcctagcaattcatagaaaaaagtgtgtgaaagccacctaaaaagcacgagactggcatgcaaagctttatctgccaaatgttataatagaaatattttcataataacataaaacagtaaaacaacaaaaagtttgtatatgtctctgtatgcatacaaatagagaatgtatgtgttatttatttttctaaatgagcatacattcctgaactaataatgtattacatacattatacaatatacataaaagtagacatttaaaagaatggcatacacttttaaaaacaacattctatttgttaactgtatacgatgatacagttaatattagctgctgtaatagagtatctttaaaatctcagagacttaacagaagttttcttcttactacataatatctaaatgggtctttctgatccataggtcactctcctccaagggaaacttcaggaagttaggctcctttctacctgtggcttcttcgtctttaacacctggcttccatgtttgccagttgggagaaaacaaaaaacaaaaaacaaaaaacaaaatggaggttgattttaatgagccagattgagaagaacacacagcactcactgatgctcacatttcattggctagaatttgtcaattgaccgcatcaacttcaaacgagagtgaaaaatatagtctcacattgtgtccacaggaaaaagaagcgggttcgctggtggcacccagcagtcttctccactaacaattacaaatataataagtttgctttttgctaagaatgaaaatcaacaaatatatctcaaatagctacatttgctggtgttttttctttttaaagatttgcaagtcataattgcttataccatcatgagctaatatcttaaggacactgggatgagattcactgtcagcaataatagatgtaaatacatattttaacttctcagctctgatgagactatatgttttttcagcctcataactagttgacaaagagcttgtattatgaataaaggcagtgtcagctatgtgttttcttatagtttacttatgcttgtatttttagtactatcttcaatctccagtttatagtcttttaaagcctgttccattctgtgcataggtgtgtgtgtgtgtgcaagtgtgtgtgaaaactagaaaatttaagacttaaacccacttaccaggcacgcattaaagtataagttcatccctgcaattcctgaatttgtgggaacttacccttccctcaagataccccatttatcacatgtgacatgtgaccatctaacatagggatgggtggtggtacaagtgtaagtccttacatgaaacagtagtcaggatacattgttttatatttttagacaaaaatcaatatagagtcctcatatttttcctgcatctcaccatcgactactccctatagagtatgtgcaccctgtgctggagtccactaaccttaaagaaagaaaatgtcaaacctcgtgttcatgtcaatcaaagagtgcaataaaaagatgatgaatgttgggataatgggaatttgggtaaacagaatcctttgcctaacatactattgattggaaaatattttgtgtctattgtgctttcagatttgtttctactctttcttggaacagtctagctttactttgtttcattttgttttaaccttagtaaatgcaaaatagtgattcatcaatggaattgaatttttaatttctagggacattccaaacagctttcctgagatgggcactgatccttaaaatattttggaatttgaaaaagaggaatgccttcttacccatttaaaatccctggttctaagcaattgtttcttcagtgaatatctggcattattttagtgtcttaatttttagtgtcacttttcaatggctgtaagtgtagacattgaaagttgtatagattttaggataacctaggttggcaatagatcctttaaaccagtttgtttcttttcattgcttggtttattgtgttttatcaaatcaaagatgccatcaactgtaagatatatattttagatactctaagagaaaaattaagttctatcaaatatatctttaaaatgacataaattgtaagactcattcttattttgtatatgttaaactgtggtaaaaatgtataccttagaattaatgaaatacaaagtattctactgtcttccagcaaaggtttcaggaaactttaaggatatataaagtgcagaaagattaaaacatcttaagggaaaatgcttttaagaaagcaagatgaatgtagcacaaataagagccaggattgagactaatttggtaataatcatcattacgtcatatgccttcctgaagggagcataaatttgggtgaaactgttttgaagtcagtacaaaaaggaaaaggaaatcttaatttattatgcagcttaaaatcataaagtaaaatcaaaccagtttctaagaggaagtatcaatttccttggtaatgaacaaaaatttatgtaatgtgagcaacaataatatctcatcaataaccttagagaatacacaatgagcatcctatgactttgtgcagtagtgtcctcccattgaggtaagtggtatcacaataagtcagtagaaacacttttaccagtgtccattataatacttcttctctcctggcttatctgctttaatgtagagtggttggtggtttgtactaggtggtgagagagagatggactgaacatccttaagcaaactaaatgtttctctcatgtaagcttttggatggcagtaatctacaccatactctctggaggttaccaaaaatggagcttatctgtgctgctatttaaatatgaaacatcgtgccctaatagagactggaaaaaatattagttgatattctctagggaaaattgagtttcttctgaagaacaggtgcatgaagaaaaggctgctgtactttgtcttggctcgtagacactactgaaacacttcctaggaaatgagttcaaatcacatctcaccgacaacatgaaaggatgatccagttcccaaatgctctactccataacttgaagccacagaaactttagcctagaaaaattttaatatacgtatgactggccattcatattggccataaaaatatctcacccaatcatagatatttatttggggagttatttctgaattctacttgctattatattcttcaggaaatgtagaccacagcaactgagttacaaggcttgcctcatggccttacttaaaagttgagggtacgtctacaataattaataagtataatacgttaattataggctttctttgtagcagtaattaattagtgccagttcagtcctatcttagataattaaatcataaaaccatatcttcaaggtttcagaaagctggtcttccaggtctcagtatcagtgggcatgcatctgaattctatgcagttactgtcagataacggggaggaaatttcaaagacaaagagacagactaattctctggggttttttcctctataaatttttaatgcatcattaaaagatcattgtttctgacttttgaaactgtggaagcatcagtaactttggttcttattatttacttcttttttaatctaaaataaggtgtgaagttgtgcttgagagaaatgatcctttcaacaagagatcctattgtagtagtttctattgtagtagtttctgtgaaagttttatcttagtttttaatgaagctgaaataagtctgtattgtcacctccctttgcgtcagaatttgtataactttgttggtctgcctttctctctgatgtgtacaacatacaacatacatatatctttaaatctcacaagtattctgctttaggaaataacttctaatagagtataccagaaggtaagcgtatatctttttatatattttatgaggaaaaggcacaagccatatttgcacttactctatcattgctaaaggaataaatcaggtggttcaaggaagaataatttaagaaaaacaacattttgatgtattacttggcagttaatttttaactggtcattaaaacctgactgaagatttctccttagaagcttggtattatcaaatatattactagttgaagacttagcttcttcatatttcaagttagttacactagttttcctctttcaggaaattttcatttatcttcagttgctgctggaataaatagagtgttttttgtaattttgtcttcaaacattcaccccaaaaatgtcttgctttggaatttctattttaatttttacttgttttaaattttaattcttttaggttgtggcagcaattgaagccttctcttgtgttagctgagtaatcgtgaagattgaactaccttagagcaacacagtagaattcccaaaagcttagtactcgtatctgcaaagtgcacaagtctttaggcatctagcaaaacaatgcccaaattatcttggttctcctttactggtgtttttctggagagctcaacaatttcaccatgtttatatatgtatactctcactttcccaagttcctcgtgcctccataatagaggagatgctttcccaccaaaagacggtgaattgattcaccaagctgtttgtaaggaatcatgatgtatcatggcacctaaaatgagaggaagggtttacctgttaaaagtcactgctgccgggtgcggtggctcatgccagtaatcccagctctttgggaggcagaggcaggcggatcacctgaggtcaggagtttgagaccagcctggccaacatggcgaaaccccgtctctactaaaaatacaaaaaattagctgggcttggtggcgggtgcctgtaatcccagctactcgggaggctgaggcaggagaatagcttgaactcaggagatagaggttgcggtgcgccaagattgtgccaccactctccagcctgggcaacggagtgagactccgtctcaaaaaaaaaaaaaaaaggtcactgctttgtctttcactttttttcgcttcagctagactcctagataaatgtttctgcaagtgaagtttattatccatacaaatcttaattgtatgcaacgaatgcaaaatgcctaagcccagacttacctgatcagaagctctgtgggtagggtccagaaatttgccttcttacaggaatctaggggaatgttagggatgatatagttggaaaataattgtgccaaattttagcgtttcttatattttaatgtgcatatgaatcaactattagtaggtctgggatgggtcctgaaattctacatttctaacaagcctatataacactgatgctctccatagctcacttggagtatcagtgtgctaaagtttttcagctggctgccccataggtaaggcttagacaaactatagtgttgctggtttcaggaagcaacagagttgctctgtcacaagtctcaggtccttctcacatttcaaaatcagtgtaatggagtttccaagacaaagtgccttgatgccctattgcctattattttggagaaagaagtatttcatgcctgttgagcttttgcagcctaaaagtggagtactgatcaagtagaagagacacagtcaagttgacaaattgtcttaaaatacaacatatcgcaagaaagagaaatgaatgaaatggtcttggccactgcactaccgccattgtgcaggagtggtaggtcaacttttaggactttaggtcatgagcagtctatacaagcctgggtctcagttttatactcacatcacaccattaacatatctgaaaacagtggtgcctattatctggctatttctgagttttccactggccagtgttcctgggaccattattagattaaggtcgaaggaccctagaacacttacactcttacctgtgacctgcggaatttcttctctttaaggagaggcagagagattgaggaaatatttggggtggggctagagcaaagttgagtattcttgtaggttgtggttaggaagtctgcagagaggaggacgttgaagatttagcaggaagctggcacagctaatacaacagttctggaggatgtgattaggaaattagttaaaggggtgatggtagtagcaggcttttcctgttggaggagggatagagataaagatgggtacagaaataagtgagtttggtggacggtaatgtatgttccttttaaagctgtatgagtttagagaaggaaatgattattgctaagaaaattaaccaggagatatttccaggaggaagtggaattgagtcaacggcactaaatgtggtagaatggtattataagataaaaatgatttgattttagcaacctgttaactaacaagaggactctgctacaggaggtgagaggattaaagcaaatttcactgggctgagaaatgaatggaaagagaaacggacattttgaacctatgcttttcttttttaaaaaattggcagtgactaatgaaatctgaatttcttaacttggctttcaaagccttgcaaagttttgttccattacatctatctaaccttactttccaaataatttataggttagctttattctcaattaagactgatttccttactgccttggaaaacatcagctccatctttacatatgtcaatattcatgctattactaccagtttttgttgcagggactttgctgttttttttttttttcttttttttccattttttcccctactgctttacaaatggataggaaagaagaatgtgtggatcttgagtgatccttgccttgagtggaagttgagagtgggaattagagagaatccctggttggggcagagggaggcctaacattcaaccaaggatttccatagaatgaaacatttgttttgagacagaaacatgttttaataacatattctcagtgtttgcttacaaaggggtttctctgtcaaactcttccattcactgaaagaaaacagcttatgatgtatcttaaagaaagtatgcttacatttgccttttatttctggatttctctacttgtcctcatagggcccatgttctagtaacatattctcaatgtctgtttacaaaagtttttctctgtcaagctctttcattcactgaaagaaaacagcttatgatgaatgtttaagaaagcatgctgatatttgccttttttaaaatacagatttagggggtacaagtgcagttttgttacatggatatattgtgtagtggtgaagtccagaataagccatttcttacaagactgccaacaagctgcatcagacacttaaaaagtctataagtaccatctaccaagacctagtgtcagtctggatatcaaacttacgcacagatacctgcaattccagcaattgggccaccttgtggctcccacctttagatcaaaatgtgttcctgctgctctgacttctctaaggcatccagttatgcaaaaggtgactgcactattcattagaattcataattctgatactcactaactgacttgagaggtagtaggtggatccatgggacaaggtagtcattttcttcactaaaaatctttgattactgatctttagtatatcttggttcttcatgactgagcaataaatttctttttttaatttaacttttattttaagttcagaggtacatgtgcaggtttgttatataggtaaacttgcgtgaagggggtttgtggtacagattattttgtcacccaggtatttaacctaatgcttattaattatttttcctgattctctccctcctcccaacctctaccctctgataggccccagtgtgtgttgttcccatctttgtgtccatgtgtctgaatcatttagctcccacttgtaagtgagaacatgcagtattcgattttgtttgctaaggataatgtcctctagctccatccatgatcctgcaaaggacatgatcttgttcttttttaagcaacaaattttcttattattctttacccatagaagagcattgttacataggaaccctaagatctcctatttggttagttataagatttttgaaatacttttgtccttcttttgctttcagctgacacaaaaagccctaatatgcattttctagactgagactcttgaatacatcagatattacagggcattgcaggaagataggataaaatagttggttaacatttcactaacatttataaacatatattcatatatataaataatgcctttgaatgaaaagacaaccaataggacacaaaaaatgtagtgagacaaatgtagagaataaatacattttaagattattttgtcgtttagcagcctctcattgttagaaagaaaagcaagaggagactggtgagttctcaggttccaaagatacagcatagagcacaacaacaattcagccttttgtctctctcgagtcatgtgaatttgaagaagtttttttttttaacgtatggtaacttctctaagctgggtttccctacccgtgaaataacaagatagaactgaagtagatgaatatgaactttcagaattttaggtgtaaatataggcatagctcaagaagaataaaagcctgtaacatgatgggaaaaaatgacacttcaggtgggagaaaaggaaaatgtgcagtagtgtggagtggcatgcattgtcatagggtggcaagagaacgggcacggcaactcaggggaaggagtgggaataaatcagtgaatttgcatagcaagggctaggctgagaattcccaagagtggttagtttaaaaagatagacccaactttttcacctactaatggagctaaactacttttgctgcttccatttaaacatttgatatattggccagaagtgggcagcaagagtcctgcatatgctaatcttaaataatctgtctctaatttactgaaaagtttattaagtttatggtaaaaagagaaccgaactgaatgagaggatattttaagtttacagtaaaaagagaactgatccgagtgagagactttcttgcttatttactgtgtaaatatctcgaatgctaattgtagaataaactgggcagaaatgacatcttttcaatcttgagtcttcccatccaagaatgcgggatgtctctctattatgtaggtcttcttttatgttcttcactaaaatgttatcattttcccccatgaaacattctacatggtatgttatggttatttctgatcatataaatgtatgctgattgtgaatggcatatttaaaaccacatttctcctttgttactgctcttcctttaggtttttattgtttatgttgtatttagccaccttgctcttcactcttgtagtagttggacttgtttgtctttcaattcttttttattttcttaagaatcatattctctataagatgtaatttaatgtttacttttctaatacttatatatcttctttatttttcttatctaatttaatagtttgtcctccaataaaacactgaatagcagtgaaaagcattgacaattgtttattccgagctgattatgacatgagcctttatggaagcccatccctttctttccatttgtctcttttccctttcttccctttgtgctcttccacccatgagtacatgagagcttttactaaatgaggattgatttgcttcttctgaaagtaatcacatttttcttaggaacttcctggtaatgttccatgtttttcttcccccccacaaaactgacattttctactggcttgctattatttgcatcaccaaaactgtgcctaatgcagtaatgcaccatgacatacagaaggctagaaatgtgtcggcccctccagaaaatgaacccacattatagtcgtgtagcaattttggtagtcactaccagcttctactcctttgaaatgtcaatttatctaaaattaatagctcctctccaccctatttttttttaatttgtgaagtctaaaaaaaaatagattatgaaacatcttagaattatgcataaagtgaaaataaatcacatctcagtgagaatagggagtattttcctctgataaaaggagcctggcctaaatgcagatggtagagatggttgctgtgtttgcttaggggacttatgtgcttgtttccaggtattggctgttctggggagttgaggttcttggaagagtaacatgttcatgtgttagagtaaatcctcattaaggagaatgcttctgcacctcagaaaagcaatctttgtgacaagctgtctttctttttttaatggttgcctcacatgggtggcactgaaaagattacaacgtgttcctcatcgcatacacattttacagctaaaccactattatctgatattcttatagttaatgattttgccatttttttggctagtgtttgtacttaaatggccttatagaatctttcttaaattcactctacctaattatttagcaatcaaaagagagccgaataaaacagctcccaaccctgcactaatcacctcttaagtattggttctatctatacacatcatcttagtttacatttattcaatcctttttttctttcagtgttatctctttctctataaactgaccggatattaattgtgactttgagtcatcgctttgattgctctgggatttggagtaaacctcagaagctaactgcatttggaacttttttgtagactggctttcttaataacctccaataacatctttagtctgctaaccaggataaatatcaacgaaaataaaccacagaacctacattcttgtgaagccgataaaaaaaaaatacagcagtaaacatgactggcaacttttgttgaacagaatatggaacagttgcattcatttcccctccaaacttctcactggtagaaaataaaggttcagaagtttataggagataacatgttgctcaaaagatattaatagcctttttagcaaattaaatacctctagatatagtgttaaaagaagtttggcagttgagataggtgtccaaattatgatacttagaaaaagagtaataatagattcaaatcttattatgattctagaaactttagctggttaactaaacattgagtctgaatcatttatttccctcacataaaattttccattttatttattttatttattttttttttttttgagacgaagtcttgctcttgtcacccaggctagagtacaatggcacgatctagattaactgcaacctctgcctcccgagttcaagcgattctcctgcctcagcctcccaagtagctgcgattgtaggcacctgccaccaggcccagctaatttttgtatttttagtatagatgaggtttcaccatgttggccaggctggtctcgaactcctgacctcaggcgatctgcctgcctcagcctcccaaagtgttgggattacaggtgtgagccaccacgcctggcagaaatttaccattttatttgtataagataaaattctaaatagcaaaggtcttcgaaagtccttggaaaataacacataagtaccgggtgttggctactcattatttattaattgctcattcatctctgccctgacttacagggctcagcactggatgttggttctcctagctcaatactcagaggtacttccatatttgctttgcttccttgccaccctgaggctgggtactccaaggagcactgtacctgtcagtctgtaaaagtgagtgaacttgaagctttgacccactggcaagtatgctatttctggttattcatgtgcttttgtttttccacaggaaataaatgataaccatttatttgtatgataatccacataatttcacactttccttgataaggttatgtgaggaggctaagtgatgtgcattcatgatttagtattgaaatcccatgatttaataaacacggagatttagaaattatgagataacatgacatttctagacagttttgcaaagaagttttacagtttctcttttatatttaaggtgactacacttgtcaacacaagcaacaaaggcccatctggtaaaaagaaagggaggtcaaagaaagcccatgtactagctgcctctgtagagcaagccactcagaatttcctggaaaagggtgaacagatcgctaaggagagtcaagatctcaaagaagagttggtggctgctgtagaggatgtgcgcaaacaaggtaggcagaatgatattattgttcaaggcggatctatactgatgtgcaaacaatggctttttctttagaatcaatggatatttactcaaagaagaagtcttacgtttttttcctttctatctacacttgtcatttttaatgtttgctggatgtggtacatagagatattttcattgttgcagtatggtacagctacaaacactccatgtctgctgttacgtcaaatcttcaagatgtttcttcttggtcaatgtaaacagactttgtgtcaaactcaggctttagggagaatgggatgggaagacctaacgtttatagagtcaatgtaaaatcaggtttctatggatgaagggggagaagaatgtaaagtattataagagaattattcttatttttctgcaagtctcaaattcatgttttcagttcatagatttcctcacaaatgtagcaagctagccactcattaataaatcagctacctctctagctagctagctataatactgttgatttagcattttaaaattttgatctgtataaaatatacaacataaagttctaactacggccgggtgcggtggctcacacctgtattcctagcactttgagaggccaaggcgggtggattgcctgagctcaggagttcaagaccagcctgggcaacacggtgaaaccctgtctctactaaaatacaaaaaattagccgggcatggcagcgtgcgcctgtagtcccagccactcagggggctgagacaggagaattgctagaacccgggaggcggaggttgcagtgagccaagatcgcgccgctgcactccagcctgggtgacagagtgagactccatctcttaaaaaaaaaaaataaaataaaaagaaaaaagtcttaactacttgtaagtgtacagttcaatactgttaacgatattcatatcgttgagcaagcaatctccataactgtttcatcttgcaaactgaaactctatacccattaaactatttcccatatcctcctccctgaagcctctggcaatcaccattctactttctttttctatgaatttgactgctctaaatacctcatataagtggaatcatacatattagtctttttttgactggcttatttcacttagcataatgtcttcaaggttcatacatgttgtggcatgtttcagaattccatcgtatgtatataccacattttgtttatacattcatccattcacggatgtttgggttgcttccactttttggctcctgggaataatgctgctatgaacatagaggtaaagatatctctttaatgccctgctttcagttcttttggatatagactcagaggtggtattactggatcatatgataattatatttttaatttttcagagcctgcatgctgttttccatagtggctgcaccatttccatagtagtgcactcctactaatggtgcacagcggttccagtttctccaaatcctcaccaacacttgttttattttgtgaattgtatcatcataattgttgtgaggtgatatctcattgtagatttgatttatattttcctaatgattacttatgtcgaagaactttttatatgcttcctaggcatttgactatttttttcggagaaatatttccagtcttttgcccatttctgaatcaagttgtttggttttgttgctgttgttaagttataggagttctttatatagtctggatattagcatcttatcagacagtgattggcaaatattttctcccattctgtaggttgccttttcactctattgtgacctttgacacagagaatttttaaattttggtgtagtcctatgcagcattgtagttgaaagttctaaggaccatgaaatcagaacagacacctactcccaagcttggtctctctcctgcattttctgccttgaagaatgcaatgcatgtctattgagttgcacgttgcataaatcttagtgccattcttgttacttccctttccttccaaatatagtctattgtaaagtttcctagatcttacctcctatatatctgtttaatggaccacttcctgtcttagttatttaaaagcactatgttttcatgccccagggcctttatatatgctgcctctttcacacatttctacacttcccagctcaaggaataccttctcagggaaactttatctgaaactcctgtcatactttttaatgggttctttccttgttacttttcacaggataattaagtatttgtgaggtgactgtctttcatgccatactataaattaataaaggcagagaccagaccatgtctcttttgctaatcattgattttcaatgcttagtactcattaaatatttgttgaattattgaattaagaggtgaatgaatggtctcttccaattcttcttgcaaacctaccactgtatcaattcacagctggatatttagtacctggaaacaccaaccctccttccacactaacaaatactgttccccttctgccctgttcttcctcatcctctccttcctcctaaaaattaatttcatctctattatactaacttaaattattactttaatttgcaacgttaaatgtgccacattttatctattgtgaagagtatatttgtgtatgtgttttggcagtgccaaatctaagttttcaggtgcattcgaaaactgatattccttctgaattgcagatggacgcttgtttgttttcatgcatctatagcctggatagttgttttatttttttcttttgttgtgggttttttaggttgactgccatataataaactgtatgcacttaaaatttacaatatgataaattttgacaaatgtatacatccatgaaaccatctttgcactgaagatagcaaaggtattcatagtagagagtggtttgattggccccgggcctccttttaaaacatttgtcttctatgataataaatttttccctttagtttctccaaaacctcttaagaattcttttgtcattacaagttagttttcacacattctgtagaaactaacgttttcattttcttgaagcttacatgaaattgtgttctcgtggatataatacaataaacaacacagttcttggccagactatcctaggagtattggagtaacaaatttctacagatgctaatttaacacagctaacaatggttgaacttctaggggatatttcaagttttctttttatattatcgatttcttcttacaaaacaattctatatcagaaatgttgtctacgtgtaacctgtataaaactcaaatgccacgtgctccttctcttgaacagtgtcaaattcaaagaagcattactatagtatgcaaaataacccaaaaaatgggtaaaagcatttaaaatttgctttgttatttttcattctgcaatcttttccatacactgcacatgcctctcaggtgtgagtggtgcacctcctcactgacagcaaggtcctcagtctcttgtttgaatttgatgcccagaagctcttatctccattctttccattctctagcacagctcgtcattatgtaatccccttagcttatctggctttagctgattttcctgtttgcccattacccaaattttatttaccaatgagagcctgcattgattttcagagagagaggtagagagaaaagagcttgtggggaaggaatatggaatggggcaagatatttagttaatggaaactttaaaacacagtatctttccttctatcatagaaatctgttttccaatatgcaagatgatattcagaaattatggacacactgacatttagaaaacaataacctcttttaaactacctccagcatccatacatgacttatttattaaatgatatgttgtgggaatgaaatctgttagttttactattgcattgtttttgtttttattaaaaagtattgtcactttttgttttcagcataagtaaatgccagttttcatattgtacatgtccattttcagatttttaatatagaactgttttgtttttcttttgaagtttcacaacattcattataattaccccatctgtcaagattatagaattatctatttaactatgttattgtatttcatatggctaaacagtgttatttgaatttctttatcattaaatatatatatatatatcttttaaacctggctgcatgccagatctctaaaagttttcagtatgagtggtgactatatttttactctagaatattccagtagaagatttccctatatctgtaaaaaaatactggagtaggtgttgtgctgaacccctatggactctgatggggatgacgccaggatcacggggccaaagaagagacccagagccagcaaatgagacatggagttttactggggggcttacctacgggggagaagtctagtggcagcaggctggcagaagaaccataaccatttgtgaaaggcatgcagttcatatagtactttcacgtatcaccatttacctaacaactttcacctggcaaccttcattcaacccaaaacggtgcctccatcccctctacaccccatgttccatgggctgggctgggggctcagatgttactcatagacaaggaatgaatctctaggtgggccactcccagattccctagctcagcagacacattcagatgcatctgccgtatggggtcattctcggagtatgcgtaagtttttgctctcaggtgtgtttatatacagtaggcttatgatagcatttatatttaaaagaagtaacaaaaataaattgcctaaaagagatattgtattcaaaacttagaactctgatgttttagactttgggaaagataggatatctagtttggtgtgtgtgtttctcccttcctatctgttcacttatgactaaagtcatgtgatatatgcatattatcttcctaatgtaagtttaaaccgtatcagaataggaacaatgagatttatgtatttctttcttctcctgaggcactcggcatggtcctctaagcacatggtaggtgatattcaggaaggagtcttgtgaaatcaggaaagcattggcagtttggctaagatatccaacttctaatctaacttttacaaataactagctgaaaagctaagtcacttaaccacttttagcttcagtttctccattttacaaatacaattattgtgtctacctaaatgaattgttttactaaatgaagtcacaggggattaaaaaaacgctaaatgttctatagatgtcagagtagatttattaattataatttattaaatcaatgtgtactacctatagcaatgtgtactaccttttgattagtgagcaagtcccggcctttccaagcaggatgctagagagctgaatcagcatctaatagtcttcatgaagaagattgagtagctcggtatggcttacagttggtggtagttgcacgtggtgtccgcaaactatgagtggatagatgtgcagctggtgaaccattcacagaaaagcttcttgaaaacaaggaatgcaaaggagttattccaatcatttcttcatattgaagctctggaccaaggaaagcttaaatcggggaattccagaacgttttcagtgtttaccacgaagatttttctagactgaaaacttttttttgactatgcactaattgaggggttctcaaactttagtgaatactagaatcacctgggaagatcttgaaatctttatgtccaggcctcacccctcttcaattaaatcagaatctctgcagttggacccaggcttcaagatgtttatagctcctcaggtgatttcattttacagccaatttgagaagaagtggactaatccctttcttgcttatcagccctgcttagattacttatcaatccatggtagttatttagtgtttcacatttggcagctgataacaggcagtcattatacaaggtttatgagcttattgtttacttagaagtaggtaggtaagggccgggcgtggcgacttgcgcctataatcccagcactttgggaggccaaggcgggcagatcacgaggttaggagattaagaccatcctggctaacacagtgaaagagaagtctggtggcagcaggctgggcagaagaaccacaaccaggggttgtggcaggcacctgtagtcccagctacttggggaggctgaggcaggagaatcacttgaacccaggaggtggaggttgcagtgaaccaagatcttgccactgcactccagcctggatgacagagtgagactctgtctcaaaaaaaaaaaaagaggtagataagacttacctaggagaaacaacttgatattctatattaaaatattatggatagatatatcctatgctaaatgatgtgttacccagcctgacattctgcaggtacacaggaatatgtgttaagtatatactgggcagtcaaatgtatagggcagttaaatatttcaggagttgtggaaaaaaagatacatagctgaaattaacaagaaggaggtaatatttaatgtgatcattgattaaaaattttcgaagaccagtgggacaagaattgcaggtttaagattggtgggataagaatttcaggctgtatctaattttcaaaggcataaaaaagaatggcactaataattggaggttggataaagaagccctgatttgatgaaatgtttcatattcaggtacagttagaaatataagatggctgggcagggtggcacatgcctgtaatcccagcactttgggaggccgaggcaggcagatcatttgaggtctggagtttgagactagcctgaccaacatagtgaaaccccgtctctactaaaaattcaaaataattagcagggtgtggtggctcatgcctgtagctccagataggcgggaggctgaggcagtagaatcacttgaacctgggaggcggaggttgcagtgaggcaagattgtgccactgtactccagcctgggtgatggagagactccatctcaaaaaaaaaaaaaaaaaaaaaagaaagaaagaaggaaatatgataagatgatagaacagatccagatagggaaaagtatagacaacatgatgaaaggaagggagagagggaaggaggacagaagctatctacctggctggcttctactcacttaaatgatattttagaaagattaatatggcaacttcatgaaaacctgactaaattagagaaaaactggacccagacagattggttaggtgtgatcataatatcaagggaaatgaaacaaaatatagtactactttgagggtccaggattgaggaggtggtaatgggaacagaaagaagctaaaagttgcaggcattacaaaaaaagaataaaatctttttcaacttactgaaggggagataagagccaaaatttgttctacatttttggccctaggctaattaattgggaagtctttaggagtgacaggggcaggggagagtgtacgggtttgattttaaacatagatgaatggggaggaccacctggcagaaggacaatgccatggtgaaatagagaaatttggaagtacttgccaatagagagaggagaacagagggatgaaggtatagttttggaagaaagaacaaactagtattagaaaatgaagtagaactaaattagggaaagcaatcccctgaaaaatatccagcgaacaaagaatcctaaaatccaagggaataggatgtttcttaaaggagatagtgatcactctagactctagaatgttgttgtagtcatatcagagtgttcagagattgtggagaatgaataatgagaaaatgctttggatttagctagacaggtgtcattaattatattcaaaagtgcattttcaggaagccacaagggcaatagctaaatgaaaagaaagaatccatcctgaaggaacagaaaagatgttgaaataattgatgtaggtaggaatgctaactagactctcttttggttatcattgcaatacatattgaaggtatttctttttgcctctcatagtctggtactcaactaagggcccctttgttattattttgtgtatctctggagcctgacacaatgtctgcacatagtgagcacttcaggcatgcattagaagatcgtcacagaatggaaggagagaaatggagaggagcaatggggagacattaaaggcaagcacaaaattacaactgtttgcctgcttgcttattgtttccagcccaaaaaagaagtatcagggtatatatgaagagaaggagccataattataatacaaagaaagacagttcagggttgcatgaagtgatgcagagaggaaatttctttatctagaaagcaggtagggaggagagataatcccaaaaatgttttgtggaaaaagtaagagcaaaagcagattagatgaaatgatctcgattattttgaacaaagacagaggtgtttttaatggaccatggatagctgatacttgaccactattggagatgtttttctattttttgtctgttactgccatctgtgtggatctcccgtacatttttaagggatttaatttactgaatacagctgacgattactcctttcatggatgctgctgaaaaggccaatttttatgaggcataatttgcctaagaattttttatttaattcatttatatggtatgtaactgcatctgttaaaaatggggtgttcacatacggtagtcagtaatcttattcaatttgaaatagatttgaaagctgtgctttgaatgataggcatcctttctcaaattttctcaataggcaaatccatttaatggtgtaacacagcattggttgtatgccataggacttatagagaatccttaaaacacctcctctgtcaccccgttattatatctccacattctcttaagccatggagcagttgcttatgtttcctgccttcgttcgacaacagcattttcacattgcccactgtctgtctgagcaatgacaaatccaaacagctaagatatgaccatgccaccaaggtgtatttggccagcgtgtagatgagatgtacatggtcctaactcaaaactaaggggaatcttatggagcagagtgacaaggaggtgcagatgaaagaagaagcttcttcatgggaccatttcctaaatgaaagtgatggccaagccattcactgctcatgcagtattttctttgttatgacataacctcaaatgtgaagtgatatggtgatatcaacaagttccactattttcttttctttttctctctttttttttttttttttttgagatggagtcttgctctgtcacccaggttggagtgcagcggcgtcatcttggctcactgcaacctccacctcctgagttcaagctattctcctgcctcagcctcccaagtagctgggattacaggagtgtgctaccatgcctggctaatttttgtatttctagtagagacagggtttcaccatgttggccaagctggtctcgaactcctgatcttgtgatctgcccacctaggcctcccaaagagctgtgattacaggcctcagccactgtgcctggcctcactatttcatttttattcaatcgacatttattaagtaaatgatgaccaatgggctaagacagagagcaagactgagaaaacatgacagagcatgacagaaagttctccttcacatatctgagaggtcataagcccttgcctcctaatgacctggtgcctccctgcttctcaccctctttggtggtgaggtgttagtggaatgagaggacccaacagaaacttcagttgatgccagctgtgtgaactcctaggctgagagctggtcagagactacttccctgaccaggaagctccctctgtcacacagctctgtccctcctccttcatttgccctataaatacataaagcagcacagtgtggggatggtgggcatgttcttctcgctcctgcagcactttccgcaggggtcagcctctctaaaaacaagagttgcgggaggtgggcaggattctgttactcctctgtgtgtccttttctcaagtatccctggctttatgcctctactccttataccctgaatacttgagtctcctaggatattgggcttcctttctgtgctgtgcgctgactcttcactgctgcctgactgcctctgtatggatggtaccttagttaccatgttctagtatgggttcttgctggtcttagggtaagatttcactcctgtatggggagcggaggggatgtttccactgaaggaggatacctttggggaaagaagagtattctaggacagaaaatggggatacaagaggcaaatcctaggtaagagaagggaagataactcatgtatcttccctctacggatctcacttcattgagcctggactctgctgagtgtagatccattactttttaaaatgatactattcacagccgggtacagtggctcatacctgtaatcccagtgctttgggatgctaaggtgggaggattgcttgaggttagtagttcaaaccagcctgggcaagatagcaagacccccatctctacaaaaaataaaataaaataatgagctgggcatggtggtgcacacctgtggtctcagctactctagagactgaggcaggaggatagcttgagcctaggagtttgaggctacattgagctatgatagagccactgcatttcagcctaagtgacaaagcaagagcaaatgatacagtttgagtaatgtaataaagtgcatgtgtgctagatccagcaagggcagaccttgaagttggaatggaggatgtcgttcttgagtctatgagtgcagctgagctagagatctgatggtgctccactatggccatacactgccactcactgtccttccagtggcttctcctccccttccttatagaaacttcattttacaagtgtttctcagagtgaagttcacagaccatctggttcagaattccctgcgtgggtatgggaggagtccatgaaaattcatcttgataagtctagccataactccagattcagtatgtctggggtgaccctgtaaattttattactagatagcaccccaagtaaatcttatgcttctaaagtttgagaatcactaatagcctaagtttaatacatcgttatcaacatcattttaattagttaggtctctttgccatggaaaagtatgctatctaggaatgaaatcaattctcagaaggtttaacatcagaagtttaaaaaataccaaaaaacctagagatgcatacaatgacaaaaagacaaaaagaagttccatgtgaaaatatgatgaaaaatgcatacacgtgaaaatgtcatatacccttaggattcatcttaatgcaaattttaacatttgcaataggttcatctgttgcatattttgttaaataaaatatatttgtatgccaaagtttgcattagctgagggcccaggagtacttcaggtcagcacagagccctttgtgtggcttttattgcaagacattggaagataatggcatattattctttcacctgacctctctttctggaacccttggcttttgaaaatgctatattctttcagcaaaaataacagcaacaatagcaatggtttattgtttgccactccatttgtaagaaactttgtatatagtctctcaaagtcatcctgtttgtcatttgaagtattatccatacttgtataatatgacactgatactgatatccatgtgcattgattacttctacaaatattttttgagttctatgcacaggcactattttgggtgctgagaatatgaaataaagaaaacatacattatctgctaataagaatattacattttgagatgagacaaataagtaaaatattaaacagggtgatgattataggctatggaagtgcaatttaaaaatgaaacaaccaaaagcatgattcatgaaaaaaattgataatttgaatttcatattaaaactagaaactttggcactgagaaacataatactaagagaatataaacaagccataaactgcaagaaaaaactggtaaattacatatttgatgaaagacttatatccataatatacaaagaactcttaaaattgcacaagataaccagtaactcaacataaaaatgggtgaaagccctgaacagatacctcaccaaggaagacatgcagatggcaaataagcataagaagcaatgttcaccatcatttgtgattggggaaatgcaaattaaacaacaatgagattttaatatccttactagaatcactaaaatctccaaaactgacaatacaaactgttggtgatatgtggagcaacaggagatctcattcattcagatgcaatatgatatagccactttgaaggacagtttggcagtttctaaaataaaactaaacagatttaattgccttataactcagtaatcacaaccctacatatttactctgctgatttgaaaacatctatttatatggcatcacctaatcttgttccattttctaaaataaacttagaataattttagacttatggaaaattcgcaaagatagtacagaaaattacatatactctacacttatttgtcacaattaataaaccaatatttatagattattaactgagcagagcataataataaaaaaaccataatcacaaacctttctgttgatatgcttagcaaaaatggcaagaacaaacacagtgtgagtgccgaactattcttatttttaagctgacttgcaaagaatggtaaattatacatctgtatgaataagaatcagaaatctagtttagaagattgccaattcaggactgtttcttttaatacccttttttgaagtctaaacttaccagtctaagtaaaaccattcttgtgtttcacagaaaacatttaaagaggcatgcaaggatatacaaaatacagaaagagaataagaaatccatggaaaagagaaaagacaaatatggtcgaagactcaagaagagtcagggaagtgactaatgcacatatacattagggcctatgcatcctgtgcaaacctgtccacccgagaacacagccacaggtggctcaatgggtggggcttgctttgcagtagagtccaggttcaaattccaactgtagtttttatggtgcctgcgctgtgcgacctgggaaaattatttactcactctgtgccagtgtgttcatgagttcattggggctcatcttacattcattccagcattgctatgcagagcagatgataggatgcatgtaaagtacttagcaacagacctagcacacctcagacttgaaaaacctggtggacgttgtctttattgctaacgtcattgttattcttgctacaactggacaacagattgggctcttaagctttctgacacatcagttgtaaagttaatgacaaaattgtatttttaatcataaaatgatctttccgatagatcatgaaactatctccatttcatgtaattcactttgttttaaggaaaattccttaaacaaaatgtttgatttgtgcataaaatactctacgttaacacataaagataaagaaacctggttatcaagcattttctctctaaaagctaggtctgtaattcaatcaaaaatgcattcgatataaacatcttgaataaaaaccagataagattgttgaagacgaagctgattcactgatgtgttctaattctgatgtcagtgacttgatgcaaaccaggcagtcttcattaactctggacctctcagaaaccaaggctgggcaagcgtgcttctagatgtgactcttctttttttaaaacaaaaataataataatttcaagatttatttcagatttggggagtgccttcacaggtttgttacctggttatattgtgtggtgctgagatttgggatacaattaaccccgtcacccaggtaactgagcctagtacccaagttagtttttcagctcttgccccctccttcctttcctcttctagtaatctccagtgtctattgtcaccatctttatgtccatcagtatgcaatgtttagctcccacttacaagtgagaacatgtgaaatttggtttcctgttcctgcattaattcacttaggataatggtctccagctgcattcatgttgctgcaaaggacataatttcattcttttttatggctttgtagtatttgctattgtttaggtaccacattttctatatccaatccactgttgatcagtacccaggttgattccatgagtctgcttttgaaaagaaaacaaacaggtcaaggttaaaccatgctgaatcttgttaggtgcatgttaataaaaggtctcagatgaccagctctttgaagtgatatataggcaatctggaaaaatcagatcttacaataaattatggagatgtcaacccagcattgtggagctaagcagacacattaatcattagaaagtggtaaacagaaagaaatgcagaggctgaattacctcatcttaaactaaaaatcataatgcttgacactgtatgcctactcttttgttgccacagttaaaaatgaatgaaaagccacgagaccagcctggccaacgtggagaaaccccgtttctactaaaaatacaaaaaattagccaggcacgatgatgcgcgtctgtaatcccagctactagagaggctggggcaggaggattgcttgaacctgggaggcggaggttgcagtgaaccaagatcgtgccactgcactccagcctgggtgacaagagtgactccatctcaaagataataataataataaataaaataaaattgatgcttatgaatggtcactttttctcccatactttttctctggttctcaggctcaccaagcttgctctgctttgagtcattgggttcaactcttcgttaaacctggatgtttctttccctaaatctttacttaacctctcagttgcatcacataaagttgagctcccgccctgcatccctggttcatcccctttcttgtttctcttggcttctacaatacctcctttccctcccacttttttctggttccatatcttcttggaattctatttattagaatgtcccagggctctgaactgagctttgttttcttctttgtcaatcattttactgtatataccaaccattccataatttctacttctgggcccaagccatagatattgctatttaatatagcccaaatacagcctctctcatttttttttccaattcagaaatgggactaaaaatccagttgcttaaatcaatagtgctagagttaaactttattcttttttgccccctcattcctcacatccaaagccctcagccatgctccaaagcaggtcttaaagctattcattttaaggcggtatagcatattcgttaagagtacagtttacggaactagacagcctacatttgaaacctgactcaataatttattaactgtgtggtgttggacaagtatttaatgtctcataggcctcagttccatcacctgtaaaatgggaataataatgattgtcatataggcaaggcatgtaaatcagtgactgatagatagaaagcattatgtaaatgctaattaagacatttgctcagaaaggccttttctaaccccttgataaataattatatatgtatattacatataaaatgtgtgtgtgtgtgtgtgtgtgtgtatataatctttagttattttagtctgagttttccagagaaagagaaccaataggttatatatgtgtgtattttaaggaattggttcatgcagttgtgggactagcaagtccaccatctataggacagtctgacaggctggaaactcaagtaggagttatgctgaagtcttgaatttcttcttttccagcagacctcggtttttgcttgtaaggccttctacctggttcaatgaggcccactcacattatcaaggcaaatcttctttacttaaatgttaactatatctacaaaatgtctagaaagcaacaacttagcttagtgtttgattatattactggttactaatgcctgaccaacttcacagaataaactaaccatcacaataggtaataattgataagtaatgctatgccaatttgaaataattgtacttatgtaaaagtgcatttattgtttctaaatttctatgacacaatgcagtgttcatgacccttcttttagaaatagttgcctcttggtgccagatttctcctggaaaacccttgtcctaccaaatggaggctgtggggtgtagataccaagcagggtgttacgtgtgccctcttgggtacaatggagactcaggtttgccaaaagccaaatatatggcatggcgcaagtcagcctttatgtgccacaatttgtatttgccaaatattaatgccagtctcatctaatctataaaattctaagaattagataaatgccagaatgaatttgggaaaacaagaaacattttttaaattgaatatgtgaaaattaaattgcttttaaagacatgatttttcctttatgaaatgacgataagctgaaatgctgtatattttaggtaaatagataatttttccattttcggccacgtctatgttttaggttcacattttttgccatttcagtgcgtgtgaccataaggatttaatgagctgttggcatgatttatttgaagttttactttaaaaaaacagttttaacaacccaagggtagtttaagttttgtggtgctattaagccaatctggccttctattttgaatttctataaataactaatgctatgtaagtcaatgcatattattgaaatatttttagtgtttctgccatttctctttgtacttgtgctctcgtgaatggagtgaaatttgagctcaagaacgtttgtctttttaaagcataaaagtatttaataacattggcttttgaaaagcccttaaaatgtgcacgtatttgtatgggctgcataaaggaagaagcagtttgttgcttcttataataattatattatagttccccgatgcagattcatgtgggagtatttaagggatgaaaggtcaaaaggattaaatatttacattcattagaatatgatcttttggtgtaggcagaaaggaaagagactaattggtttacttctaattgtgagccttatgaacttactgctttggtaataccttaaatgtcatgattaaaaatattgatctgtttctctatgggcttccactgaaatggtagcagtcatctgcaatattacctaatacatttaaaatatggtctttaactataagtgtgagtattataactaatacatctcttttttatgccaagagctctgaataacaagcacttgctcttcttggtatagtgatctgagagccccattgtattctgtttgttttccttaagaaaagcaaggcagaagggcttcgtcgttaattaggctgtgtttctctgagcaagcctatttaatctttggtcttaatttctcagctaggaaacaaaatcttcaaatttgatgttctctaatatttcttggaaccatatatttttgtcttgtattttaaaaagaagaggaagaatggagactgaatccactgcccaatgttggatttcgattagtcaacccaggcgtggtttgccccagaggagcttccagtctcaattgacagcaggccaagagtcgggaaagacacggaaaacaaggcaagatacgagcatttcaagagaaatccccctggaggagtgcttcaagaaaatcctcctggtttttgcaaaagaccctcctggttctttcatttcagccttgggaaacagatcatgacattgcgtaaaaggtgtaatcctagaacaacgagtagattttatgattttttattagtttgttttcaattctgggtcagaatccctttgcatagagtgtcctagagattaaagagcaaagataaaataagtaatagaaaaaaaattgaagataatttatctacttcttctggtattcaggcaagacctggtcaaaaatcagcatctttcaattcatgtttatatttcatttatgttctgtcttgaaaatgaatataatcaattaaaaaatcaagaatctttgtattctgctctttcatgttcatctttcaagaagaatatacattctaaaatgtgcaatagtatgagcttaatgataatgactttaaatttagttctgtaaagttctcatgaggtttagtttttcatatctcatgcatttacacaattttatggtggcgattttgatttcgaatgagtatctcctattctaggagtgtcagaagcttttagctgtactgtcgggctctgtaacaaactgtttttcagaattagctattagttaactagaactttaacccaagtgctcttatccccttaatttggggtcttattctggttttatatctttcagatacttagaaactattcttttatttgacagtttcgtgattgacaatgggagtaataatttggctctccccttttatctttccttgttaatgaagtctatatcgctaatatttttatcttttttaaatcttcaatttgcatttctatatggtaaaatgaagttataaactaaaccagttattccagatgcagaccaagatcaatgttactatgtatctccttgttttgttgaataattcagctttatattcatcttgcacagaccctgatatttttctttcatgcagcagcaattggtttgaatttattgcacactttgatccacagcttctttctgtgtagctttttctccattttcttctccatccagaaaataactgttttggtgtttatgatttgtatgtttttttcaccttgacaatcggtattgtctgtttatgtcctatttttctcttttatttcaaagggcattgcaaggtagaaggtagagtattattataagtactaaactacttattatttcttatagtttttcaacatctctgcaatagcagcatcatttttccatctctatggtagtcatcatcaaacaatatgatctggtaatatcatccatctgctttgtaataaagccacagtcacagagtcatataatttttgacctgaaaaggaacttgacggttgcattgtttgtggatattctaaagatgaggaatgtaactcctagaagtttccccttggattccacagctcattacaggaataagaggactaggacatagattttcaggtatgatagtctttcttctgtgctgtttaatacgaagttatcaaatggatataagttgtatttaaaagcttttgttggccatgtagtatttggactgcattaggcttagagttaaggcaacagcccactccatccactcccctccctgcatgaagaacgggaaaagcaaaattggtcaaggacaaagtccctccagacacacagctacacagttaagtgatgatcacagtgggtccacataggagggaaaacagaccctgtaacttgtatcaccagttcctactcctcagtggggaaagagacactcagtgttaaaaattggagcagaattaactgaacaacatacagtaaattttgctagcaatatttatgaatcaccttgtatttaataaggacattttcatattaaagaatgttctcttccaaatttaaagataactcaataatttgattttacttattttagctgtatatttcctgttatgccaattatacaaaactataggcaacctatcactaatgaactattattcaactaataaaaatatattttgtttttacattagcaataagtatgtggaaagaattacaacatgtgcatatacatggattgaagtctagtaatgttgaaaactataggccaaaaaatactgttgtaaatgtattttaacattacataaattaatgtttataacattacatccttaagaatcaaaaacaattcatctgtaagaaacaaagacaggatttgcattccttgataagtttgagggctcatcaggaaaagccttgttggttctccaaaagccacagaacagtctttgagataagagtggtccagtaaaaaggaaaaataagtgagtggcttagacacctgtttcctagactgaaaaataggatcttaaaattgcctttttttaaaagacttcattttgctttagatagactaaaactagaatgtgggcccagggagtaagggcatgagctgaccactctgtctgtcttaggtaaagagacaacagaagggtttacaaaggattcactaagtgaggaaaagatgtggaccaaaacttgagctgacaaccgggtaggattgcttggaattcagtatgcatatgtgttagaaatagtgagagtaattagaggttatggtagggttcagagggaaaaaatggaacttaaggatcagagcttcaacaagatatctaggcaatgggagaagggcatcatccttcaacaagaagatttaataagtttttggtttgttttcaaaacaatgtgcacaatgtttggtttggtttgtgcacaatgtggttaagacgaaatgaggtaatatatgtgaaagtattttttccagtgcttatctcagtaaacatttgttgaccgtggttgaaatgattttattttctttaaataatgacagaagaacaaaaaagagtatttcctctattgttacatttctagagacacaagtcactagtactttctttttttctaaagctatctaaattatctgcattccctgacttcacatattccttttacttacaaatattccaagtagtttcaaacgttcctttactgaagtggttttcaaacttctgtatgcattaaaatcgcctggggagcttgttaaagtataaattctatatgcacattgaataagatgcttgtgtttaatgggaggtgggcaggttaaagttgctactggactcctagactgcccttccagaaagatctatccccacatcccagcatgccgaagcacttcagaacacacacccatcttccctgcgttgaagtttggctttagctgagaatcacattttctcccccacaggaatatgccaaaattctacttaatcctcaaagataaagttaaaggctacctccagaaaggcttgtgaatttttaaaatgagatgtgatctttctctttttatgcagcctcaacactgtgactaatagtgtatattctgtcctgtttggtgttatgttacttgcgtactccctcacctttgcccttctcccattgcctagattataattactctgagtatgttcttatttgtgcacgttgtcaatgctcagtatacacattgcatttagtgggaacttattttttaaagcgaattcattcttgggaacaaatccagctttcttgttttgattggttcatggtttagtctttctacttaggataagagtagtttacacaccgcagtcagtgttataatattctgtgtttctttgtgtacttattgttaccagtaagttttgtaccttcaggtgattatttattgctcattaaggtccttttctttcttattgaagtgcttcctttaacatgtcttgtaggacaggtctggtgttaatgcggtccgtgagcttttgtctgtctggaaaattctttatttctcctttgtgcttgaaggatgttttcaccagatatactattctgaggtaaaagtttttttccttcagcactttaaacatgccatgccagtctctcctggcttgtaaggtttccactgaaaagtctgctgccagatgtattggagctccagtgcatgttatttgtttcttttatttttctgcttttagtatcctttctttatccttggtctttgacagatttgattgttaaatgcgttgaggtagttttctttgggttaaatctgcttggtattctgtaaccttcctgtacttgcatattatctttctctaggtttgagaagttctctgttattatccctttgaataaactttctacctctatccctttctctacctcctctttaaggccattaattcttagatttgcccttttgaggctattttctagatctataggtatgtttcattgattttcattcttttttcttttgtcttctctgactgtgtattttcttttttcttttttttttaacacagagtcttgctttgtcacccaggctggagtgcagcggcatgatctcggctcaccgcaacctccacctcctgggttcaagtgattctcctgcctcagcctcccaagtagctgggattatagacacgcgccaccatgcccagctattctttgtatttttagtagagatagggtttcaccatgttggccaggctgatcttgaactcctgacctcgtgatccgcctgcctcggcctcccaaagtgctgggattacaggcgtgagccactgcgcctggccctgactgtgtattttcaaatagcctgttttcgacctcactaattctttcttctgcttgatcaattatgcaattaaaagactctaatgcattcttcagtatgccaattgcattttttggctccctaattacttcttgattctttttaattatttcaatctccgttaaatgtatctgatagaattttgaatgtcttctctgtgttgtcttgaatttctttgcatttcctcaacacagctattttgaattatctgtctgaggggtcacatgtctctgtttctccaggattggtccctggtgccttatttagttcacttggtgaggtcatgtttttctggctggtattgatgctggtagatattcttaggtgtctagacattgaagagttagttatttattttaatgatcactgtctgggcttatttgtacccatccttcttgggaaggctttccagatatttgaaaaaacttcgttgtagtgatctaagctgtatctgctttagggggtaccccaagcccagtaatgctgtgattctcacagacatgtagaggtactgcctcgatgatctcagacaagattcagaagaattttctgtattattaggcagagactcttgttctcctcccttcaaggcagcaagtttccttatggcctagtgtgtgtctagaaacatctttggggacctagggcctggaacgggcacctcatgactctgattggtgccctatcctgctgtggctgagatggtatccaagatgcaaggcaaagtcttccccactctttcttctcctctcctcaagcagaaggaaggggtctctcttggagctgtgagctgtgcagcctggggttagaggaagggtgatgccagcactcccttagtcaccccagctagtatgtcagtatgtcacatgccccttcagtccactgtctgtgacccagttgagcactaggactcggtttatttagagacccagagcactttggcatttggtgatgaggtctgtgggaactcaagttcagacctctgagatctgtggttcaccctggctagggctggtctacatgctccctctgtgggtaggtatcagccgagtttggtctgattttcctttcttctctaacaggacagcactgagttcatttcctcaggattgctgagctgtccctttcccagtgccagaggtgctctttgcatggggtcagggaggggtggcttcagtgatccaggagttttctgtgcctgaagagaaaagtctcatagtacctggttttaacactgtatgattgaaggaggcactgtctttttagtgcctctttcagtgataccgtgttaaaaccaggtactatgaggtgtcaggtgatttttggttcctttgaagatgttttctctatatagatagttgttaaattggtatccgtggcaggggtgatcggtggagctttctattccaccatcttgctctgcctcctccccagctttcttgtcttgagacaagacacagtaaatatttaataactactttctgaatcaattagtccacaatagcatcacatgctcttgtcaattataaaaggaggtaaaattgtcaataataaaaggagggttttttcccttcattttggggattaatgtttaggagacaatattcattagtactgtttctaggggatttattaaatatgaagcttcatacacacaaaggcttcatctccctccctaacacacgccaactctctcataccgtgtagccagtaagagtccagctcaaccttttgtgaaaagcagtttgtgtgactgttttgttttgcttatgttttttgagactgagtctcactctgtcgcccaggctggagtgcagtggcgccatctcggctcactgcaagctccacctcccgggttcacgccattctcctgcctcagcctcctgagtagctgggactataggtgcccgccaccacgcctggctaatttttttgtatttttagtagagaagaggtttcatcatgttagccaggatggtctcgatctcctgacctcgtgatccgcccggctcggcctcccaaagtgctgggattacaggcatgagccactgtgctcggcctgtgtgactgttcttaaagtttctttcttagaattctttttttccccttaaaaaatgtccaaaaatgttgacttcggaatgccctcttgattggacattgtggtctcgtgttgctctgttagcaggttgagggcatatttgatcttgaaaaatggagggtcacttaatcaatgcattttccttgggccagctgactctgatgttcaaggagactgaagtgttaaagctggatgactctgcaggccacttctggttttgttgaagtgaaaccctccataaagtcagttgatattttcatcttgttttaacaacaggttcttcacgtagattacatctccagaaacttctggattatatatacctgttaaaaattcctttcataatccttcctaatttagcccttagtaaagattaatccctagctctgtcattgtgcctatccaataattacaactgggccttgttttgaagctgtccttaagcattagttacgttttgaactactggcctcatagcagaagtctcttaaattctttcttaaaggatgagttgaggaagcgtttacagaaagaattcaatttgaaatattcttctgattaggagttctccaatggaggaaatactggaatggaatcctgattattattacgtttgttattgtatttttgtcatagcctttaccctgaagtcatcatgtccaatagaactttctgcaataaaaatagtttatatctgtgctgtctagtggggtatccattcaccaaatgtggctactgagcacttaaaatgtgactagtgtgactgagcaactgagttttaaaattcatttaattttacttaattttaaattgttaccttactggcagcatgaatctagaacagtgaatggttttaccacttccctccaggggacatttgacaatgtatggaggcatttttggttgtcacaagttggggagtgcttctaccatctagggggtagaagtcagggatactgctaaacatcctgcaatgcacaggacagccatcacagcaaagaattatctagcctaaaaggtcaataatgctgaggttgagaaatgctggttttgagtctgagatttttgagacgaggattgcttccctgtctcagtgcctaacattgtgctatgtgtatattatttagttcatggtctctaaattgcagaaaattaactgaaacagagaccaattagtcaacaccaaaatcactggaagtgcatcattttttagacaaaaataaggcaatacaaaacttcggagacacatgcaatgaaagtaataatctttgtaagctcactaaagcagtaaactacaataagtaaagggtaacactaaagatgaacaggcataccacaaaaatactgtctgcacacagtaagctatgtttgatgtgcacaaaatagcttcatgttattaaggcaaatgtcagtatttaacatttgcaaaatatgggcaaactattttaaaatcaaaatagagtacaaagaaatgaaacattactcattcaatttctgattaccaagagagatatatatgttctttttaaactccattagttaaaagttaaataatatgtttctcattttattgttgagactggagcaccttggagaacttaagtaacaagttcaagttatgacagccagttattagcagcttttggtttcaaacttagttctatcttcaaagtaagtgaaatcaattcttaacttgtatagcatctagctttctatgttttagatgaagaaattattgcagaaagtttaaaagaattaccaggtaacacagttagtggcaaatcaggaattagaatgcagatcaagctggttggcctctaacctcgtgaaatttctaatcacagcctattttttgttgttgacagacaaggctgcttttgttttgctttgttttgattttccaaatcaaactacctattatgtggtgaatcacagtagagaaatttgtggtttgtacttattttaaaacttgatattttatgtaaacttaatccttgtagatggcatcaaaatgagaactagaatatacttaaaaatcagaattcattaagctgatagtcgaaccacagagcagaaaagtatcatgtcctctgaaagtcattgtcttttagctcagcggtcccaacctttctggcaccagggaccagttttgtggaagatagtttttcctcagacgaggggtaaggggatggttttagtatgattcaagcacattatatttgttgtgcaccttatttctattattattacattgtaatatacaatgaaataattatacaactcaccataatgtagaatcagtgggagccctgagcttgttttcctgcaactggatggccccatctgggggtgatgggagacagtgacagatcatcaattattaaattctcataaggatctggcaacctaaatcccttgcatgcacagttcacaagagggtccactctcctatgagaatcaaatgccaccactgatctgacaggaggcggagctcaggcggtaatgccagtgatgaggagtggctgtaaataaatacagatgaagcttggctcacttgcctgctgcttacctcctgctgtgaccagtaccagtccatggcctgggggttgggcacccttgttctagttgatacaaaattatcttccaaactgagaattctcattgcgactgttttgtacattttaaagctaatgctatataatagttttatggctatgatcacagccttataaaaatcccgtgttaaagatgtaacaatttcatatgttttgtgctaaaatgagcctttggataagttaaccccccctcctcccctcccctcctctcctcttctttttttttcttttcttttgatggtgccagagaggatagagaagacttgctatagaatggacttctgaaattcatttctctctattcctcttaccttttgtccatcctctctccttccctttcttcctttcactaatatttattaactgcctacaacatgacagatgctgaactaagactttgaggtttaaagaaaaaagatagggacattaatcagtttgatattaaaaaaattgtcttcaacacgtccatccacactccactccccatccctgaagactcaatctctcaagtgtctgtgttcccacagcttgttgtttgctcacataaaattagttaaggcatatggtaggtctctttaataaaaagatgcaaaaatacagtaccttagagaagatggcaagatagtggtttaattccatctcagataatagttcagaagtggatgcatggtctggtgagcagctctcccatcttcagcatgaggcttcagcataaggccagggtgttttgttgactctctgccttgcctttgagcatcatgagaacatggaatatttattttaagagacaggttctcttctgttgcccgggctggagtgtggtgacatgatcatacctcactgcagccatgaactactgagctcaagcggttctcctgcccagtcaccagagtagctaggaccacaggccaccttacctggctatttaaaaaaaatgtgtagagacagggtctcactatgttgtccaggctggtcttgaactcctggtctcaagtgattttcccaccttggcctcccaaagcatgtttgtccatttttacatacctaatgattagcaccatattagatcatcagtaatattaaaatgaattttgaaaaatgtttaaaaactttaatgtagcattttcagttgttctatcaaacataacattttattctaggaactttatctcactctgggattagataggtttagggcttgcttgcttaggattttctctcctataggccttccatgtccatttacttccagaattggaagaatattataaaaggcatctagtcatgtggaaacagccatgaagactagaaaggttggagtgaacagccataacccataaactggacataaactggaagtgtgagttaagatgacttttttaggtacaagtggcaggaacccaatctgaattaagcaagagaggatggtattgtcaatcaagaaaaatgacgaggtaagtctcaatgattttaggaagtttatttgccaaagttaaggatgcactcccatgacactgcctcaggaggtcctgatgacatgtgcccaaggtggttagggctcagcttagtttcagacattttagggagacctgagacatcaatcaatatatgtctcccgttcagaaatatggggacagctcgaagcagggagggggcttctaggtcacaggtaggtgacagaaaaatggttacattcttttgagtttctgataagcctttccaaaggtggcagtcagaatatgcatctatctcagtaagcagaggggatgactttgaatagaatgggaagcaggtttgccctgagcagtttccagcataaattttccttttagcttagtgattttgggggctcaagatgtttttctttcacagtatcttatggagaatgggggtcttaaggcacccactgagaggcctcatgcaaaggtggaaacaaacatagtgagtctttctgtctttcaactctgttcctttctgatatgtgccaaactgctttcatgctgaagattatcttttgtttttttctgtccactagatagatccaacacaatctgagttttaaccagagagagccagagttgattcactactttctttgggttagtgtaaaatcttggctgctgtattattatagagactcgagtccccttttggtagattgttttcagagatggctgctacaccttcccccatgatcttttgcaatgtggctttgtggcttctctcatcaagaaatcaaatattccctctctcagaatctgtgaacctgtcttaacatttgccttaactaacaaactggttgtggcagaagtgacactgaatgagttttgcacccgggcctcaagagactttttaatgtttgtttctgccctgttgtaatgctgacatgagagaagaaggcatgaagaccccagatgaaatactaaatagaaaaagaagtgtggctctcccagctgatcttaaccccctgctgacagcagtgctaattgctaaatgggaatgtggccatttgaaccttctagcctagctgaccctgtagttgaaagcctctgtattagaaagttcagagaatacccgccatgcctccagtcatgggaactaataaatggttattggtttaagacactcacttctggagtgtggttttgtttgtttgtttttattgttttaatgcagcaatatgtaactgttagactcttctagacactctgggccaggagtggagtcacacaggaaaatgagagctccctgggtaattgcatgtacatagtactgattaaaggcaccatagttaacagagctgtaggaaatggctctgagaagaaggcatggttataagcaaacagggcagtaatactgaactacaaactatgtatttcatttgtgaatatccacaaaacagggtggtaagattattttttgaaatgagcccccaaaagcaatattgaatttgcaccatctttctggcccaatattaggaaatttctatttcttattccctctttcactttcaccccacttaccaggaaaggaatagattcctaagccttagtggcatagagaaacctttcttctgaccttcagcatttgtaactttagaggatgaattgttcctatattgcagattgcgtcagtaacattaggggtcatttttatcaccaatgaatattttaaagccatccctttatgattggactatatggttaatactgctgagcttatctagttggaacattgcttgggaagggggcgatattcataagaaagactaaacaataacagcagctgctgataaatggacagtgttgggtttctctcatttggtatggttgacaaggcatgaatgacagttggaaaacagttctggaagaagcaacaaaagccctggatcttttaatattctattttaaaaattctgcagttttgtggcattttggttgtagaggatacagacagaaatggacagctgtatgtctacttcaatttttaattttctctctatttttaacttttccctttagcaatgctaccattatataatgatctatttagtacattttggcatcattgatattagcatttctcaagaggctacaactaagagtagaaaaatacaaaggatcaaagcatattggaacttaaataagttaaagcattttttaaaatgtattttaagttcaggggtacatgtgcaggaggtgcaggtttattacataggtaaacatgtgccgtggtggtttgctgcacctatcaaccaatcaccaaggtattaagcccagcatgcattaactattagttacagcattaaaaacaaaaacaaaactgaggcccagtgagattcaactctgtggtagagggcatgtggaatatgggaacattaggccatttttttatgttttcgaaacaaataaatgccattttctgtgttatctttattcttgagttttttggtaggtgttgcatagtagacagttgacattgccaccacctccaccaccagctaaatagcactcttcagtggtcatgagaactttatttcttgttgcatttctaaatttactattgaaatctcaaattcttcttccgactcttaatattaggaagtacttgaactcttaactcacagtattctccatagttggtaagggtatgagtgagagggaattcatctaacttcataccctgacagttacttatgaattatacataggcaagagtcatctgattatactcctcccttatgagctgcagacttggaaattagtgtccaaagcatttattcaaacagacagcaaagatattctggcacagtttaatgaagaccagtaaactttcatctgcctgaaattttaaaatgtggaatcctcaaataatgaaactttgaacacggcttttgtttatgttgtttgtatatgccttagattggtgtctaataaattccaaccagttaacttttggaatttttttttaaataaataatgaacaggatacataattagaaaggtactatgtgattcttcttggcatgatagtgtctgggtaccaccaaagcaatatccatggtaacagatacaaaatctcttcatgataactaagggctttctaagcttatattctttagaaagctacactgaaggtttaaggtaaatcaattgcatatgagtcgggaagaaaaaccactgtataaatcaaaagcaatcacttagacaattaggagatggcagagaccatgaactactcaactgggatagaattgccaaatatatccgcacattcaagcatttaaatccacttatcataaagtagttctaaacttcaaacttattgttcactggcttgttaatcatatttcaaaaacaatgaaacaatggcatcatatttttgtaatgatattatatattctttaattcaggacagatggctgttcttatattccacagaaaatacatttcctaattatggagcctaggagataaaagtattagcttaatctctaacccttttagttatttgagccaaacccacatggagtttgctaaagagctctgtcacattggtacaatttctatatgtttctttctgaggagctgagagcatcttctgtgagtaacctagagcatgtaagtacacataatgaaaatgctcccttggaattaactcacaacttgatttatgcaggttggccgactcgtgtatgtgagacctgcttgggctccagctgcggttaaacatgtctgtgggaccagtagcctgactttccaatcagagctttgttgctgtgactgctgctgtggagattcaagccacacacaaaccagctgaagagaaggaaatttatcttaagcttgagtagggttcatgggaatctaaaaataggaactgcttactatacagctggtcctcatggggcccctacctggaaaatttaagtgaaagcaatctgtcaacaactggatgatttctctactataagaacagccaatatttactgagctcttagcccataccaaacacttgttatgtgtgtgtgtgtgtgtgtgtgtgtgtgtgtgtgtgtgtgtgtgtgtgtctgtactgtgtatattcatttgcattccttaccacattatgactaaggtactctcatcttcctttatatatggatgagaaaactggttcttaagagtagccgagagacttaccaaggccacaggttgataattactagaacaggaattcagatgcaggtggagtgctcccaaggcccacttacttcaccactgcaatgttttgtgtccagcagagagcttgccccattctcttctctgtgcagagcacttgatgtttgagcataagatatgggattaaaacccatcttaccaaaacaaaaggatgggaatctgacctgattttattaaatcaattctaggatggcagaattatttctccatttagaggaaaaatatattatgtcccaatttctaacctatactatttctccaaatgagctagtggcaagataaccaggacagggtgaatagatatttgtaaagaggaaatgtccaggtagcaaagatccaccagtcatagatttatttgcatggggttttttttttttttttgtacttgtcttgccagagacaagaataaaaggaaatgatttatgtgaaattcacataaaacaaatggcatgtgattgcatgatctgtctatatgaaatagttgtgcctcatccttcctaacaggaaggatggaaagaggaaaatccttttcagctgggtgcggtggctcatgcctgtaattccaacacttcgggaggctgaggcaggtggatcgcctgagctcaggagtttgagaccacccagggcaacatggtgaaaccctgtctctactaaaaatacaaaaaaaaattaaccgagtatggtggcacatgcctccagtcccagctacttgggaggctgaggcaggagaatggcttgagacgccaggtgaagttttcggtgagccgagatcgcatcactgcactccagcttgggctacagagtgagactccatcaaaaaaaaaaataaaaaaaggcttattcatgacttttgtgttccattatatcattaggtactttttctgcatggcttctaatttttctcatttaatgtgttagtatggcaattacattcctaaatattctatgttgaaccattcttgaattcatgggaaaaaaaacctacttggtcatgatgactgtatatatgggtatatgcagtcatatatatacacatgcataaaacatatacgtatatacatatatacatacatatatacacacatatatacacacgtaacatacgtactttttaaatactttgatatattttacttgttgatatttaagataattgcatccatgttaatatatggaattagattacattttccttgcctttctttctttctctctctcctctctcttctcactgtgacatgtatctcttagacaagaagtaggcaaagttgtttttatataaagtaacagaaacaatttaaggtttttatgccagtttgaaaaatcaaagttattagatagatatttaaaccacaaccatttaaaaaggtaaaaatcattcttagtttgcaggcactattaaaacaagtggcagtctgagtgtggcccatgggccaaagtttgctaattcctgtcctagggtcctaagacatagggccattccactggttagaaaatatttatttattccagccaagggaaggctcatttgccaaattaggcattaatgatggcagatacctcactttgttgatgtgaaacatttacagctgaaattctgttgttgttttttttttttccatttgtgtgtcttgtaatttgaaagatctttttaatggggaaaaaatagtcttgaggttggaactgcctttcaggaagaaaacttctggggtgattttgacagccaacgatagattgaagcctcctggagtatccaagggtgactggcctcttcaagaggttttgcaagggctcatcccccttctctgtttctgccaggcagtgggggtgagagcaggcctgaagaaagacacctggataataggtcaagcatccagtgggagggtgcggatggcctgaggtgaatctactgcctgcctagagcatataagtagcagatggactaatggacacatgtcattctttcttttcatccttgtcctacccttattaactctgacctctgtgctttttacttttttacttttttccctattgttattttcagattttgtgaaacatggtctcactccatacactgaaatgtaaacagacattttagcagcagataattttaatatgctggactttcctaaagtctttatactacccatgatgaccctggatgtattatccaaaggaggaaatgaccagatgacagtcacacagagaggagccattgcaggatgagcttgaaagttcacccttacctgatgatcatgtaaaataaaaataacattctaagccccccagccatctgaatggacccctcttcctcctggtccagggcattccaaagttaacctgaaaaactagttcaggccatgatgggaggtgggagccagacatgcctcattatacccgcctgccttttgaaattactgctacaacagaccctaagtctgataagagacacttacaatctattatctctgaagcctgcacctggaggcttcatctgcatcataaaactttggtctccacaaccccttatggtaacccagacagtcctttctattggtaataactctttcaaccaattgtcaatcagaaaatctgtgaatccacctagaacttggaagcctggcttccacttgtcctacctttccagactgaaccaatgtacatcttacgtgtattaattgatgctttatgtatccctaaaatgtataaaaccaagttgtggccgggccaccatggccacatgttctcagcatctcctgagggctgtgtcatgaaccattgatcagtcatatctggctcagaataaatctcttcaaatattttgcagtttgactctttttgtgaacaatcacatttgactaccagacatctgaggaactttggagacctcaaagaatcttagagatcttctagctcagcagtttttaaggcttttgtctggggaatacagacccctctgagattctgaggaaaaggaaggattctctttcccccacaaacatagagaaacacaacacacactcaaacacattacatacaacttcagtttcatgaattccctgtgaaccaccatttagtctactttaagaatgcccgatctcctctaatcccctaaatggcctaaggagggtaaggcattagctaagcaagcaatcctttctcttacttcacataggaagacagtgccatctattataaattatgttcaatttctgcacttactgtttagaagtgtctttctacttcataaaattcatgcaacttatactttgctcatatttgattcaaatttttctttgtaaatataaggaagcattcaatatagagaagaagatttaaaggtagtattttctttgttttaagcactgacttataaaaacaaagtttaaaaaaagaaaagtaataaagatgtcctagtattacagaaaaagggttccaatccagaccccaagagagggttcttggatctcatgcaagaaagaattcaggtcaagtccatagagtaaagtgaaagcaagtttattagaaaagtaaaggaataaaagaacagctactccatagacggagccagtcctgagggctgctggttgctcatttttgtggttgtttcttgattatatgctagacaagtggtgaattatccatgcctcccctttttagaccatacaggataaattcctgacgttgccatggcatttgtaaactgtcatgatgttggtgggagtgtagcagtgaggacgaccagagatcactctcgtcaccatcttgggtttggtgggttttagctggtttctttactgcaacctgttttatcagcaagatctttagacctgtatcttgtgctgacctcctatctcttcctgtgacttagaatgccttaaccatctgggaatgcggcccagtagctttcagccttattttacccagctcctattcaagatggagttgctctcgttcaaatgcctatgacactaggagctttagtgtatagcccatttgccaaaaacagtacaagacatgctcttatgagatgttgctaattaatggttccttaaatataattgatttttatttttcactttttgaaagatcaaaaagtatttgatagctgctttatgtaaagctatctgaactggaagtaaacaaataataaaatgtagcagctttctacagaaattcaaatttaaggaatctctggggcaattatatgtaaaactgatgataatttatatctgtgtgtgtgtaaaataacaattctgaaatggcttcatttcaaagcaaaacacacaagtagttagtccaaaatcatacatttctcaaattatgagatccagagaagctgaaagacccaatttaaacaatttaaactctacataagaactgtgaaatactttctcttctttattgtttactcaataatctaaaaataatcagaactagctcactaaatccttttccttttacacctactctgtttagtttaaatggaaaaggctgagatttcacatttgtacatggatttatagtgcttgaagtgaaataatattttctggtttagtggcatttattgcttatcaaatctttaaattttttaaggttatatttacaataattatgtttaattttatatataaaatgaaaattaataagcaaactttggaagagttagccaacttaaagcactattgcttgccttcttttatttttatattttatttttttggagactgagtttcactctttttgcccaggttggagtgcaatggcacagtcttggctcactgtaacctccacctcctgggttcaagtgattctcctgccccagcctcccaagtagctgggattacaggtgcgcgccaccatgcccaggtaatttttatatttttagtagatacagggtttcatcatgttggccaggctggtctcaaactcctgacctcaggtgatctgcctgcctccacctcccaaaatgctggaattacaggcgtgagccaccgcacctggcctgcttgccttcttttagatgtgctctcaacttcaagattttctgtaccatttaacttggaggaagataaattttcttatcttcccccacagatgcagtgtagtgatactggttgtcttcctgcttgggcaggatgcctaagtacttaattgttcggtctctacataagaatcactttgctgaacaatgaaatgcagctgcctctagggtagaatgcagcagctattgagcagcacaagccctactaccggtcagtttggggcctcgcaaggggaagagtgcaaatccatttccaaaaaaaagggaagaaattgacagccaatggaatttttagtttttgcaaattggctctgccccaccaatattctcttttagtccatgtcatctctttcataaatttagtatgttttcttccttctttcttgacagtcttttttttttttgtcttctgccagttttcctccccctttctagttaattcccctaattgtcagcaattgtgcttagtaatttttggtttcaagtcagctctcaacaagagttgtctcttgaatatttagaattaatcttgacattttatgtccctctgtgcatgctgatggaggttctttaacttgctgagggagaacaagtggcttatagaaatcataggtctgccagaggctggaaactgtgccaatggtggccagggacagaatcagagtcttagagagttttctagttaattagatttggtcacatgacctttgtgactcaaccaatggcaataaataatgagacacacaatcccaggccagaagccttctgctagtatatctagttagcagaagtggaatctctactaggattatgactgcagggccttcgtcaactgcaccttttccagaaatccctcttaagctttcccaatgtaaacttatttctctcttctctgaacttctctggacttcttttattctttatacttggaaactcatcacacataattgtgtggattccttttgttaaactctgcagaggaatcttcagtgggaagagtggcttaccttcttatcccctaattttcactctgtcttaatttttacataaatttgatcattcttttccctaccatgttcatctccaggacttccctcccttcactgtcctccctctactatgtttctccatgtcttccctgccaacatgtatcttctcaaaatgcacacacatacatgcttatctcagtacagttaatagaatttgttcattttcccaactggattgtaaagagggtttcttaactttcacagatctatcacattaaattgcctacagttgttactaaaaactcttgagatatatatggaataattcattcaacatttattgagccttactttgtgcatttcacagcagcttcttgccaagaagaaacctatgtattttgaagttctggtgttaaacaactgtattttagctttatgattaaattaaaatgaggattaagtttttcttctgctcatattgaaataagtgactagaatagatcacggtttatatggacaggaatctcacttagcaaacagtaggctgatgattgacagcaccatcaccctctccctgttcctcaaactctacttccagtggtcatgtcttaggacaagatacttattcagaaccagagctggttttatgctactatttcttaatattccacaggcttattgttggttaaagacctgcatattcaaatgcctctaagttaagcttgatgtattccccaactctaaaggccgtagttcccctgggcacagttatgaccacgggaacttctcttgtaacactcagcctgcaggtaatttaactcatgattttatgtagcagctctaccctggtgactcttgcatttgaacctttgcctgtatctttcctgagaactacagactcacatatccaactgcctactagatagctctgttgggatgtctaggagacatatcaaacttaagaagttcaaagccaaatttctgtttttttctccccaaacctgctcttgccccagttttctgtgtatcagttgtaatttctcaggttgtatttggggtcatactcaactcctctctctaataaccctcatctcttctatcttcaaactcttggctctaccttcaatatgtactcagaatttatatgtagaatgtaatatattcaattgatggcatatcatgtagcagagaatgaaatatatatatatatatataaaaacatggatgaatctcataaatgtaatgttgaaaaaaagcagtgagccacaaatatacaacctatgcttttatctatataaaggaaaaaaacaggcgaaacttacttatgctattagaagtcaggttgcccgtgaagcttagtgactgggaggcattgtatgggagcttccagatgtttacttggtcaaaattaagctatatattgatgatatgtgtacttttttgtatatgatacctatgttaaaataatatggacatgtctttctacctctctgatccaaacaacgccatctcttaaccggatcctggggatggcctcctatttgcttctctttctgccaccatgctctcctcagtgtgtagccagagtgatcttctaatatgtaactgggtttgtgccacttctgttcagaagttgccaatggctctccatcttttgcaaggtggaagccaaaggccttacaggccccacctgttctgttgtactgtgcttagttctctggatttacttccccttactcacatcccttctttctgggctccagccacattgaccacagagttcattgatgccaaccatctttcatcctcgggacatttctgctgtcttgtgaccctaacttaactctgtccctaaatgcatttaggattttctccctcggtccttctgatctctgctgtagttttttcttaccagcgaggcctcccatgaccatcctgtatgaaatagcacctctgctgatctcacccatgttaacacactttgctttttttccccacaggaaaatgattctatgaaaagctgtatttataatttgttattatctgttatttttctatattttccagaatatttaatccatgggggcagggatatttagtgtgtgtttgtttggtgccttcctttttgtattttcagtgcctagagaagtgcctgacacacagctagctggactttagtgaatatttgttgaataaataaaaacaactgggaaacaggtactccattgtgattgagaaaatgagcaagaactacagtacttactagatcctatgatagggtatttctaactttgtaagtatatcccaaagaaaaaaatgaaagaaatagccacttgcatgttattgtttgtatgctcttcacaattgctatatacaaaggctaacaaaagggaaaactcagctaaatggttctaaattgagggaagaaggaggtgggcaggagagaagatcccaatctcctgttaagggtggtcttgcatattccatagggaaacacattgttattgattggaagaggtcttatcccatttcccatgttgaaatatgaaaatgtttgaaaaacactaacaagtgcttcagtgtgatttaatacatatggaaaacagatgaccatgttaacatgaaatgatatttaagtagaaaagcagaataaagaatagtaagtagacatggtttttttttattttattcattaaaattaataaaggtggaaagaataatttaattaagatataagtttaatttttgactcaaaatgcagaacttcagctgataaattttccaatagaaaatgacctttttcccccaattttatgcatgtactataaaatgtaaggtaatggattaaacacatcctactttaagatttactgttgaaacacacgtcttatttttacctcaagaataaatgaattaagtaaagatatttttttttcttttttggatgtgttgggggaataggcattctttccagaagagtgggcagaggtgaaactagttgccacactttaattataacgatagtagactctcctcaggtacgttagaatacactaagaaattcagctaagatttacctgtctttacactgcaacactagagaactttctagaggagtaccatcccatacctatttaattgtgatgcttgctaatatgtcattcagcaacaatttcttataagtactccccaacctgctactttttgcttcatctcccattgtctaacaaatttaatttcccaggatttctcaacctgacaatccattgtcaccaaataaatacaatcattcctgcctctgaactgtttatcgatctgggaacttcactttcctcttttcttactttaaatgcccatttttgtcttcaggacattgaatgatccatcagatccaatccctgccttggcattatctcccctattattcaatccatgccttggcattatctcctctataatctcactcattcctgcctctgtgttcttcacccttactgaaaactcattttaattaattataaagaattgtgtccaaaaccagtaagatgacttccttgaaacaggtgctaaatgatcctcgcttcaaaataatcaccgcctttctttgcattgccatgattttaaaaataaattatattattgcacactgtatttacttcatttgcttttgtctttatatacttataacttttttcaactttctattttagcaacttcataaaaaatcgagaccatatgatctgatctttatagtattaaagtgctatacaattaggggagcccagtgagttagctgagactttttgtaatacataatgcagaagacacagggaggagtagtaaagatgagcttagcagggttgtttgtgttgttcataaaagatgaagtaagcaagttggttaatttaaaaaaaattatagttattatcattgtgttcatttcctattgctactgcaacatattactacccgcttattggcttaaacaatgttaatttattatcttatagttctgaaagtcagaagtttaaaatcagtttcacatgctaaagtcaagatgttggcaggctggttccttctgggaggtgtcagggagaatttatttccttgccttttccaacttttagaggccactgcattccttgtttcgtggccccttttttgcaatagcatcactcctacctctgctaccactgtcacatctccttttatctattgatcctcttacctctgtcttataaagacccttccaatgacactgggcccacctagacaatcctgaaaatcttcccctctccagacctatagtttaaccacacatgcacggtgccttttgctatataaggtaacaaattctcaggttactgggatgaggacatggacatttggtagaaggggcattattttgactatcacaatccctactagtgccaatctcactcacttagatgaatgcgaaagaagttaccctgagtacactagagggtatgtccgacatgtggattttatcactagtgcatgtcactacagacaaatagtttgagagcttctcttttgtgccaaggagtttggaaactttatctgttaggcattggtgaactctcagtgctttccaagcaggtgaagaacctgctcagttctatattttagaaaaataactgatcacagaatgaggttgatgggagctcagactcacgtggtggaaagcctaaactcagaaataatggcaatggaattggagtgcaggcagatgttgcagagacattccagagaggatcctgtgtggacttggaagtgtttgcagagaggtaggaatatagaggataccttttgaagtttttagcttaggtggcagcataagaaatgacaacattaatgaatttgaataaattcagttataaatatctatgagaaatgcctctgtcagtttcagaatcagaggttggcagtcatgttgcagaaaacatactgcactcagatttacaaatatgtattttggacttaactggaaaggttaagggacacctgcttccgtgagaggactccagagtggttgcatgcatgcatacatgtccacatgcatacatgtatacctacaaacatacatatgtatacatgcacatacatccatgcacacaatttactgaccttagtgaccagggcataatagtataaatcatcaaaacttccaggtatcagtgctcttttgaatacagatattgcttccatttcagtctgtgcaggctcaagctcattttataattttgctttgcatacattccatacttagtctcctgtaaatgtaaaagaaacacaaagcaattggaaaaaataaatcctttacaatgcgaaatcatgaagttgtttcttgctctcaaagagtttaatgtctaatggtaagataaacatatgtaataatgatacaccatgtcagctgttaaaaatagtaatagctaatgtttactaagtttaaaccttatgagctcagcactgcttagccttttaaatgtgttagctaattaaatgttacaatcgtcatataaggtggacattgcgtgtaaagtacacaacagagaaaagggtaacagctttattctagtcacgagtcaaacctgtgtgagtcagggaaatgttcctagaggagctagcccttgaaatgagacttcatggatgaggttttacaggtctataaatgtgaaaggctatcaaaagaagaataacattggaaaaagctgagagatttgagaaggcacaatgtgtcagggagtgatgagtgggccagattttaaagtgccagagggagaatggcaacagatgaggcttgccagaaacgggaaggtcagctcacaaaggacattgtgaccagagtggaaggagtttattttgtatgatatggcttatgggaagacaaatgactttgagcaggacagtgagccaattcgatttgcatgtgagccgagtttttattgcagagggaaaaatgcatcccttggggactggggagaggtgaggaagccaggaatcataattagcgctcaggggcctatttcagtagtctaggttaaaaatgatgagaattgtatctatgtggtagtgcaaaggacaaacacgtggcacatttttacggtagagttgagagtgtgtggtgagtggaaatgggaagtggaaggaaaattgggaagtagaggatggtgtccaggggcccctcatcaagactgtgatggtgagaggagagtcaagacttctgggaagatggcatattaatatttggatatgttgcatttgacatgcttcctggctatctggggagaggcctccataggcacttggctatatgggcctgaagctcaaaatatatttggcctaggatttggcaatctgtgatgagagtggatattaatcttctgggagagagtcagccaattagaaaaacagatcatatgaataaagaaaaaggccaagaaagagcacctcagggaatatttacatttggaaatgtacttctagagcaaatgagaatcacaaatagtgatgatgtagtcagcagtacatcagtagtagctgaaatcgtaatagtggatgcaatatcttacgtagaatttgtagaagcagagcagtaagtaaaaagatacaaatgaaacgctggggaagaggaaaagaggaatttccgctaggaactgtttaagagctgttaggaaaattaccaagccaaatggtgtcagagaaaccagtgaaggggaaaggcactagagagagggaggagttgacgatgtcaaaggacgcagaaagggtgagtaaggtaatactgaaaattgctctttgccagttaagagaataattggtaacctttgtgagagtgattggaatatggtggtgagggtaaaatgccaaaaagagtaggtgtagaggtaaatgggatttgagggctatatactaatgaattgaggcgtaatgattgttgattaaataaatgaccttctaagatcttttgaaactaacttcagtgtaatgttagaaatacaatggggttgtgacttttaaatgaaattacttaggaatcagaatgtaaggccagagaataattattgggaccaggtaaattgtaagtagaattatcagttggctaccagttatacctatcattcagtctcctgctattttcttcaacttccagttttgagtaagtgtcccctgatccaatcatagttattgatgtcatttaatgcccctattattgatcgttacttagacttatgcataataagacatagtaaccacttttgacaagccataaatattagggccatataattattttcacctggcttattcctcagaagtagaaattatgaaccattttgcagatcatttagaacatagagaacatatattagctagagctgattaattaaaccttttgtaactttatttcctaagagttgaatgagtcatttattttgaattagtataaacctacttgtattcaacttttgattcatggcttacaaagtatgaatagattgggcacagatataaaattagcccagtgtacttattggtagatttcaaaaactatttaaataatatgtttagcccctacatgaattaatagacataaaaaaggccattcaagatctgttcaatggttgtcactgaatgttgagatgttaacagagtgggaggttggcatttgagctgtggaacaaataagaatctcatgagatcctgaagccctaaagatgaatccagtttatttttcccatttctctcccagacatgcctcaaccgatcctttttacctctcctttcatccttccaagccccaaatattttaaaataaagaaatggatttacatatagagacatgtaaacaataataatgggttaggataatgtattgagataatgtttgtttcatcctgcctgcatcttctcttctccattacaagaaggtaattaagcctctgtgcatagttgcttcaggggtagcctttgttaggtaggatttttattttatgaaaacatatactccttgaaagaatcatgctagtggagagaagaaaatggggagaatattacttttgagcttagaggaagtagaaagaagtaggagtattctccaagactgggaagtagatggaggactgggtgttccacaaagaccaagcccatggctgtgctctagcaggatcacaaaggagacatcctccaggtacttctaggggctgcaaattctcagcattcagaaaaattcaaacccatgtgcagcaagggatcatgtgtaatttggacaatgagctgtcatcattctcaaccatctaccagaatctctaccttaggtatagtaaagacacctgtattatttgtcactctacggagaaggacaggtggcctcctgcattcgtaattgaatttcttaagagtcaggtgtaaataaaattaaataatatgacatttttatacaatgcagttgtggatgcaaataccaactagtataattcttccattaaaaaatatattttgagttctaatcagacctattctttctcagctctggaaatatagccgtgtaggtgactggtatgttctctgctttctgaggtcttgtgttagatacagttctctatggatctctcacatttctgcacattgtgtgagcagaggcactgggtactctttgtacctgactagcttttcaaggatgtttgcatagtaaacagccttggaaataaagataatgtctccctctggagcagaggacagacatgtttgctatccataaaaaacagtgtttctctaagctcagagttcctttcctgtaatacagactactgtgtgtacaagcatccacctctgctcagccttgttgccccacaaaactgtggcaggctgactttttagcttgcagtgtaatgtcttagatcctgtgacatgctggatgaaggaaggccttgtgtctggatgtgttcttacaagttctttcttactttacctgcctcattgcttggcattgattcattccaatgagttgcccctaccttttttgggaaaaaaaaaattaagcttgtgaagtttggaaatagtgaagagatctcagactttaggatcacaattattgtcctagattgaacatttcatggttttgtgatattagaaaaatcacttaccattctgccctcagttcctaatcagtaaaacagagatgaggatactcatgacattgtcacttgtgagtactcaacaaaatgacacatttctgaaatccaaagaacctgatcaatgataaaaacgtatatatgcaaaatatttatttctataatacctatactaaacaatgccttgtaattttataagtcatttattacataatccaaattcattggttcttgtactacatttgttcttctacttaacagaaatcactggaacatctatgtgctaagctgtatcaatattttatgcattatatagagagaattttggatggtatgtatgtttagtatgatgccaatccagagaatatgggcctaagtggaatatctctggtgagcagcatggagacattgaaatggaaggtgatgaaggaaaaaagagaagccttgtgttaagagctctgcagcatgtgcagtattgcagtgccagcaagctaacttgccagtttcagaaaagctggtagatgacataagactgcatcaaaaacaaatgcctttattactcacagcgcagaaagcagtgtgagtctcaaattcatgttggatccccttacgctgagtcccatgggggtgagacagagcgactcatgtagagctgggcatgcagtggggctgcaccccaactgagggtacctgagccacaggaagctttatcttttatattggacaggaaacacccatccctgagctaaaggaacctgaatcttttactttgaatagtaaacattccccttaagggagatgttatttttattataggaagtaataagtaaagctggcctgtaccctctctatcttccaaggttttcattatgcaaacatctgtgataagagagtctcgaataaaggggcagttagtgcatatgctcacaagatgtgcaaaaagatcgaagacccatatggataatcgccacccaatatccaggtgaaggggaggcatcttaaagtaaatcttagcctccttcaccattaggtcttgggccaacccaaattatagtgcagaaattacaatacataatcagattttattattgcacaaaaatcactattcttcatttttcttttcatttctttttccaactttccccaataccacacacacacacactcatgcacacacacacacacacacacacacacacacagaagaaggagataaaacatacaagaataagaatgatacaatggactttggggactgtgggaggaaagggtgggaagggggtgagggataaaagactacaaattgcgttaagtgtgtacgattcagggatgggtgcaccaaagtctcacaaatcgccaccaaagaacttactcatgtaaccaaataacacctgttccccaaaaacctgtggaaataaaaaaataaaaaataaaaaaagaagaggaaagaatgagaaggaggttaggagagaaagaaaacaggacttcagagaaaagtaaatgagaaagcagatatagggatttatggtatttcatcatggctttagacatctgttaggttggtgcaaaagtaattgtggtttttgccattatttttaattcttttgcctttacttttaatggcaaaaacagcaattacttttgaagattagaatgcttaatatgaacctcaaagtgagtatttatttattcatttattacatataaaaagctgtacatatataatgtatacagctctgagctctgggataagtaaacatctgagaaactattaccaccatgaaggccataaacatacccatcaccttccaaagtttcctccctgccttttctttctttctttatttattttgcagtaacaaaacttatcataagatctacccgcttagcaagtcttaagcgtacaatattttatcattaattataggttctatgctgtacagtagatctccataacttacttatcttgaataactgaaacgtaaagtgagcatttaagtaatatactccatgaataagagtaagtatgtacattctgccaagatgtaataggtaggataaatctaccttgcttgaaaccaaagtctagtatatctttccatgcatattgtcttcagcatcttacttcaggctccctcttcagttgaccattgagaatgtgaggatatggagccgtgcggttgattttcatgtcctataccggaacaggataggcacaaccttaatatttgtagggcccaggacaatagtacaactggaggcctacctactatatgtctaaatattttatgaatcagtctaactgtgaataaaaatatgttctagcctcatcttgacaagcatactgtcacaatagtgaaaaatatgtgcaatgctatactatttctatgacagaaagtcagcaaagtctcagggtcatctaactttaaatatgactatccagttaggtgttctgttgatgggatgcataagaaataaagtcaatttatacaaactatgatatctttttatataacattgacttttcttgccttcatttcagcaaaattgtatattatgttattaaagattcttacgtaatttgtgttgtgttgagactaattgtcttaaaagatttaaaaatataatagtaaagtacacaaactttaaatatattttccaaaaatcaaaatgaattactataaaaattcaaaatatttttatgtatgtgtttaaaagttattttttataaatattttaaattagcttgcaaaatttaagggtataagaaaaatgtaattaataaatattacatttttaaatcaattgtattaaattaaatttcatttaatttgtttatgaaaagaaattattagcaattgtactattaaatgactttctaattgccaaaataaaggactgtatcatgttttatacaggctacattgcgactcaaatatatgtacaatatgtacaaatttaagaatatagtgaatttaagagtacagtactgatgtgagtgctgcgatattttgtgtaggactcagaaccacagtttgaaagaagagacataaaaagggttactcaacactactatgagaaaatgcatttccatgcaagaatctactgcattcattagtcttttcagtgaaataaatgcttctcttcaaatctccttgtcctcgggtgaaatgtctgtctttaacaacacaaaagagttcctagtatttggactcagttccgttttgttatgaggacattggtcagtatgtctggaaacggtttctctgggccctaaaatgtcttagtcataagaatggatatttagggctgcaagtttcactgtgccagtgctggacacaccagatcccaagtgacagggatgcatctgctctttaatacatttatattttgtatgtttttgatacttggggtactataaaggggccctggacaggcacccgtcttaacactgttaggacagagacagaccttgtcaaacagggagaaaattagatatccaatcttttctggaacttaagaaagattttaatattgtaatccctttaacagctctttaaaagtggcctaaattcaggagaatggcgtgaacccgggaggcggagcttgcagtgagccgagagccgcgattgcgccgctgcattccagcctaggcgacagagcgagactccgtctcaaaaaaaaaaaaaaaaaagtggcctaaactatgcccaagttggtgatataaatatatgcctacaacagcaacaacaaatagaaacaaaaacacataaacagaaaaggaacccagcatatacacttcgtgagaactgactcctgaccacaagcggggcatacaaccagattgccttaaggacacatggaggcaggcagcatccaacgggctcatctctgcccatcagatggagctgtcagatgtgtgatggttagaatggttgcttttgggcaggtccagggtttcaagccaaatatgtgaatcaggttgggaagaaaaatgcatgtagcagcatcagttaggtaatgagaagtggcacagtgtgatcaaagcgggttactaggaatgcaaatgcagatttttccctgtccatgctaaaaagatgcaatccaccccgtctttattatgcattcctgctgtggcctggagtactgtgttagccctccaggagatggaacagtgcagggatgagatagatatgactcatgaagctcagtctagttatgcaggttaaattgatcactttcaatgagagttgccctccctccatagaggcactttttcctttttcacttccagctctgttgccaaaattcccattaaggtcattacattatgtctttaaaagtacctttcaaaatgcaaacaatgtatcacaattgtaaaacattgtcaacataagctattaatgccagagtggtaggaaataggctttttgttgttgtttttgtccacaaaatattggaaggactagaatgagaaagtacctatgtagacatccagtataaagtcaggtggaaggtgggtaggtaggatgtaatggaagatatggagatcaccaaagcccaagcatgcaggcccaggtggtcatctaaaataagcatgattggtctcatttcctttgtttaaatgggagacttcagctttcttaaaattgagtggcttggctgggtgtgatggctcacaactataatcccaacattttgggaggccaaggcgggtggatcacaaagtcaggagttcaagaccagcctgaccaatatgatgaaacctcatctctactaaaaatataaaaaaatagtcaggtgtggtggtgcacacctgttgtcccagcttactcaggaggctgaggcaggagaactgcttgagcccaggaggcagaggttgcagtgagccaagatcacaccactgcactccagcctgggtgacagagcaagactctgtcttaaaaaaaaaaaaaaaaaaatgattggcttaacagaaaaattgcccctgttgtgtttgtacatttagatgttttgatttatggaaataattcatgatgaggagtgaaacattttaaaagtttccattaaatatgttccagtttccttatttgtaaaagttaatggtttattattagatgctttaggattgcactgttctctggggtggattttattaaatgaatcatttattcttcattatttcttaattttttttatatttataccagattttacatgaatggtttctgcatccctcttactgacactgacacaaatttaccctttttctcatatgtatattccctgatagatctttggaatcacccagtctgctggttctccaagcatagtcccaagacctgcagcattctctgggaacttgttagggattcatgttccctgccccatactagaactgctgaatgagacactctggggtgggggcccagcaatctgtattttaactggatattccaagaattctgaatttgtggcctagtccaactcttatgtctccacatcagggaacaggttgaaagcaagatggtactaatcccctaggcatcggactcctactctagtgcttttttgtttgtttgtttcatcactatactaaggtccatgttaagaacacaatgtgagtctcctggtgggtttcaggactttccaatcctcatggatctccaaaatttatcagaaccatctaacagtataataagatatttcttttttccttttattcagttagatttttatctttatttgaaatcttaattattttttaaaaatgcagaataggagatgaagcactggagtgaaaccagttgtagtaaaagccaactaatttatataataagacttttttttttttttttttttttacaaaaatactcattcttgaaagaatagcaagttaattggaagcatctagaaattacgatgtgaccaaaaggggccttcgaagatgactcaaaagaaatctttatcactaattgaagagcatagacagatatttgaatatcaaaaaatgaaagcaaatgtaaaagcattggcacaaatttctgaaagacagggattttgaataagactgaggatatcagactagagtaacacagttttataaaggaaattctccccaggagagtggtttcatttgttttcacttccagaaagtaagaaaagagcagactctggagtcctcaatgaatctcacagtgttccaaggtgatgcatggaaagtacgcatctggcattaaaaacatgtgatctgatttattgttgaagaaaagaggataaattatcctgctatagtacatcttactctcttttgttgttctctctggtgagccccagcccagatttgcaatccaggacccaagggatactttcctaggcagctcctgcctatagttttgggaaagtaaagtcgatgttttgtatgtcagctcacagttataattcgatgcagtctcagatcttgtttttttttttttaatctctgccagcctcattccccctcttcttaaatatgttcatgtatatataaacattgtatgtatgcttatgtatctagatatgtatcgagatgccttattctttttttttaacagggattcctttaattccaaacaccacaccccgcctgtaatatagactgtgatacagagttggcctccacagatgcagactgaagaggaacctttttcatatagtttgagggtttttgttttttctgcaaaaactctcattgccttcttgtccagaaaggcatgtagaaatgagccctattgtattgtggaagaatctcttcttgtacgacaatcaaaaatactgcagaaatttaaatcccccacgattttactgtacataacaaagatttggaggtatcagttaggctgatacatctttggaacagataatgaagcttagaaagtgagagagcaaaaagagctattaccgtaggctttaaattttttcttaaaattgtttagcatcactgaactgaaaggagcttcaaattcacagtcttaatgtcacattagcatattcctttcattctttaaactatatttaatttatttttccacagggttatggtagtgatcattatgaaaatgtattttattttatatgtcataaaaatagcaacatcttagacacagatgtaggtcagtagtcatggtaattacttactctgtagattggcataataatgaccattttgcttagaggggaaaagttcagggatgtgaaactgagtagaaaggagaagcaatcacatgatctgaaaggccaagtgactgatacagtttttcagacattgcataagatttttttcctaaggaacttcacatgcagatggattaatctgtaacttatgtcactatatcagaatttgctaaaagctataattttgtcaaataaaatacaagagaactctttaagatgcagagtatggtgattctaattcaaatttgaaaagaaaatttatttttatatcaagagattttacggtagtttggaaagttagaaaactaagaatttctgggaagctcgcatgttatattataaaagatggctgtgctgcttttggtgcaaaacgctagcccctcacctcttttctaaactccaggcaaatgttctcccttgcattgagatatgtacattcccacctagattcaattctgattccttctctgaatgaacattgacttccttgtcttattctcatttgctattagtattacctttatttgtcaatacctcagtaatatgtgtccaaaattgaaaaatacaggaaatgctaaaaaaaagtcagctcagataatattgacagcagctcctgtcttgtggaagatgaccggtgtcttggggagtttagaggagcccaccagcaacagatcacgtccacctgcagaaggggacaacagccaaggaggatggcgaaagagaggggctccagctctagaggtatgtgatgggagcctgctagagtacactaaaatttaggcaggagcagaagaggaagtgttgagtaatctgtacgttttttgataacatgcctgctgaaagacaattttagtctgatggatgattatttaggggacttaccagatgagcgctaattattgttttgttgcaatgtgatgtgaatctggtcagaaaggcttggatcatttaggtgtcatagaaagtggttatggagatttactgaaaagaactggtcctgaagactttgaaaaatattcagttgttgtctctagattaatatattgggggagctacaaggacattttaacccagcaatacctgaatccagatctgtgctttttgtcacccaagcaaaggtaatagtagtttatgtactaattaaaagctctttagagaaattagaaaggacttgagaaaggttttgctaaatgtaaatttatgagagagggtgaattgttttcaaaaacgttgagagaatggactagatacctcttgcctcttgtgcactccctcattgtcttcagccactgtggtgtgaccagcttcccacagatggaacctaacagcagctagctcagctgcagccagtttctcttgctttctgccccagggtatgcttttgccacgagcttttggaactcttgggggaaaccatctagacattctaagtcaagcatagtggatagttaatgtaatagtggatcgtttatgtgctaattaaatgctctttagagaaactggaaagggcttgagttccaggttattgaggccccttgacaaatgaaggcactagggctaatagataagagctgtttcttccctgccttgggcagatgatgttgagatgcatttttcctgtctctgcagattcccagcagtagcagtgcatacgggggctcacagacccactctatgttaatttccttggttcttgaatacaaaattagagtggatccacttagcagtgtgtagaacccttaaattagttctctaatccatagagtaaaagctattctgggccaggcatggtggctcatgcctgtaatcccagcactttgggaggccaaggcaggcagatcacctgaggtcaggagttcgagaccagcctgaccaacatggggaaaccccttctctactaaaaatataaaaattagccaggcgtggtggcacatgcctgtaatctaagctactcgggaggctgaggcaggagaatcgcttgaacccgggaggcagaggttgcagtgagccaagatcatgccattgcactctagcctgggcaacaagagtgaaactctgtctcaaaaaaaaaaaaaaaaaaaaatgaaaaaagaaagaaagaaaaaaagctattccgatacaaaagaaaaggcagaagcttctgagcttctgactcctcttcccaggataagataaatcagaactagtactgcatcctaggagaaattgcatagattggtgccaccagcaaagacctaaagcacgtagaggctatgctctccctcagtattaccattcattattcttgtatcactcctgaaacaatagagggatcacagaaagcttctaggtataaagggataatatcctaaatgtaaattattgtaacaccagttatatcctcctacagagcatttctttccatttttacaaagtagagctataggagttaattattttaagaaagttctgaagttgccaaatgggtaacattctcagatacttgagtgatttgaggacatcatgccaagtttcattactgcttgtttggtgatccttcctggggccctgatgatccatattcttaggctaagtgaccccaaggttacaaagtgactgaactgcctctggcccagatatgcggctggattacgggccttttcctaccctaggaaggcctctaaagaaaatggtaatgaagttgcctttcaggagtagttgtagatacagaatgaagcaaggagactcaaatattagtgggaaaaaaagacttggaagattaatattatacatttgttttttgcatgaaatgcagattgactgtgtgttcactgatttggtaaaatgtctcagttacatgcttttttgtgtgtgactgtttatgaattgtcagttctggggacagaaagtggttttcaaattactttaggctttattatcttttatttcttgtttctgttcttaatgtgcaagcacaagaaaaagcagaattatgtttcaacaccagctaaatgagatgaaatcagatattggctttaaaacattttaaaaggttaaaagttatataaaaataagttctgtataaatgtaatattacatataatgtaatgaaaaaaatgcaagctttttaataattgtgttatattggtatttatttgcactagcctttcatgacatttctgaaatgtaaattgataacatcattttcagatggaatccactttgaattgtctatttttcacacagttgattttatgttcttcattcatactcttcttttgcaatcctgaaaaaaatgtgtgcttaataaacactttaatgctgagaccagctcagtcagggagaccctaacccagcggcgctagaggaattaagatacacacacagaaatatagaggtgtgaagtgggaaatcaggggtctcccagccttcagagctgagggcccaaacagagatttacccacatatttattaacagcaagccagtcattagcattgtttctatagatatttgactaactaaaagtatcccttatgggaaatgaagggatgggccgaattaaaggaataggttgggctagttaactgcagcagggacacgctcttaaggcacagatcgcttatgctgttgtttgtggcttaaggatgcctttaagcagttttccgccctgggcgggccaggtgttccttgccctcattcccataaacccacaaccttccagtgctggtgttagggccattatgaacatgttacactgctgcagagatttttgtttatggccagttttggggccagtttatggccagattttgggggcttgctcccagcactttaaaccatgatgtagttccttagaattcatttggtctgctgagagaaattatcagacaatttggctatgagcatgtgtataagttttattacaacttcagatgcaaaagaaaacactctagtaggctaagttaaagaaccattctttgtaggaatattttatagggtaggaagatggttagatacttattgttagatggatacaaaagttttttaaaagtctggataaaggtcactagactcttgactaagaggcagctggccatgtggtagttgggccaccagtttctcaaatcaagacataattccattatagttcatcagaaagttgtttttaaaaagatcagaaatgcttatttcttccaacaaataagttaaaattgtaatctcaataatgttcccagatatgggaaaacacacctatttttttcaataattttagcacatttttgtatttatcatacagtgactattcagtcctcaaagaaactatattcatatattgccaatatttaaaaattcctaaaatagtatgtatatcttttaacatataccaaactgctagaaaataaatctaccagatgaagggaaacactgctgattttcttctcttttaaccaaaatcacacagtcacactttattatgtttgcaccctggctggtatttttttgagcaaaatgaaaatagttaaagcaatagaaatataataaaagaaaatatatagttcttatttggagtagttgaacttttcttgcagcagtggccaacttcttttctgtgatgcaaaattgaagcaaattttgaggttaagagcctgagtggggaaaattaatggaatttatagtttgacttaatctgtgtcatgaaatgtgagcatagattattctaggaaggattgtaacctactattttttttatatatttaagtaataaaatgagaaaatatacataagtttagatattgaaaagccattattgtctgtgaaaattttagaccatggattagagattgagaaatatcttctttgataatgccaaaaattaaaatgcaagttatagcactttaatggatggcatagagagaaccagttttaaaaccgatttaagaaaatgttttgaacattttaaaagtctcagttctgagtagcacaagtgtcagagaaatcttttaaggggaaattgcccctgtgaagagtcttgaagaagagcaagaatgagctgggccaaatgggaaggaggggagcggggtcaccatgaccaaaggagctgggttgtatataggaaggcttgtgggaagtgcattattaattgaacatcaaatgcttttatggtataccttaagaagaagctggaaggataagttgtagctaggaaaaggcctgttctttttgacgattgtgtaataagcccaaggggactagagaatgagtcccctgtcccaccaagcaaaggttgaatattcctggtctgaaatgcttaggaccagaaatgtttcagattttgcacatttttagattttgaaatatttgcattatataatgggatagcttaaggataggaccaaagtctaaacatgaaatgtcttcgtttcatctgctcctagtgaaggttattttatacaatattttaaaataattttgtgcgtggaacaaagttttgactgtgttttgactgatgcctgtcacatgaggtcaggtgtgaaattttccacatgtggcatttttattagcactcaagaagttttggattttggagcatttcagatttcagatttatggattaggcatgctcaacttcttttatatttgaataataatagcagtacgttactgagctcattgtctcagaaggtaattttggctgtgactcctgttttgctgagtgcagtgaagagtattaagagatgataagttggctgggcacggtggctcatgcctgtaatcccagcactttgggaggctgagatgggtggatcacgaggtcaggagatcgagaccatcctggctaacacagtgaaaccccgtttctactaaaaatacaaaaaaattagctgggcatggtggcgggcacctgtagtcccagctacttgggaggctgaggcaggagaatggcgtgaacctgggaggcggagcttgcagtgagccgagattgcaccactgcacttcggcctgggcgacagagcaagactgtgtctcaaaaaaaaaaaaagataagtttataagaaaagaaagaatagcctataattttcaaagattagtaggttaaaaattatcatttcaacatgacttttgcatgtaagttttccatatggtgtcagtataaattctctttcctgcttctctcaaactctttagttagttatacattcctcactactactatagattcaaatgccatgttgcagtagttaactctaatttattatgggcacaaaatggggactaaggccacccattagggctatgcacccattggagttttatttaaaaaaaaaatagacattttatagttaccaaaaagcttctaagagtacgtgaagggagcatattggcatttcaggtagatgacttgggaggcaacttagaggacgttttgaaggtggagagagaggtgtatgtgttcagacgacttgcacaaacatctggataatggaagaattgattcctacagtgttatgaataaaatagagaatgaagttttatgttaaaagagttggcttggaggagttactgggaagaaagggagaggaaggtgactgggacccttccaacttctgccctaccctgtacctgtcccctcattgtccgcaggtgacttagacttccctgccatcctgagcaaacagagggtaccatgtgcacactacctcctcccatgttctctggatctcagaaccctgcgactgccccagtctcccacgtttgcctctggctttgcctcttcctccgagctgagttgtcagctggaaaactagtggtctcttgggggttgcttctgtgtacaacctgccccttcctcctgcttgaaagttatagcatctctgggataagtctcttcttgagttgagatcatattttcatttattatcccccacgtgcctcatataatagagactcagtaaaggtctgatcaagctaaatgccaaatccccttcttatggatatcttattcctgagcaactgacatgctcaagcattctttatcctaaaacaaaactcctttcctgagtcctattcctccaacgcccctgtttctctttattcccaaatggactcagtgtagcttacctttgacttctctgctctctccctggtctccttcactcttacacttccaggccacctttctttactgttattttaatgaaaattgctctcactttgatcccttaagaacactttttttaaatacaaatatatttttggtttgctcatccattctactagactgggaattatttttcttttgtgttacctcctatttctcttctttgtagattcatgatttttatcctccaatgttcttatcccttgtttcccaaaaagacaactcaataaatcctctttctttattgtttgacttttataacatttaaagtgatgtttatggagggttaaaatcaagcatatggtttctttggattttttgctaaattagcctttttccaaaatcttcattttttcatattaaaaacatatttctgcatcttaattttaagcattttttagccttaaaaatagtttaaactgttcctagtaagtgaaaacatgctcttttaaatttcacttgactgaatgcattgttaattcttccagacttagtgaatttattatattttattcagtgttcaaacattatattagctctttgaaagttattaaagtttcttttcaaaaaatgaattaaagtgttacattgaatgaatagcagttacattacacatttaaggaagaaaagtgctgatgtatttaaaatcatttactgaagttacagctgtcccatttggctttaaaaagcacaatgctattatgtgaattgtaaatactaagatattgttctgaggggcaaaaaaaagctaagactgttagaggaaaattatagtcttctagtatggtaactggatttcctgtcgatttacatttatgaaacttcttactttgatatcaagaaattataagtagataacctaaacttccaaaataggatcacttttcagatttttcaagtagctgattgctacaatcagctgtctttaaggactcatcatgatctatgatattaaattttcctttacaaaaattactttttacgtgacatttaacttgtaaaacgtagtatttataattgaaatgctgatgagagtaatttaaagtatttcagaacactttctctacagataatttgtcttcaaattcttgccctagcttacaatgccctgtatgattgagaccttatctactgtgccagttgggttcagcagagttcaaaatgcaaaatattgggggttgcatgtatgaaagaggagaagggagaaggaggaaggactactgggtagtgagggccttacactgtgttgctgttcagaaaatatgttggcgaggccaatgaggagttccattgccaaaattgccctttggaggagtcattcattaagcaaaaatggttgggctctactcattaactgaagttgcttggggaaagcctgtcatagcttgaaggccatagtcaatcccaaagcatctgaagctagagctatcaccgaattcttgcttatcttttttattttctttacagtgtctttgaaagagaatacttttttatgtttataaagtccggtttgtcaattctctattcttttatgaatcatgattttggttttacatttaagaaatctttgcctaacacaaggtcacaacaattttttttcctacgagttttatagttttaagcattacatttagatttttaatttattttgagctaatttttataggcaaatttggggtcaaggttaatgtttttataaatggatttcatctttgtcatcatcttttttttttattatactttaagttctgggatacatgtgcagaatgtgcaggtttgttacataggtatacacgtgccatggtggtttgctgcacccatcaaaccatcatctacattaggtatttctcctaatgctatccctcctctggtcccccatcccccaacagaccctggtgtgtgatgttcccctccctgtgtccatgtgttctcattgctcaactcccacttatgagtgagaacatgcggtgtttggttttctgttcctgtgttagtttgatgagaatgatggtgtccagcttcatccatgtccctgcaaaggacatgaactcatccttttatatggctgcatggtattccatggtggatatgtgccacattttctttatccagtctaccattcatgggcgtttgggttggttccaagtcttttctattgtaaatggtgctgtgataaacatatgtgtgcacgtgtctttataggagaatgatttataatcctttgggtatacacccagtaatgggattgcggggtcaaatgatatttctggttctagatccttgaggaatcgccacattgtcttccacaatagttgaactaatttatacttccactaacagtgtaaaagcattcctatttctccacatccgctccagcatctgttgtttcctgactttttaataattgccactgtaactggcatgagatgttatctcatgtggttttgatttgcatttctctaatgaccagtgatggtgagctttttttcatatgtttcttagctgcataaatgtcttcttttgagaagtgtctattcatatcctttgcccatcttttggtggggtggtttttttcttgtaaatttgtttaagttctttgtagattctggatattagccctttgtcagatagatagattgcaaaaattttctcccattctgtaggttgcctatcactctgatgatagtttcttttgctatgcagaagctctttagtttaattagatcccgtttgtcaattttggcttttgttgccattacttttggtgttttagtcatggattctttgcccatgcctacgtcctgaatggtatggcctaggttttcttcttgtgtttttagagctcctgaaggaagcactaaatacggaaaggaaaaaccagtaccagccactgcaaaaacataccaaatagtaaaaccatcgacactataaagaaactgcatcaactaatgggcgaaataaccagctagcatcataatgacaggatcaaattcacaagtaacaatattaaccttaaatgtaaatgggctaaatgccccaattaaaagacatcatcatttcttagagactatctgtgttagtccgttttcatgctgctgataaagacataactgagactgggtaatttattaaaaaaagaaaaagaggtttaagggactcatagttccacatgggtggggaggcctcacaatcatggcagaaggcaaaaggtcttacatcacagttggcgagggagaatgagagccaagcgaaagagaaacgcccataaaaccattagatctcgtgagacttattgactactactaggagaacagtatgggggaaaccgccccatgattcatttatctccccctgggtccctcccacaacatgagatgagatttgggtggggacacagccataccatatcactatccttttgccattgaattgccttttcaccttttcttttcttttctttttttttttttgttatactttaagttttagggtacatgtgcacaatgtacaggttagttacatatgtatacatgtgccatgttggtgtgctgcacccattaactcatcatttagcattaggtatatctcctaatgctatacctcccccctccccccactccacaacaggccctggtgtgtgatgttccctttcctgtgtccatgtgttctcatttttcaattcccacctatgagtgagaacatgcagtgtttggttttttgtccttcagatagtttgctgagaatgatggtttccagctttatccatgtccctacaaaggacatgaactcatcattttttatggctgcatagtattccatggtgtatatatgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgagggatcgccacactgacttccacaatggttgaactagtttacagtcccaccaacagtgtaaaagtgttcctatttctgcacaacctctccagcacctgttgtttcctgactttttaatgatcgccattctaactggtgtgagatggtatctcattgtggttttgatttgcatttctctgatgtccagtgatgatgagcattttttcatgtgtcttttggctgcataaatgtcttcttttgaggagtgtctgttgatatgcttcacccactttttgatggggttgtttgtttttttcttgtaaatttgagttcattgtagattctggatattagccctttgtcagatgagtagattgcagaaattttctcccattctgtaggttgcctgtccactcagatggtagtttctttcgccttttcaccttttctaaaagtcaattgatcatacatgtaaggatctatttttagaatgtgttctgttgcatcaatttatatgtccatacctttgccaataccacactgtattgattattgtatctttataagaatcttgaaatcaagtaatgccttctaactttgttcttttttcaaaattggttttgggtatttgagtttctttgcttttctacataatttttaaaatcagcttttttatttctaagaaaaggaagaattctgctatgattcatcctgggattatagtcaatctatggatctatctggggagaactgacaccttaacattattaaaactcccagtccatgaacacaatatatctcttaatttgtttaggtcttttaaaatttctcatcagctttgaagttttcaacatacagatcttgtgtgtatttcctgaaaggtatacttaaatattttggctgctgttttaaatgatacttttaaaaaatttcgatttccaattgtttactgattctatatagaaatacaatagtttagttttgtgtgcatgtatgcatgtatgcgtgaattgaccttatatcctgtgaccttctaaatttaagtattatttccaatgtcattttttgtagattctttgagatttttctacattgacaactctgttatcttcaaatagttgcagttttatttctgttttttcattctatattcttttctttttcttgactattgcactggctaggacttccattatcatggtgaatagaagtggttaagtgcagtcatccttaccttgttcctgatattagagagacagcattcagtcttttgtctttaagtaagatgttagctgtagttttaactgagattcctttattgggtttaggaaatctcctattgcatgtttgaggagtcactagcctgaaatgatgttaaatatttttcagcggcatttatttgcatctattgcaatgatcacaatgatcacagtaaaaggaaatgtaaaaaatggtcccataaagatttcatggtcaagcttattttctttgccctaatatataagaaaccttatgatctcacccatgcctacatttctctaaccttgtcattcttcacatgcatcttcggctgttttggtaaaaggaattgcttacatttatctgaatatattatgttcatatctagcagtgatatttgtagtaaatgctgtactttgtcacccagatttctcctgaagcataaaagacctagtccccaacctgagagacctgctgggtgatagacctcagctgtaagccctccccaagagttaccttctgatggaaagtgccaccttaagtaggtcatgccaacttccctggaacgtcctatgtctaatgcagagagagaaagctcagcctccacaccccaaagagggacagtaacactccaggtgcaattctgaaggagaccagtccaacttcacaggtgcccatagggtgagtttacaccttgttaccactagttagactggttagccactgcagttaggtgactgcagtgacagttttcccatagatgaggggtttcccaggacatgagactttcagtgctaaaagtaggaaagtcctgggtaaagcagattgactttgtcacccaaaatttcaaagcctgactcttctctaaaatcctgctttgctcctttctaccacagttgctgatcctgggcacactccttgcttaacttcactcattctaatctctgccctggcacatgagtgcaaaaatagacatcagaaggacaaaagaagaagcaaggagaccatcaagggaggcaattgcattattcccacagagaaatttatgaaagtaacaggcctaggtcagtgacagcaaagatggaagacaggtagattcaagatccattttacagatcaagctaataagtcttattgatgaattgaattatggatcctggaagcctgttcagagttgaggttgaacagatgagcaaatggtggcatcatttactgaaatggggaatataatgatgattcactataccttcaattcaatttgggatgtgtgagtggagatttcaagtagacgtaaagttctagagctaaagagaggtctggattggtggtacagatttgagagacagtgacattcgggttataatttaaatcacaggagcaaataggaccctcagaagagagttcaagagtttcaagttctttcgagaatctgatgaaagctaaggaccttcttttaagaaaaaagcacactcttataaaaatgtctacattagtttcctagagtttgcatgacaatgatataaatgggatactttaaaacaacagaaatatattgttttgtgcttctggaggctagaagtttgaagtcaaggtgtttgcaggggcatgctccctctgaaacctgcaggggaggattctttcttgacttttcttggctccttgtggtggctgtcaatcctataccttggcttgcagctgcatcgctccaatctctgcctttgttgtcacatggcagtcttctctttttgtgtctgccctcttcttaaaaggacagcagtcacttaagactaggggaccaccctaacctactaagacttcatcttaactaatacatgagtgctcccccaacttttatatatatgatttcatcgtgaggtccgacaaaactttggagacacaactgaacccataagaatttttcaaaaatattttttacttttttgtaggttattggggtacaggtggtatttggttacatgactaaattctttagtggtgatttgtgagattttggtgcaccctgcacctatcacccaagcaatatacactgcaccgtatttgtagtcttttatccctcgccacctctcacctttccctccaaatccccaaagtccattgtatgcctttgcatcctcatagcttagctcccacacatcaatgagaacatacaatatttggttttccattcctgagttacttcatttagaataatagtctccaatttcttccagctcactgcaaatgccattaattcattccttttcatggctgtgtagtattccattatatatgtgtgtatacacacacacacacacacacacacacacacatatatatatatatcacagtttctttatccactcattgattgatgggcatttgtgttggttccacgatcattcaattgtgaattgtgctgctataaacatgcatgtgcgagtatctttttcatgtactggcctcttttcctctgggtaggtgcccagtaatgagattgctggatcaaatggtagtacttttagttctttaagtaatctccacactgttttacatagtgactgtactagtttacattcctaccagcagtgtagaagtgttccctgatgaccgcatccatgccaacatctactgtcttttgattttttgattatggccattctggtgggagtaaggtggtatcacattgtggttttgatttgcatttccctaattattggtgatgttgagcattttttcacatgttggttggccatttttgtatcttctttggagagttgtctattcatgtccttagggcacttttgatgggattattttattcttactgagttgtttgagtctgttgtagattttggatattcgttctttgtcagatgtatagattgtgaagattttctcccactctgtggtttgtctgtttactctgctgactgttcttttgctgtacaaaagctctttagtttaattaagtcgcaactatttatctttgtttttattgcatttgcttttgggttcctgataatgaaatccttgcctaagccaatgtctaggagggttttttcaatgttatcattgagaatttttatagtttcacgacttagatttaagcccttaatccatcttgagttgatttttgtataaggtgagaaatgaggatccagtttcatgtggctagccaattatcccagcaccatttgttgaaaagaatgtcctttccccactttatgtttttgtttgctttgtcaaagatcagttggctgtatgtattgggtttatttctgggttctctattctgttccattggtctatgtgcctatttttataccagtatcacactgttttggtgacaatggccttatagtatagtttgaaatcaggtggtgtgatgcctccaggtttgttctttcagcttagtcttgctttggctatgcaggctctttttggttccatatgaattttagattttttttttctaattctgggaagaatgatggtggtattttgatgggaattgcattgaatttgtagattgcttttggcagtatggtcattttcacaatattgattgtgcccatccatgagcatggtatgtgtttccatttgtttgtgtcatctatttctttcagcagtgttttgtaattttccttgtagaggtctttcacctccttggttaggtgtattcctaagtattttttttttgtagctattgtaaaaggggtttagttcctgatttgattctctgcttggtcgctgttggtgtatagaagagctactgatttgtgtacattaatcttgtatccagaaattttgctgaattgtttttatcagttctaggagcttgctggaggagtctttagggttttcaaggtaaacaatcatatcgtcagcaatgagtgacagtatgacttcctctttactgatttggatgctctttatttctttctcttgtctggttgctctggctaagacttccagcactatgttgaagaggagtgatgagagtgggcatccttgttttgtttcagttctcagaggaaatgctttcaacttttccccattcagtattatgttggctgtgggtttgtcatagaaaacccataacacttttataccattttaaggattcaaaaatttttcatgtccaacttccagagacataatgctggactcaccaacgtttgaaagatgggtgcaggaagagttaatataaaaagaatgagaagatacaagaagagcaggagcatatatctccttactaggaagccaaaagaaaagagagttcaaagatcaaccccgaggccatggaagaaaagcactgaaaataatcccctgaaaatcaaatgtatgtgttaggttgaccacaggtagctccacacattgctgctgatgatactagcaatacatgttaacattcttggcctttctagatgtcagacactattctaagtactcttaatttgctgaattatttaatcctcacatcaactctgttattattcccattttgtaatgagaaaactagagagttaaaatagcctttttacagtggcatacctagctggcaaaagagcatctcaaaccttacgatgttcaaatcataactttttcccctgtcctaatgtgtacctcctcatgattccccatttcagtcattaaataaacctgccaatcattggcattttgtttctttttttttataggagatattcttttttttattgcctgtttttttaattattattatactttaagttttaggatacatgtgcccaacgtgcaggtttgttacatatgtatacatgtgccatgttggtgtgctgcacccattaactcgtcatttagcattaggtatatcccctaattctatcccttccccctaccacaacctcacaacagtccctggtgtgtgatgtgaggtcatctcttcatttcacttcatgcattaaatgaactcatttttctgataacacaaaccagaaagtgcagaataatgtatttctctctcacttttttttttttttttttttttttttgccattttctgagttaaatcagtgactaaatgtggtcagtctcttgcttaaaatctgtcagtggttctgccttgccatagaataagtagcctgggatcaggctctcgtatttccagtctcactctcaaagcattcctagagggctgcacttccactcctctggcagcactctaaccacattgaaccatgtgttgtatctcaccctttccctgtgctctgtctgtgttgggttttcctcttggcaccaggagacctctcttaatatttcggagcccaactcacaggcaccttctcttatgagatgttcaatggggtcttgcgccaagggcaaaacctagatcgagaacacgagagttgtgccttcaatgtgcatttgattttgtccaagtcagaggatgtaaaaaaggcaggagacaaataaacaggtaacttgactaaaggacagaatattaatgacaggctggtgctgacaacaaattgttgttgagctttaaagaagggagacaaaccattggctggaagtctactccttccaattatattgcaccatcgatgtaaataaccccctctcccaaaaggagagctttatgatgacatgtgatgaagaattttatgctgttctgctaaaatcacatttaccatttcgcatattgggcttcaatttttaatttactcgttttaataagcctcattacttccaaggttatttatacagtgtttaactcctactgggtgtttctttttctgagtcttttttagcttttaagtaatggctgtgattatataattaaagcaaactacagcagattacattaagaagttcactttttttggaagaaggaagtttgctctttgttcactttcatattattcatttttcataatttaatattaccaaagatagtgcataaatattataattagcatatttgttgtttttcttgaatggatattgtgatttacctttgtttttgttttttgtttttttgagacggagtttcgctcttttacccaggctgcagtgcagtgttgtgatcgtggctcactgcagactctgcattccggtttcaagtgattctcctacctcagcctcctgagtagctgggattacaggcgcccgccaccatgcccggcttatttttttttgtatttttagtagagacggggtttcaccatgttggccagtctggtctcgaactgctgaccttgtgatccactcacctcggcctcccaaagtgctgggattacaggtgtgagccaccaagcccggcctgtgatttacctttaaaagactgttaatgatcttcaggtagcactgacaactcctaaaccctgaaatcttgaattttagatcctttattgcttatggtttctcttaggcaaattatgcaaagtttttttctgttgtttttattttaggttttgtttacagttttgctgcaaagtctgtatcatatacttcaggatccaaaatgcaattatatatatatatatatatatatatatggatgtatgtgtatcatattaagtaaactcaagcaaagcactaatagcacacacacacacacacacacacacatacacacaaaagtattgctttatccctatctactgtttctcctccatattctttttctttttttttttttttaattgagacggagtctcactctgtcacccaggctggagtgtagtggtatgatctcggttcactgcaacccctgcctcccaggttcaagcgattttcctgcctcagcctcctgagtagctgggattacaggcatgcgccaccacgcccagctaattttgtatttttagtagagatggggtttctccatgttggtcaggctagtcttgaactcccgacctcaggtgatccgcctgccttggcctcccaaagtgctgggattacaggcacgagccaccatgcccagccttctccattttcagaactgtagagaactccttcctctgtgcgccattacttcctgtgtgtactgctgttatatgacatacacactttcttataacttatgggcttacttctgtctcttctactctttgatacaattttagaatctagaaaattacttgcatttttgtatgtcctttgtacaatacttggggatgataggcacttgcagaatgaatgaatgaatgcctagagtttgttctatgtgtgagtctctcaggtacttgaatgtttgtatgtgtgttaagaatataagactataagaaattcaaatggtggataaaacatttccaaaattaaaataaaagtcaacagaggctagaagggtagtggggagggggagattaagaagaaatggctaatgggtacaaaaatacagttagatagaaggaataagatctagtgttttgtagcacaatagggcaactatagttaacaataattgattgtacatattgtatatttcataataactgaaagagtggaattagaatgttcctaacacaaggaaatgataccacaattaccctgatttgatcattacatattctatgcttgtatcaaaatatcacatgtaccctataaatatatacaactattatatattcataataattaaaaataaaaataaaatgacaatgaaaacaaaacaacaaaaacaagcaatctcatgtaactgtaaggaaaatcttagttcatcgtctagttggtttatttaccactcacatatttgtctgtatatgactgtaaatcctcagataaatatatgtaatatgtgattttaaaaaataagccatatgatgccacatatcaaaaaatgtttaaagtgccacactgtttctaggattatctataacttacagtaatgaaggctatatggttaatcaatggccgttttattgtattctttcttgcatatgtattaattgcccttgttagtgcatcttctattaattctctggaaaatttggctcatacgttattgcatacgtttttgtttttctttttcttagcacctgtggaagttttatcccaattctctagtagcactcaaagcaaggtttactttcaaaagtggaagttcagttgccaagaaacactatgacaatagcaagtactaaaacagatggaagctgtagatttccaagttggctgaaatccttatcttcggaatgtctttcgatttactcataaagattgaagaaatggggaatcttccaatcctagcttccctggagtcaaagtgacatgtttacttctaacttaatgtgtatgcatatatgcactcaacaaattatagcaagtgttcacataattttattgaaaagggaaggaaggaaaaaggaaggaaaagtttgaaattcaccatgtttattttgaaacatgtctgaaagccagtttactggtctttcatcttcaataaatctcatgttcctcagaatgaaatgacttatgcttggaaatattgatgcttagctgcagatctgaaatttggacataggacccctaatttcacattcaatatttacctcatctttcttttcccgttaactgaaatactacatgagaaagggttgttccaaaatgcaattctgtagaaaatttttaatggttgttgtcttttatgtatttcctggaatgcttggttcctttttaatcaatatgtttatacattcatcaagttttcatactactaatataacataaacaaaataaatctcctaataatggcacaaaaattggtaactaaacattttgtagatatctaaatcttttctttagcttgtcacaatgaaaacaaaacaaaacaaatttaggataaaccattaattcccctgcaagataaagataattccttcaataattcattcatttatctattgtgctttaattgtttttattttattttttttagatgaagccttgctctgtcacccaagctggagtgtagtggtgtgatcatagctcactgcagcctaaaacttctaggatcaagtgatcctcttgtctcagcctcccaagtagctgggactacagctgtgcatcaccatttctggctagttttttaatttcatgtagagacatggtctagctatgttgcccagattggtcttgaacttctggcctcaagcagtcctattgccttggcctttcaaagctttaggattacaggcatgagctacagcatcggcctaattgtttttagatgctaaacgcactaccaaaaactgagaagaaaatgaaagttattttgaatgcataaaattagttggacgctagatatataaaaattaaagaataaaaacaagtataagatgcaatttttactgcatgtcaaatatttggcaagagaggaatacatgtaactttccttgaaaaaatgaattataaatttagtttttgaaataacagatatgattggcaggtagaaaatcaaggtgtacatcccatatagaacatatggaacaagaacctggttggaatgtttcttaactggtgtttattctgtacctactacactacattagagagtagcttgaattgatgtttgatcgactgaagcctagagctctatttcactcttgtacatagtttataaacataaaacttaagaaaagtatagcaatggttaacaaaatccttgaagtagaatgatgtattttacttttttcactaatcatttcagttatactttattcactttattccacataaaagaatacaatgtttttgctattataattgctaagatgttacacttcaaaacaaattatctgcctagccttcggtagctttatttcagaaagttgtactaatactaatgagaattcttttgtcagttacttgggtgttgatatttgattccaacggtttttttttttaatttttggttagtgattaattaaaagaaaatcgatgtttaaggaactaatactatattttactatttctctacatgtaaaaaatttcagagccttttgtttctcagaaagttactgtgaatgagctcattacattttgtgctgccaagttagtccagtggacaatttttattcacttaaatatgcctaagaaagtactttatttctgtaaacaaatatgaatatttatgcttagtataaaaatcttatagcactgtgtcaacatcctattctcttcatctcctttatcaaatgtaatttatgttaaatattgtgaaggatacaggaagcatcctccacaccttctcctttgcctctgatttctagtctgcaccaagtctggctcattttgcctccggaatatccctcaaatcattctgcctttttctaccctcagcacctccaattccaaatccctattgctctcttgaccattacagtggtctcttcatatggctattctcatcctccctggccgctagtggccttttctctacactgtaaccaaagggctcttcaagacacacaccttatatctggcctgcagatttaaaacacattaggaatctctctgtacgcttaaagacaaaactcctgagcatagcctataaggccatatatgatctgcctgctctccctcccttcagacacatttcataccccacttgcctaccaccatccccattcagatcaatgatcatacaggtcttccatcccctgaacttgacaggctcttttctgatgtatgctggtcttttgccagatacaatttttttctcttcatcttttagatgtcagtaaaatgtcctttccacagggaagagttccttatcaactttacctgggtcagatgctcccatcatagcatcataacagagcgacgacttttgtctctgttgcaacttttcattagttttatttgctttctggcttctctgcctgtcttccctagtagatggtaagacccagaagacctaagccatatctgcctttacttattatttcattacccaggtataggttataagtggaaagattgtaggatatttgtgaatatctattaagtctgtgaatgataaaaaggctttagattttaaaatctcatgattacaaactgtttaagagacagaaccataatcgtgcatggtattgcgtgctgctagtcccagctacttgggtgactgaggtgggagaatcgcttgagcctgggaggcggaggttgcagtgagctgagatcgcatcactgcactgcagcctgggtcacagagtgagaccccatctcaaaaaaaagaaagaaaaagaaaaggacaaagacaaccaacccatcacatggactacatgtatggcatacctcttaaaccttcagaaaaatagagatagaaacttaaaaattcgtagattctgtggtcaaactctattctgtatacttaaatataaccctgaagaattttatcatttacctacaaatttgtcatctcttcattattatagtaatactgaaatgcagctatatatattggtaatagaaaatgacgttaaaaaataaaggttttttttgtcattttccaatctccttccttaccccacctcacaaatatcaccaattgctctgggtagataaaaaccttactacttggttttatgtttagtcttacttggagagattgaagaagtgtgtttaccgctgaggactgaatataaagactttccaggaagccaaaacagtgctaaatgcaaggacctctgtctgtttagggggaaaaaaaataaaaggcagaaatcacactcaaaagagggaaaggaaatgagatgagatcttgaaaagcatgtagggagaaatgaaaacaagcacagcccagactttatctttttagcagtctaccgtgcttcaacttttgaacatctgagagcccaaataatggtgagtatatcagatctcccctggagtccagttttgatggtgataaaagttgttttcacaacgtgctgctgccagatacagtttctctgaatcacccagaggctaaacaccatcttccttccttctttttttcattttattttgtggttatcatgcctgaagcatgggtcaccatattggaagtaacttttagtagttgtacaagccaataaatgaatgtatccgtgggctgtgttggggtcatagggtgtttttcaagagcatcacgatcaatcttaggatgagacatcagtttgagaacagttagaaccacgtcttgtatttcccagttgtctttccaggagcactgccccagtgcttatgagtctgaaaactactcagtattattatttcccttactttctcaaaatttagtcaagtttggtcaaacagctgacattgctttttcaacttatgtaaaagtaaaaatcaatctaaatgatcttacacaagatattttttaaatgtagaatattctagaggggcaagtgagatcgaacccaaagatcctacattgtatagctgccatggatgcctaaaaatcaatatgatgcactgagatgctttgtgatacagatataccttctaaatcatcaaaaaagttcccctttttttggtatggttttaatatcaaatataatttgttttcaaattcctcaacatttgttaattcttgtgttttgtttttatactttttattaaatatattttagtgccaggcatagtagttcacacctgtaatcccagcacttagggaagctgaggtggaggattgcttgaggacaagggttcagcacaaaccttggcaacatagcgagaccccatatctgcaaaaaattaaaaattagctgggcatggtggaatgcatctgtagtcctatctacttaggaggctgagatgggaagaacgcttgagcccaggagttcaaggctgccggaagctaggattgtgccactgcactccgaccagggtgacagagggagatcctggctccataggattgttgttgatggcataagagagacagagagaaagatagaatggaacatagtgcagtggaaggaggcagtcaatgaatgccattacaggactttaaagtgatgatgctgtcgattttcagattactctgccatgttgaaaattggttggagtagaaatggtggtgcaccagttgggatttttaaaataggtgagataagcgatggttcaaaatagtgacagtgatgattaaataaagtgtggtgtatataaaatatggaggttgcgaggggaaaaaaaaatgaaagatgaattcgaattatctggtttgagcatctaaaggggatagtgttgccattactaaaagggggaagacaaggtgtggaacaggtttgagcagccggggagaggagggaatgcagatttcagtttgagattaagaaggcctatgacactaaaatggaaatatacaaaataatgggaaatacaaatttggaattcagaggcaaggtaagaactggagatctaaatttaggaaatatcatatagatgatatttaaagtcatagatggctaagttgatctaggaaagagaatgtagagagagaaaaaagtgaagaagcttgggaccaagccctgaggatcagaagcatttaggagaagatacaaatactccatttccaattaccttggataaatgaggattgctctatcataatgtactgctgtaaatatcaatgtatcattatacaacatagtaatgctgtatcttatatgatattataatacgttgtgatggaagaactgcaagtgccatcacctctttttgcattgttttgtttgggtctcatagactcacttttgtaaatacgaaaagaagtaccttacaaaatatatcctacacaaaaagtggcgtatatgttagcaagtaaaaataattagatgttagatattctagcctatgcattactctgcatatttgtagtagtcaatgtaaaataaaaagaaaaaaaacagtaattagttgaatcattcagattttataaatgaccatctacatgacatatttcttctttcataagtactattttgagaaacagtgttggaaactaaggggcatttcatgcccataacaaaattcgataacagtcagatgaaattatcaggatgcaaaaagagaaaggatgtactgggtcaaagacaagttatgtggctggagggtaaatgttgtttcttataacttagctctccctatagttccacaattttagtaattggagtagagggcagttatagggatctaaggtaaatgcaatttggcctcaaccaaattaaccaagtacgcatggcctcctggagcaactgcagccactatcatcttcatatctgcatgtcttctgggatctagcaaggaatggagctaacagtgttacaagtcgtaatgccaaagaacagaaaaatgtatgtatgtttgcatctggacacatgcttctatgagaagtttattagataaatgccaatttcttccattaccttcaacttccttcatttcaacaagggctctgtgtgtaggcttctttctgagttcacaagtgtaatcacctccaaacacaatcatcaaggaaagagaatagtggcttattgggacaacttttcatttgggcttaaagagtggtataattcaatgaaagaagataatcggatcacatccggactcaggaagagaaagagagtcattaaactggcttcggagacactggccactttattaacaacaaccaggcttatggcataaatccacatggcatttttcaaggaaattatatttttcaagcaattacctacgtaacaattagactgtaatttttttttgttttgttttttgaggcaaagtcccactctgtcacccaggctggagtgcagtggcatgatctcggctcgctgcaacctccgcctcccaggttcaagtgattcttatgccgcagcctcccgagtagctaggattacaggcgcccgccaccacgcccaactaatttttttatttttagtagaaacagagttttaccacattggccaggctgtctcaaactcctgacctcaggtgatccacccgcctcagcctcccaaagtgctgggattacaggagtgagccactgtgcccggccagattgtaatttttaaaaggcaaataattagaatattttgataagcataagctgaaagttgagcaaaaagtagttggcttgcagacggaaaatccacaaggcgtcatccagaatattagcaagacttaagggagcagggagtcacttatttgatgcaaactgaagaacctcttgttcaaggagcagtgagcctgcatatgggtgatgaccaaggagcatgacacatggaatgcttcatcatctacctgaagagacagctgcagccagaaattgactttacagccagcatttacatagagacttctactgtaaatagaagcaactctgtagatgcccctgaaaggaatatgtatcattatatgccattgggcacaaatatatggttttttttaaaagtcttatgtgtcaacaatacttaacagaggcaaaggaatatgaaaagaaaaaggatttggaatgagtgatttttattatcacactgtcaggtagtcacatgggatgaattgcctggtaaataccaacaaagtttccacaatggagttatgtcaaagcaagttggtattacttcattgttttattttctgaaaaccaaattgtttttataatttttgtctggtccacctgaaacatcatgttcttgagtcttaaagaaactgtctcttatgcattcttttctttgttgatcttttccttaataattgccttttagttatattatcttaaatatattgcgaaatagagtataagcaataacttacatatgaggttaaaggaaagcaatgagaaagtagtaacctgcatcagttctttttgttaaagatctttgcatttgataatttttcccttcaagttgttaatattaaaataacctgaaggtcctttatttttggtttctcatttctatatagaaggcaacactttcaacagattgcctaatgtcatatttgccaataaacctaaaatgcatcattttgagacatatccattatgattattatgacattttatttttgtccatttataagctagagcagcgcaaaataacgcaaatacaactaaaaatgaggaccccgtctgtcatactcagtgcctggcagaaaattaccttcactgtaaaatgaatgtagataatttacttttactatacagagtgatgtcttaaaggagaatgtgagtttagcaggaaagaaagaatactggaaaaacttacattaaagatcagttgcaaagtaatggcattgcctttcagacagccagtaaagcaaaaaggaggaaaatcctaggaatagagtttctgctcttggactaagtgtttactgaaggaaatgcaagagtctgctgaattgaaacactgagagaagaatatgagaattatctgccacatattagctctggttttcaatgcatgcttcttcaactaacaacatcagcatcacctgagaacctgttagaaatgcaaattctcggccccattccagacccattgaaacagaaaatctgtgttttcacaggccctccaggtgattctgatgcactcttaagattgagaaccactggtctgaattgggatagttgtttgaattgcccaggtaaactgcccacattgattagattgactgaagaactgtcagaaacctcaatcttagttgagtctttccttggtggacttattgatgtgtttaagtgaaatgttttcaaacctaccccactcttatgagttatttaagaggggtcagtgtctacttgaagaatgagaacagttgagatctgaccacttgaaaaggaacatgttatccttagttcaagtagttgaatctcatgttttgatgatcagagatagctctgtaggaggaatacagaaggaaattgcttattccttatgtaaaaaccttcccctaggccaggcgcggttggctcatgcctgtaatcccagcactttgggaggccgaggtgggcggatcataaggtcaggagttggagaccagcctggctaatatggtgaaaccccgtctcaactaaaactacacacacacacacacacacacacacacacacacacacacacacacacacacacagacacaaagccgggcgagatggcgggcgcctgtagtcccagctactccagaggttgaggcaggagaatcgcttgatctcgggagacagaggtttcagtgagctgagatcgcgccattgcactccaggctgggtgacagagcgagactccatctcaaataaaataattaaaaaaaagaaaaccttcccctataaagtgtcttttattcacctgcttactcatgtctgtttttaaaaaagaggagtgcgtattcctcgtagggagatttctttttctttcttatttatttatttatttatttatttatttatttatttatttttgagacggagtctcgctctgtcgcccaggctggagtgcagtggcgcaatctcggctcactgcaagctccgcctcccgggttcacgccgttgtcctgcctcagcctcccgagtagctgggactacaggcgcctgccaccacgcccggctaagtttttttctatttttagtagagatggggtttcaaacatggcccaaatacatgttaaggtataagggaccttattccatttaatgatatcaagttttgattgactaggtctcagtgctgctagaagctgaccctgggaaaaggaattcaggacaagtttatttaggagacgatgcggacctggagactgagagagacgagggcagggagccagcacagcttctgtatgtacctgggaacctctggggtgcaatacgaaacatgtctcaagttatcctacaagagtacataagggagatagagtatttattcagtttattatcaactcctgtcattggtgacaggctggcagaggatgtagagtgcatttgtcttctgcttccactttggacttcagagagacagccatgggcaaagagtcctggcactgacttggaagtgggcaggcaggtcaaagggaagttctggggaggatgggccacgcatggcagcatctgctccgcagtgggagacggtagaatgtaggtaggtgctagggaatcataggccagtggatgcctaaaaggagaagtggagtgggctaaaaaaaatttcaaaaacaaaacaagaatcctaggactctctaagggaaacttggtctacttcacagtgttgcccaggtatgatcctggcactcgtcatccacgagcaattatttaatgttcacctgcacttgacattgtgatccaccccaggaagataatgaaagcaatatggcttctcgcctgaggtgtctgacaagctggtctagcagcaggaaggagaaagctggagctcccggcatccgttcaaaatgacaaatggaggctgtaaaaagaatgggcctggtgtttatggaggctacaaattaaatgcaacctgcccaggttcaatccgatgcccgtttctattagcatatactgacacttctcagagatttaccctgtgagtctccaaagatattttattattcagtgcctgccagaaaactaagcttggtgtaatgtaggacgtgtatattatgaaatattaaaattattaattcatgataattgaaaaaggtgctagtggtagctggcttctctaaatacatttaattacaaatatgacattgccattcttgtccccacccctcttttttcctcttctcaatgcataattttgaaaaccataaattactgtcattttgatcaatacaaacttcggccaaattactatagtttgcttaatcattttattttagaaaaaaattctgttttctcattataaatttacaagtttctaccagtagattaagatttttttttacattaactgttaaattttggttttactccatagactaaaaaatattaaaataaatttggaaataaggaaattaagaaaatctttttctcctcgaggtttgtatggtagagttattttaaatctgtttttcaaattttcttttcttatgctaactccagcgtaatcatatttacaatattttcactctaaagccttgcgtgattcagccccttaactataacagcccagaattccttttcaaatactttttttttaatgttcttagataaacaaggtgcttttgtctgtgttgcttcacatagcttaagaatcattgactccttcccacaattttgccttaatacaatttaactccaaaatcatatcaggaaatatgataactcatttgggtagtgctctagcttttcttttataaagattgttgcgaggtaattggtaattcagctatttcctcatgcctcatttccaattcccgctgtcatttttgtagatggattcttttgttctcggtgtttattcactgagagtacacattttttttttaaatcgttaccaaagtaatttcaatcttctacccttcaattaaaaaaaaaagtttgaattccaatatttatttgtatttcctgcttagttattttggcctctaaatcgttacaaataatccagtaaatttcaagcagatgatgaataatttctgcattttgttgggttttttatttgttacatgaacatttccagttttctttaataaccttctcaggcatatgaaaccacattgtagttcactttgtctttaaagcatttttctctcaagtatttggctctaagataaagtgcctgcagtcattttcctgttaagtttttcagttttcagtcccatactcattccctgtgtgagatacccccaacttcaatctcatctatcacacttggcacagttctgaaatggactgaacggcctgtgtcgcctatggccatgttccatgtgctacaaactgtgaaaggaaaccctcctccactacctagaggaatttgaaagtgttccatagctattacctgaaacaatacgtgattaatttcctatggtgaatattctgacttggattgtggcctctctgattttataaagcatttactaatcctgtgctctggattttcgggcagatttgttgaattaacagaattgcctatactttttccttaacttccacctgaggatgctaatttcttggggcaattaaattacaaatatgctttctcccataaatattatgccatttacattgatatggcctgttttttgtctttcctagcctttaataacttgacagttttctggtgtgcagtttctggccattatctttatatggatagttcagtcattggttgtctcatgctttgttttgctgcaagagaccttgagagagactgagtgtcagccctttgtcttcatgtgcatccaaacaaaagcaggcctgtttgtgatttcatttcagccttgagtcacagtgcatgcattcctgaatcaatgaatattaaatggatgagcatttgttgatggcttcctgtgtgtttgcacaaggcttcgcagtggttattcaagagtgccagtaccagatgtgactctgtcaacagtatatccagacagttctccttcgaccattgtgtttttactattctcgtaaattttaaaccttatttgttttccattgctactgattacagttacccctttttacttgttttgttcttagaaaatgaaactgatttaaatattagccaacagtaaagctttaggaaaggtaaatttgtaaacatagtgatatacgtataaattaggaggctcaccaaatacaaacagaaagaatgtaaggcatgtgattacctggactgtcttctggcatttgattttgagaatttcctcaaaagctcaatattccaattcgttggggtttctaaacctgagtttggaatccaattctgtggatcacaagataatttttactgtggctgaaaaacggagttatatcagaaaggtaggctagccctaggcaaaatagtgaagcagtaaaactttgtctttccagggccattgcacttctgtctgcttgtctttaggagttagcctaagaactcaatgccttttttttctttcccttcactacacaggaattcctgcctttgtcagacttcttgcctagtcaaaagtaatgctttcagcatccttctctcttttccttgatagtgaaatttagtgaaaattgtcagttaggaactagtcctagtaatcattaccctttctagataacacactcttcagacattaacctggaggattgaaatcatcctagaaggctggtgaggaaaatcctgccacttagtaaaactcgatttcttgctcctcatggcatgccacacaaaaagccaatgtactcatactggtacatcactatatcatcatgttattgccaaataggaaccagtaaaacaagacaaacagatattcttggaagagctctctttctctttcttaacctctaccatagagcagtcttgccatgaagaatcctttggtttcatttttgccatatatgcatccattcataaatagtacatattattatttgaaacttctttaatattttcattagtaatattatattgaatgtatcgtttaccatttgcactttttctaaactagttcattttctaaactagctgcatttttctaaactagttcattctttataaattccttgttccattggacacataaattaactattttcttactgttggaattttgagatgtttccaagttttgcttgaaacacacaattgcactaaacaatttctgctgcacatttccttgtggagaagtatgagagtgtcttgtaggaatttatttagaagtagaattgttaaataatatagcttatcaataagtgtaagttctaagagttaacctgaaacttgctttcctgggacagtgacactaatttgtttttagatctttgcctttttttttcttataggctgactaaaagtataattgatgagttctagagtatctaacatttatctttagtagttgtattctctagtagtggatattgtattgtattatccagtagtagatattctctgaagtagttgtaaccatgtacactcctcccagtaggatatgagatttcgttttcaatgttcttgatgaattttattagagttagaaagttcccaattttatgggtgcaaaattatatcttgctgttactttaattattatttcttcagttggtatgcttttcatatctttattagtcatttgggtttgctattttctttgtctcctttttcattgggttgattgtcatcttaaagcatgattcttacattttcatattcaaactttgtattttatgtactattttttgcaaatatacccccagtgcatgactaatattttcattttgcttatgcctattgttgtataaatttttcttaaaaatacaattagttgcattgatctttattgtatatgtgtcctatttaagaaatttttttctaacccaatatcataaatatatctctaaatattttgctaaatgtttaaaaatgttgcttttacatttaagtctttatctttgactttttactctttgaattaaagtctagttttattaattttcctattcttagtcaatatttagcactgtttattaaacagtccatccacccctatttgtcatatgtcacatttgcatatatgtaagttgagctgtttgcaggctatctactctataggtcaatttctatatgtataccactttgatttagttaccatagcttattaataaatattgatatctatcagggcaatgctttattacccctttttaaaaattcttcacaatcctcttggcttattatttattggccctcttttcctcaatcaaaacttgagtatcatcacctaaagagctttttagtattcgccttaaaatctgaacagaataacattaaacatttcatttttaagttgtttatttaaaacttttgtatactgagtccatataaatctgttttctcattaaagcaggattctaatacaattttatattttaaatagcaatgaaatgtgcatgtagaatcagtcagctaatataggcaggaaaatgacccaacattttagtcatcgttgagtcttcttttagaagtgactactagagtgacatatgagagtaagctactgaatgttgatattcccctagcttggcttgttcattgggcaattgagattctaatagctttcaggcaatacctccctgaatatctgcctacttatgctgcagagctgacagatgtcttctgtgtgtccttgagagagtgaggccattagatgtgaagcctaaaggatccttgccactttctgtgctgcagaatggcctctctttgtttttttttttttttttttttttttttttttttttttgagacagagtgttgctgtgcccggattcaagcaattctcctgcctcagcctcccaagtagctgggactacaggcatgtgccaccatacccagctaatttttgtatttttagtagagacagggtttcaccatgttggccaggatggtctcaatctcttgacctcgtgatccacctgcctcggcatcccaaagtgtcagaattacaggtgtgagccactgagcccagccctttctttgtttttgactctcttctttcatctctgacttgcacacctcagttttcactgctcactgccctagcaccatttctagttgctgcaattgctgatctctagttttcttgtttctttggcctcctgccacttctgtctcacttctcagccttgtatggaagggatgacttttcacagacaactcctgccaattgggtttaatctttggagcttcagatcctcttggcaatatgtctctcttcctcaccacacagggaggctgctttttttgctccttaaattgattgcattttaaccttgactatgtttagttcagcagtcattagagacgcttgatgttctggaaagctggtccctagatgactaaacttttactttgagtgtgaattttaatagcattttctcaaagtcttgtggaacatctcagtggctgaattatttttcagtgctctaacaaccaaggataagacgcagagtacactttcaaatgttttatttagatgaatcatttcacagaagtgaggtgcatgcatttcctctgtattagttttctagggcttccataacaaagtatcacaaaccacatggcttaaaacaacagaaatttactttttaacagctctggaggctagaagtccaaaatcaagatgttggcaaggccacacttcctttgaaacatgtagggaataatccctccttgcttcttcctagctcctggtggtttgctgttcatctttggtgtgccttgacttatagcttcagtcctttcatctctgactctgttgtcatatgtgatctccccttgtattctgtatctggtctcttctttttttctttttctttctttatgtactgttagaatctcactctgtcactcaggctggagagcagtggcatgatcatggcttactgcagcctcaaccttctgggctctaatgatcctcccgcctcagcctcctgtcttctcttcttgtaaggacaccagtcatattggatcagggaacacctaattcaacatgacctcatcataactcaattatatctacaaagacccctgtttccaagtaaggacgaattcgtaagtattggaagttaggattttgacatatattttagggagatacaattaaacccatttgaatctgtgtgagtcagggttatctagagggacagaactaatggaatatatatgtatgtgcaggagtttattaagtattaactcatgtgatcacaaggtcccacaataggccatctgcaggcagaggaccaaggagagtcagtctgagttccaaaactgaagaacttgaaatctaatgtttgagggcaggaagcgtctagcacgagagaaagatgaaggctgggaggctaggccagtgtcttctttccacatttttctgcctgtttatgttctagctgtgctggcagctgattagattgtgaggacctagattaaggatgagtctgcctttcccagtcctaactcaaatgttaatctcctttggcatcaccctcacagacacacctaggatcaatactttgtatccttcaatccaatcaagtcaacactcagtattaaccatcacagaacccaacccattgaataataccatgtgccaatgatctctcaaatgagcatggcagaggtgtatattgaagatgcaatcgttgattttttttttcaggtacatatgtggagaggtgtcagcgaaaacttttttttctcttctcctataccaattgttatctttttactccctagctcctcaaaacatactctcaatttgtaatttattgttagaaagtagaaagtgtgtttttttttaaaaaaaatcaacagttggaaatgtttttcaacatttagcctatgggaaaataatacttttagcctatgggaaaataacacaactccaaaagatctataatttcattgttcaggcttttgtaatttccaaacatggcttattttatttttagaaaattacccagtttaaacaaaagagactaatattatgcaaggtgattttctacaatatttctgattaagactgattatgaatatttattataataatcctgggccaagtcctctacactgattggtctttctttgctgtccagaacagtgataaaaatgagattgattccatttaatagaattatactatactcagtaaatggattactacttttaaaagattggaaaataataaagtgaaccaaatattaaaattatactcattgagctcagtttagtctttcattgaggatttaatgaaagttgagggtttaatgaaaggatttaaagtgtattatttggaataactagaattgtataggctagctttctacacctcaaagaagaacaaaagcagtttagatcagaggaaagtatgctggccatggaaggaagaatgtaggagggtggagggtaaagaaagaagatgacaggtttagaagaagaaaggaatgttgtgttttcgaaaaatacagaaggggtttccatgctagaatggaatatatgccaaaacaataggaggctatatctgaataaaagagtgataattggtagagttatttcagactaattattagaggttttgatctaacataagaacatactctgattagacattattataggtattgattctcatgatttgactaatttgacagctttaactcctgaacataagatgaatagaaagtaggagatgaaacaagaaactggggaacttacactaagcactcttgtaagatcttgggtgttatattaaaagtgttgattatgatagtggctttggaaaggtagaggactgtgtagttattgaaaatactgatgagattgaattagtagtactttacatgaattccgtgtagatgaaaacagtgccacatgatattatgtataagataaatgatagagactccaagccataaaaacactattagtcatctttattagaaaatactactacaactgttactactacttcagttgtgctgccaccaccattagtattactacttaataccacttattactgggcgcttactatgtgccagctataaactgggcaaagtttttttatacatattaatttattaatcttttaagcgcaccctattctgaattgcagtcctctgtacaaaaagtaaattgtaatactttctttaatcatggcgtttggcagtaagtggtctcatttctctggaactgtctattttactctaattttaaataatattttagcaaggtataaaattaaagtttgccaattatttttattcattatgttgaatatattgtgctactgtctcctggcttccattttccatttcagaaggatgctaacagtataattttttattgtgttgtgtctgtcttttcttcctagacaaactaataccttgtctttggcctttgaattctccagttttactatgcagctatcaaatatggacttctttttacttatcttgttcagtatgtattgggcttcctgaataagagaatttattttatatttcaaatgtggaaaattaccagccattatctcataaaaagggctctttttcattgtacttattcttttctttgcaattctgattagacttatgctagaaaattcctctttacccttaacatacgtattttttcttatttcctatttcttcaactatttgtgctttttaaaattcttttggttaatttcttcagctatcttctagttttttttcttagctgggtctaacctgttatttatttcttcctttgagattttatttctattatttctaaagaaaatctatttgattcagagtatcatgtccttagttcatattttcaagtcctattctagttctgtaaatatttttaaatattcatttaatattttctatcctatacttatattatctgaagttcttggattgttaattctgccactaagcacatctgtagtgctttcttgaactgtatactaatttttttatgaagacttatttgtgagagtcctgtgcttcctttggaaaagggttcgttttcctttggctaaggccactaaaacattcttatctgagactgtttttaaataatttatctgctccatatttcccattctgtacagaaagtataaaattattctctacagacacatgaagacaatactgtgtgataataagttatcattatcaattatgaatgaaaccatgcaatttttcctgtgacatttcttttctggactgagacaacaagtttctttaccatttgtctttgccacagggcatttttttcctagttaatatttttaccgacatagcactttaagaatataaattttatcttaggtggacaactgtacagttctattttctgtgaaggtcaagacattctcctattccttgtgtggccacgacaactgtagcttataagttattaactctaaagttaccagtacttcagaatcagcttgcattatttcaatcatgctaatttctttttctttcttgtatttgtttatttattttgactcagaggttttccttccaggtataaagatgtttgctgaactttacatgcatttccaggtgtttggagactttttaaatgctattcaatctctcacattctctcatcttacctttaaaatgagcctattataagagatattattttattcattttaatgatggcatttttttaaaggctccacttcttggctgggtacagtagctcacaagcaatcccagtccccggggaggccaaggtgggaggagcacttgcggccaggagtctgagatcagcccaggcaggacagcgagactacctctcttttttttttttttttgagacagagtctcgctctttcgcccaggccggactgcagtggcgtggcgcgatctcggctcactgcaagcttcgcctcccgggttcacgccattctcctgcctcagcctcccgagtagctgggactacaggcgcccgccacggcacccggctaattttttgtatttttagtagagacggggtttcaccgtgttagccaacatggtcttgatctcctgacctcgtgatccgcccgcctcggccttccaaagtgctgggattacaggcgtgagccaccgcgccctgccgagactccctctcttatgtatgtatctatgcatgtaagcatgtttggagacagggtcttgctctgttgctcaggctggagtgcaggtgcgatatcaactcactgcaacatctgtttagaaaggctaagaaacatgcagagtcaaacaagaaaacagtatcagaactgggacttaaactcaagaaatctgagtcctacttttttattggtacattctcagagacaaaatacaattatttgaagagcttgtcctgctaataacttttgtttacttaatattttcctagaggaatattaaatactattagcattattaatttttttcctaattttcctatggaatggcaaataagcctaagattcagaggagtcccaagttctaactgaaaaggactagtaaatgatatctaatttttaagaaggtgggaatttaaaatgattaatgaaaatctgtcatgggatgaaatattagtccttttttgttgctccttttggtctaaattagtgggcacacgtgcaaaataggtgcgaagcagactaatctttatagatgatgaataatttctcattctactataaggtgtgctttctttaggaaagcaatgtgtgatctttatatgcgcaatcaacgatcctttaaatatgtcttcagtcttaatgaagaaacattaactgggacataacaatggaattcattaccctctgcagagcaaaggaaaagccagatgtttgtgcttgctcttgtaccattggctaccttcaggctaaggaaggctgtaaagttgtctctagttacagaacaaaaaggatttgggactgattacaacatgatatccataatatcattagttgaacatttataaatcaggacaagcataaatacttatatgtctgaattcactgtgagagaaaatggtctttttcttttgcatctcctactttatatatcccttcataattttgtttcaatagtgtttcagttctttcaaattatggttcatgaaaacatcattttagtatcaggattttatttagattagttttcaaaaataaagccacaaagtaattataaacatatacatttggcattggtgttttaactatgtcttggtatatttttactatttttgttggcatataaccatgtgtgttattttagaaatggttaaaagcccaaattctgtagctagcctttctagattaaaatcctcattccattacctaatgttttttagcctctggcaaaactagcctttctgtgcctcagtctcttcatgtacgaaatgggaacagtaccccatggagttttaaatgagtattaaatgagtagatataaggcttagaacagtatctggaacaagggaagcaccatgttagggtaagctattattattgctattactagcatcatccgcttctaagtcatcattgttatcatcatcatcatcattgtcatctccactcccttgtgttataagtttttctaacagtacacccttggcttagagcttctctttgcatcaaggttactaagatcaccgactttcagacttacatctcaggactgaagctgactatctcatgtgaccttaaacaaattaatgaacaatttaaatttagccgtagttttgggtgtgtgtttttttttttaaatctttgaaatggagctagtgtcatccacctcactgtgagattttatatttataaagtgcttagtattttgcctggtatctactaagtacattataaaagacagctgttattgtattttacatcatagaattcaaaagcatcattgaaattgttacttatttattcttagtgtctcgagcagagggagatgtgccaaaagtaactggaagagaagaggtgacattgtttaatctcaaagagatccacacagagtatggcaaaatagatttgtacaatgctgccatttttagatataatctctaactacatctgttgattattgaaattattaggtttgaggaatctcaattgtaatttaaatgtgtaacaatggggcaaaagaagccttaaggctaaattctgtgaatggtttcattcactggttttgccagctattggtgccaaagcattaactggagtatttaagaagtgtgcactttggtggaaagttgatgtgatgtgtgtatgctcatgcatttacacctgaaaggattctttaacttggaattgtgtgtggataacaaatagatctattaaaaattactgaaaccacactccttctcaggaattaaagttgactactcattgtttctacaggacatccggtaatggatgcatgctggattcatacctggccttcttttctatgttaatatagcagccttggattagcatgacagagtggtggcctccgtgagggcatgaactggatcagcctgggctgccattgtccccgtccagtatgtcacgatgcctacttcttccttcacggccctaaatactgcctggaagtggcttagaattttgcttgttaaacctaggtttctgctcagtaatgcttaagctttctgtctctaaaatacaagctctctgcatctacagcttatctggcatctgtattttcttacccagccatacctttaaactccttttggtgaataaagccacttgctgttcagagtaggagttgaaaacgaactttcccttcattgttcaaaaccagttctcgtacttaccacgatgaaacaccctccagcagtgccccaacacaattgctaaattactccaactccaactccataatgtgtaaatgacaaagaattaaacaaccatgagtgtttgcttaaaaaaaaatccatgttagcttattaatccttattgtaatgtcatacagagtagaatgcgaacatcagcaggctaggttattctctctataggcagacctatgtgggaagttaaattgtactcccaatgtgagtttttaaatttgtagtgaaaaatatatttgcctagggactgtgtacctacgttcactggcaggtacaaacagtgcaattttcaagtcatttataatgattttctcattttcctttaaaggaaataaacactaagaagcacagaatggggctcccttttcttggaagcagcctgcaagaggcaggaagaccctgagactgccaagataatctcagaatgagtcaagattgaattgttaatacaccaaagaatatccaaaaagtctgaaaatacaggaaaaattgattctacttattttcagtttaacaataggatccctgctttatattttgatgtacttcataagaatagtgtctggagattgaaggaaaaaatatggagcatattatttgaaaatttaactagctttgaaataaataattttgtccaatatttcctgacgttttggatactctacattattttgtctgagttagtgggtcacatttccagtagtaggagacaaaagggtaaaattcactgacttcctgtgatcttcattctttcgtttattactgtacatctccctccaacttcatgcaactggtgtggtaagttggggcctcttggcctcagaaatcctgttagaagtaaaatggggcccaacagagagggacctttggccctaaagcccgcttttcatttaggtcttaatgttaggaggttagagatgccttgaacttgaactattgatgcaggcttgctcaatatgaggccgaaggactgcttgatgatcagcagtgtattttcctgggacattttcatctatactctgtcttttagaaactcatctatactctttgtcttttagaaacttagccaggagtgtgggctggggagtgggctgtgtgtgactgatctctgccatctctcaaagtcatgattaaaagctgccatgggagggataaagaatgaaaacaaactacacacacacacacacacacacatatatttgtgtgtatctgtatatacattgtgtatatatatttgtgtgcatttgtgtgtgtgtgtgtatatatatatgtgtatatatatatatatgcacccttaccttttatgataactgactaagtaccccctacatactcatgattcccaactccctaaacacagctgcttttttttttttttttttttgaatttctaaatgtccacttagggggcatttctctatagttgttctgcaggtgattcttgttagtgggtctttcagaaccatcaagctggaagtaagtagggcagaaattgtgacttcatgttgaatatctaggacctagaaagtgtctgctacatggcaagtgcttaataaatgcttattgaataaataaaaggatgaatgaaatgatatataattatatactttgtacacaagcacacatatagctatgttcatatcatcaatggtgcgcactaagagagtaaggacaagatgtcactgctatccaaatctcccaaatttccctcacccttaaggctgcatgtcaggctgtcggaacatttttttccctttcaaggttgatgtttgttttaactttattttacttattttaaaaatgtatttttgagttggaaggagagaagcccatctgagattcatcatgaccctagtgacaagctattgatcacaggagtgaagaaagctttgatagcacattttggcagtttgtcatattggatttagggtttttagttaccttaaatcaatttcgttcattacccattgtcagatcttcttgctgcacaaatatatttttattagctgtgttttattatggtttatacactgatattcatttaaatgttatgtcttctttaaatcctcttaatataggaaatagaatggtggtgacgtggggacctcccacagtttagtaaagaggccttgtggctataatcgcatttaagaaacgaccatttctctgtgaagaatggaaaatcagtggtaggtcagaaattaaaggctatgccatttaaatcctaaaacctgatcattctagtcttttcacccacaagccagtgaggaaaatcagttttccccacgttgcattttaaaatataacttaattgagctgtaattttatagcatcatttaccatgttcatgataccaattacttggaacattttttctagttttgaaatatgtggtagaattttctatctttaatcaacttttctcattctgagaattgttcctgtgctttgtttagccaaagactcctttagaaaaagctagattgacttcttattttactgtgtagcaatttcaagcctggtttatttagctgtagtctataagatgcaaattataaaatgtgccttttttatacttctcatttgcttttctctccgattgtattttagttgatatgaaatcagtgatgcgagtattattcaagtattattcagttttactaatgaaaatttggagatgccgtaatgacttacaaatacatacacataagtggagtatcaagacatccaaactgatatacaaaggcttcaactatatggactaacttggggacagtaagttgtgaatttgtgaaactgtatcagaaacagaatatttcctccaaagtatatggaactgcagcaaatacaaatatcagagttgagagacccagcttctggtctggactgtgcccttagttgattatttgagcttgagaaagccattaaagattttgatagttattttctgaaattcagacattgagttccaccaatgagctcacagttaatgtctttcaaatatatgtagtaatttagatactgaaatagctcagagtaacttgtgactgttttaattgtttttataacaagctagaaaccagatctatttcttccaaagcagattagaaatatctttttatatgtacatgttaattggcttaaaaagtagtgtgggaacaaacaaatcatcttgacttgaatgattagtagatatttaatatttggaaacctggagagagttgtttgctcattttttaatgtcagttgttctttttataatgcaacctcagcattagttctcaggcaatggctaatgagcattcatcttgacatttcccttcttaaaggacatttaaacaaacttcccaagatctaccctatagaagagaagattatatttttatgtgtggttcagaagagcgtatcaaagaccaaatagaagaaaaaaatgttaacaattgaagctatcacaggcagggtgtggtggctcacgcctgtaatcccagcactttgggaggctgaggcgagtggatcacaaggtcaggagttcgagaccagcttgatctatgtggtgaaaccctgtctctactaaaagtacaaaaattagctgggtgtggtggcatgtgcctataatcccagctactcagggggctgaggcaggagaattgcttgaacctgggaggtgaaggttgtaatgagctgagatcatgccactgcactccagcctgggtgacagagtgagactctgtctcaaaaaaaaaaaaaaaaaaaaaaaaaaaaaagctagaacaaattggagtggtttcctagaaagacaaagcgttttttgtcctagaggtcacacctggattttgcatctgttaaaatttcatctgcatgatgccctccaaggtattgttaaagtctggaatttggacattaaatccatcctctgtactctgcatttccttgtacagtatcttaaggagcatgaggaaatcaagatgtcctttacatatccatgtcaagatgttgattctgaatgctgccgtctctttgattcagaattagatgctagcatgtttgatgctcgcgttatctctgcttgtccaatctagatggaagttgtggcattgattcttgttttcctaataacattagaaggtttttgaagtcacacttcaactaccaagtactgtagcagggtactgacatttcagtgcgttttgatttgtgtcatggttgtaggagaatacaggtactgatcaatagaaacatttattgacttaagaatataaataagtcagcagcatgatttttatagagagacttgacttacttattgaaatttggggtttatagaaaaattaatttattggctgcttatatgctttacaagataacttacaataggttttctttagtatatatacgatatagtgtccttatttcagaaatatatgtgttgcacaatgaaatttacattccatcagtgtatcttccctttatgtgtaaaaatattgaacaaaattgagttcactattggtcctctatatgccatttttctcttaagcttagatcatcactgtttaacgtttcctaatttatggtcttctcttgcattcaaggccaaaacaataatcacctttttatggaatgtggctattgctacatttaacaggtctttgcaaggttctcatttgtgaagtatgccatattgcggcttcataatctttctggctacaacaatgtaaaattaccctacaccctcttctcccaacccaggaaaaggctacagctgaaataattaaaatccatacggttaatgatctgtgccttctgcaaggtggcgcattactgtctctaacgatgtttaatagctcataacattcaatacacttaatcattagttactgacatttctagtacttttgcatactgaacatatcttgatagggcaaatattacattggaaaagacttaattatgtaccttgggaaagaacactgaccaaatgaggacacatttggagctgctcttgccactgaattagggttgtcacagaaccatgtggctatagtgggattttgttaggtgaggagagtttgatttgctggtgtcacattgggatttattggcctcacagcaacaatggcactgagaccagagtccctgactgggatgtcaggagacagggatgctgacccccaccaaccacctgaccacggcacttgggcttctgtgtcttcatgtgtgagatgagaaaggggtgctgaatgatgcctgaggagttttcatccggatctgaaattcaccagtctcaacatcacttcagaggcagtggccccatcagactgctgtcattttgcacctaatttattgttttctgagagtttctggaaaaacctaaagaatgataaagagaccatggagcccactacccttggtagaaagacaaagggacaggcagccttcttattttataatatttacatagttttggtatggcttgcatgatagggttttttttttttttaataagcagataaggctttcttctgaatactgcttatttaagccaaatattatcttgttttttgataacaagacctgaatagtaccaagcactgctgtaactgcttggtgcttaaagtgtccacaggaggtagcttattttaatgcagattctgcttgagaaaagacaggacttcagcatccctgagccttagagaaaaattctgattgttgattgttgaccttttccccaatcacagatttcagtcatagccaccctggggtgaaatgcatgtatagctctctcatattcttgatagtttccaaaaaagtgttaagactttttccttcttgctagcaaaggcctatgtgggcaaaacagaggagaagcaaaggagttgctcctttcactagaactttcctttagcaaatgttttggtttccttgctacttcctgaacttagaaatccaactaaaagttcaaacatgaaaaagaagaaagtatttcaattattttattgtagagtgtatagcatctgggatttcatttgtcttttctccctgcttcagtatcaattcaatatggttcaaaatgtaaagtgccaggcaggcgttcctttcctcctctcgacagcattccttgagggaatataccttgtcaaccgatgtaaggtatgattaaataaattaatgtgctacaattatgatttcttcactgattaagcttacaggtcaaggaaggagggaaaactcaaatgcatgcatgcacagggagtcacaaatcatccctaacatgtgacaataaggagtggtggaggctgggaataattggagaagtgtctttgtttaggtccttgttccttcccttcctccctcctaccctcccttcctccatccttccctctctcccttcctttcttccttcatccctccctcgctccctctgtatctctctccctctgtttctctctccctccctttctccttccctccttttctccttcctccctccctcccccctcccttcctttcttccttcatccctccctccctccctctctcccttcctttcttccttcatccctgcctccctccctctgtttgtttctccctccctccctttctccttctctccctccctctctccctccctcccttccttcctttctttctcccttgcttgcttccttccttcctataccctgtaaactgaataacataatttactagtcttcaactcctaatacaggtgcagacagacatatgtaaacaaataattttcacagagtaaacaggatgttaaaataaagatatttctaaagcactggttttaagaggatagaccgcagagccagacagattttgaatgcctacttcaccacttaccatctgtttgaccttgggcaaataaccttaataatctttcttttctgtgttcagtttcctcagatagaaagggtgacaatgagaacacttccttcatcagattctcttcagtagtaaaagagttgatacaggttaagctctttgagcagaacttggcacattgtgagctcttaaaaagagagctattattattatagatgaaagagttacatgctaaaatattaagtccagatagatacagcctaatgagatcctaaagtggaaggaatcttggaccaccctgctacaccacccccttgctgctggaaccatcccagaagaagacattcctatgtttgcaaatgtagttagagcagaggccctcagccacatcaacacctgcttacctcatcttttcaacacattatccaactctgcctgattcttatcaaagaaccactcacttatttcttccaagaaaaggagccaagaggcatgatgtaatgcatcaagatcttctgtggtgaccttgtaacttctgtggtgttgtccaccttggccattcatttaacatttaagtttgttttgtctcaaatgaagatattttcccaccttgctttgaaaatgagctgaccagacctgtaagtggttttcaagtattacattgccttacagactctacaaaataatcaaaatgataaaatgttctgaagttggacattgttgactgaattaccgttttaagattctgttatgtattttccttcacagtctctgtaagtgtgtgagctcaatcgggatgcacagtttgagttgcagaactggctaaggctttgggaacctgtggtcagtttccctcactaatgttgctttcctctctaaaaacatgttttagtttctgcattgctctacaagatccgtttttcagaatcctttaagatctgtacttcatggaaaatacatgtgaaaaaggttgttaggcaggtgtcggttatcatgaaaagggaacaaactggttaagaggattggaaatttttgccctttttctcatccttttttttctttttctttttcatttttttcttttccttttttttttttttttttttttgagacagaatctcactctgtcgcctagactgcagtgcaatggtatgatctctgcttactgcaacctacgcctcccagactcaagcgatactcctgtctcagcctcctgagtagctgggattacaggtgcccaccaccacaactggctaatttttgtttagtagagatggggtttcaccctgttggccagactggtgtcaaactcctgacctcaaatgatctgcccgcctcagcctctcgaagtgctgggattacaggtgtgagccacaacacccggccttctctcatcttttctaagaattctgtaatacagggagaaatataaaaaacatgaactatcagtatatgttggataatttatgtaattagataaaggataattacgcatttagacaaaagatgatatgcagttgtagctattatgtgtgaaaactgctggttaaaaacatatgcatacagaactgtctagaagctagctcatcggatgttgtccttggttattaagatgtgaatgctcttttggcttcttttaattgtatttttttagttctcttaaggagcacatatttattttatagcaaaaatgttgacaatgtaaattaccatggaaggtataggaaatacattgcaattcctttccctacgtggcttttcatgtcttaatctgctcttattctggctgtttcattacatttgctctgtggtttgcctttttcttcattttcattctcacactagttccagttttcatcatttgattccagggagtaagtccaatacttgccattgctgaaagagtgaaaagaaaagtttttttgtttgttttgttttgagacggagcttcacttttttgagacgaagtctcactccgtcaccaggctggagtacagtggcacaatctctgctcactgcaacctccgccttccgggttcaagtgattctcctgcctcagcctcccaagtagctgggactacaggtgcacaccaccacgcctagctaatttttgtatttttagtagagacaggatttcaccatattggccagaatggtctcgatctcttgaccttgtgatccaaccgcctcagcctcccaaagtgttgggattacaggcgtgagccaccgcgcacagccgcagtttaaccctcgtttcccgggctggatgcaatggtgaaatctcggctcactgcaacctctgcttcctgggttcaagcaattctcctgcctcagcctccctagtagctgggactacaggcacctgccagcacgcctggctaattttttgtatttttagtagagacacagtttcaccatgttggccaggctagtcttgaactcctgacctcaagtgatccacccacctcagcctcccaaagtgctgggattacaggtgtgagccactgcaccttgttttgtttttttgagacaggtctcactcagtcatacaagctggagtggtgcaatgatagttcactgcagcctcaaactcctgggcttaagccatcctcctgcctcagcctctagagtagcagggactaccctggcaatttgatttttaaattttttttgtagagatagggtctcactaggttgaccaggctggatgaaaaagacgagttaaatcctcttcagcctctaagatcatcaacaattctgaggttttcattttcttcacccagcactctttgaatcttgcttttcaccacacatttttccttgcttctcacagtttttcagcagttcagttgtcaagcatttagagtgctgaccttacacgcaggcccctccttcaaggaaagagccacaggatatttgtgccattttggttcatgacctgattcctacctgatgtttttgttcctaaaactctgccttccacatgccatacttttcttttttccttttattatttttctttttttttttttttgagatggaatttcactcttgttgcccatgttggagggcaatggcgtgatcttggctcaccgcaacattcacctcccgggttcaagtgattctcctgcctcagcctcctgagtagctgggattacaggcatgtgccaccatgcctggctaattttgcatttttagaagagatgggatttctccatgttggtcaggctggtcttgaactcccgacctcaggtgatccacccgcctttgccttccaaagtgctgggattacaggtgtgagccaccgcgcccagcccatgccatccttttcttgtgtttattattactggcatgcatcattccacatttgaattgatcttacctcaagctgatgcacaattatgtattcatcccagtgctttcagggtagcctaggaaccagaataagcactgatttaaaagcagagcaccattttttttttatatatattctatcttcaaacaataagtacttttattgagcatatgttgtcttgcttctaaggaagaaacacaagaagtgaaaccaaccaaaatatacacttttaaacctgtaaccaggagatcaccaactcttcttactgcattttggatgcttgaagtggttgtgatagtagtggtattaatgaataatgatcacccgttatgggtaaggccccatgttgggtgctttgaatgcatcgtctctaattttaactctcatggcagtctgtgaggcagctgtcattattttccctgtcattttacagttgactggactgaaatacaaaggttgaataagcactagctcacatatttggtaatagttggggtggagtcgagatctgaacccaggtcaatgtgactttgtttatcctttttcatccatgagttaatacatgtaaagcttttagaacaatacttatataataagcctttatatagaagcactacatacatgttaaaattgttattttccgttggtcccttatttggtaatgttaatttttcttcttttcagcaggttgtagtggctagaggacatcaaaggctttaccgtggaaatgttgctctgagttaggtctataatcaagtacatgagattgaacaagaatgtatataaaagaagcaggcagatctcttgtaccctctcttcactgccccatttccctcttacacatgcatactatttcttagcgaaatatttcaatcttatagaaaaagcacttttctctacattcctgggaaagtagctaattttatcctgataaacttgcttatcagtttgcttcagtaatcttaaagctgcagggactaagacctattaaaattatagctgatttgaggttgcctttcctttggaatccttatcaacatgaaatcacttgtatctgcttaaaatgagcttttagtttaatttgctttgaatgaaatcatcttctatttatcttagaataatctcagaatttagtgtgagttttccatccagaaaggcagatggcattttctaatgtgggtctctctctctctctgtctttctctttctttctctctctctctgtctgtctcttccctgtctccctctcacggacatctgctgagccactcttggggtgcctgccgtgggccccaggttgattagctccacctaagatctctgcactgacacgtgtcacccatcggctttgaagcagtagtgctgaccagatggttggcatctgcatgaaatgccagtacacttctgccagatgcccgatggtgccgctaagacagatggaaggagtcgttctaggccctccagagcccctcgttctggcaagacctgtcttctggaatgatgttggttcattccgaatgttcaatctcaacttgaaaatatattggattaggcatggttcttcaagtagtgcacaagctccacctgcagggaaggggtgtgactgccctctcctcctggggatctctgttctgccaatagccctacctgagtgacctacttttaaccatgctagggctcataccgatttcacctgcaggaactgggatcaaccatgtagctacctgggttcgtgtgcagaataaatccccctttcccttgaataagtggatctatttcaacagtagctgacttacctattaatatcttacacaaatttgtctagctctacttgtggcacttttgtcaatagtttgttggatttaccttggtgtataatgttctttctacttgcactgtataaagtagggaaaaggtggctttctttctcccaccacacagatatttgccaatgactttttttatttgtgaggaggagaggcaagaggaggagatgtatgtaaccctgtggcaagggtaggacacttggattgagctctaggaccatacatcttgaaaattcatcattgtgccactagagtagtgaatttttaagtttctcccatgctgttgttatatatcaagctatttgtgtgtgcctaggcaaaaaggctaagctggttagcaatataaaatgcttattgtagatggtagcctcttttaaaaatccaacagtgcaatatatttccttacacacccacattcccgagtataaaaagtatcactgtgagggtttaaataactaccacactagctgagagaattactttatattctgatcggcctataaaatggtaagaggtgttttttattttttcttatgactaggactaattacaggatgcacagactttccatgctatcattggcttcatttaaatgagctagattttgcttagtaggtgagtagtaatcattactacaaaaattgaataaattgtttgatcttgagttaaaaaatctgtcatattaactgtactcttcaagtttattgaagcttttatacccctgtgtacactctgctatatgaagctccatttatggtttctcacagttttcactccccaaagtggatatccacccactgatttggttatcagtctcaatccttgttaattatctctttgtttcccattcctgggtcccttgatgcaaatatatacctgactcttgtatcgtgtcagccctcatcgtcagcttgaaccttttgtctggtcttcacatctagtcagcccttagatcggttggttgtgtcacacagatgcattttatactccctctcccatctccttggtccaggctctcaccactgctctctcagactaaaactgcatttaccctattaactgacttctctgtcctggtctttttcccctccagtttattttatgtaatatgactaaaataatcttccaaaaataaaaatctattattgtaacttcccaccctgctgagggtaaaatccaaacctcttacatggtgttctaggcattactgcctctctccagcccccttcctcatgggttcttccagagaactgcaggtctctgtactcagcatggggctccaggcttcagagcccacgaagtgttcatgctgcctgagatcccctccccacctttgttttcctggtgaacacctctttcttttttgcatcccattaaaatggacagcttccccccagtctcacaataaatgagcaaatacctctcccctctgtgttgcctactttcttaatcttgtctcttatggcacttaattactgtattctgattatgtgttgacatacctgtttactcatgagactttgaactccttgtgcctgggtattcttagtcaactttgtaatggcagagcctagtacagaatctgacacaagtgtgtgtttagtaaacatttgtttaattggtttagttctcttctaaatgttttctatattggcaaattggttactaagaggattagaagattggatcttgggtgcctctatgatgtgttcttgtctgattagctcaattaggagtacagtgttaatgaggccaaggtcttaactttcaattccatgtggaacaatttgtacctcgactgtcagtaacttcaatgagttgcatggtaagttgcctggtatcattggttccaaggcaaatgcagagagaggatgattaagctcaaggcaaatccatctcaactattagacaaatggaattaaatatactccttattgatgtgaaaagcatgacttcatacttcagtgtgaaatgagcaccttgtttggtccacagcacttgtccatgtgcactgatgtacttgacttaaagggctctttgctgcaatagaggtggcagaaataccacctggtcatcagagttttgcaataaaaacagtaattgtccattcacagatctttaggatggccagtctctaagcctcttgtctacccacctgcctctccgtgtctgtcttccaggtgagacgatgcggatcgcctcctccgagtttgcagatgacccttgctcgtcggtaaagcgcggcaccatggtacgggcggcaagggctttgctctccgcggtgacacgcttactcatcctggcggacatggcagatgtcatgagacttttatcccatctgaaaattgtacgtatgtagaacttatcaaaactttctttatgtgagtggcaatcttgaccgtgtgtattacagctctggcctctactctagatgtttcattgctcaccagatcagttcattacctacccatgtggtgcccacgtccaattttttctaataataaaattatattcaataatatagtcaaagagttttgtaagactcacttgaattattattttttttcctaaaaactgagagtttagatttctccttacttcctggaatgtgtaacagtacattcttttagtctacagagcctggacagggtggacctgcctttgttctatctcaagattcggagcaatcttggtccatgtgatagttcaggttggggtcagctctgctgagcagctgaccacctgtgcccaccttagtgtggattacatgttgaatatattttgctatctactctagccttgctctcctgtagatatatggattttgaatcatatattggcaataaaaaggggccccatccacaattcccgtggctaaagtcaatcttgtttcaccaagcctggcatctaacatacctggattggttctctgggtgggcacatacttgtcccactaacccatagaacaccattctatgtgccttgcttttcatggtttcttttaattcttttgtttcctaatagaggtgaagccctgttctcatcacaaactttaatggaatagtgattaaggctacctccccagtccttgactacgggtcgttcttccatttttctacttgctgattggtatctagttgcaacaaggatggttcaacactttaacaaagatgatgtaacttagctgcttgggaatatggcctctgcttagagaatccctactccataccctcagtgaaatatgattcctgaacaattggcaccaactctggactgatcgcagggtacttagatgatgagatgcaaaccacattttcctttttggagaaccaaccaattgctcgcttggttacccctgctgtcctgggcattcctggattatcatgtttcctatcagccaatcttcctgtcttattttctttatcagtgaaagcaggttatgaggagggaccaggggagataggaaatgaataacaagagcgtgctctcacctcaccattgagctcagatttgttcagtaggaggaatcatcaagaaattacttaaatcataactattctctgtcaaaaaaccttgggcaggatcttttaccgaaggtggccccaataaagtagccaagatttccaaattatgtataaattctggaaaaatatgaaaggcctcaaattccaacacctgcagcctgagctccgaggtcataaacataaaggtagtgtatctgtttagggcttctatacaggtccctgagcagcaggggacaccaagaaactgcttggaagttttttttatttttatttttattttttcctctcctccttaggaatgtttcagggaatgggttctgaaaggccaggaaaggctcttgaaattggataagctgagcaatttgaggagagtctttacctgtttcagaggctggtgaagggcagtacagtactataattaaccatttagctgctggagtcagagtaactgggtttcatcttggtttggtatctacttgccatctgtctggtaacctaccagataaatctcagatatctcatctgttaaagtggggctaatggcagtggagccctcagggtggtggggaggtttgaatggggacgattcctgtggagcacttatcccagagaatggcacaaagtgagtgtcctgtcagtggcagctgaatagggagtgtaagatcactggaaccacttgtaggctgccacactggctgccattcctccagtctgtctctgttatatccatcttttcagttacacaaaacttccttctcaagcatgttggaagaaaggttgtgttatctttcccttacagcctagttagtctccgaaggcgatatttttagataagtctttccacagaaggacaatcttcctttaccccagcaaggaaataatacgactgaacctaacaaaattaaccttacatctcatatgtcattgtttgctgtgttgtggaaggccctgtcagcaactgtcagggagtgatgatgggctgaatatccttgctgaactgcctacactccacactcgagaagtgtgataaatccagggcgatgacgccatgtgtggtaccagttgcctcctgcagtcctgcctctcatcccacctgttttgaccagtgctgttggctcatcagatcacagaagcctgctgtaatggggagtcaattgcaatctcttctccacacagccgagtaagggaagtttttttttttttttttttaacgatttagcacaaaatcatggaaaggtcaacctggcaatattaagtagtcctgtcagactgtcagtagtaaaattaaaaatgattgtagactaaataacacatttgttctacttagagtgcagtgtctgtagcaaacagctgtggtggaatgttgctatcttgtggagcaagtgaggaactacagtttctggtgccatctggtgttttctctcatgaactattgcccctaccccctaaaagacaatacgtcaataattcattgcaaacaaacatagcacatagttctactcagtagtagggagtatatcagttcttttgcgcagaagcatatcttctcaggacggataaagtaacgtattgtctgcaagcttctatttatttgtttttctgtaactcaggatgaagaacatgtcaaatagctttacatattttgatgaagcaagttagaaaatatttacacctttctcaaggatttttttaaataaacaatgagtttctttaccacctggatgataaaacatagatgagaaagaaaagagtgacagttgctttctaagaagagtaaagtagtgactctggttttctagttgggttcagattgagtaataccctgtagtgagactacagcctcctgctgtgttaactgctacatatctcttttacctttaagtgttacacatagtattctactttttatctttcaggccatatgtcaaaattttatttgtgttctttccagatgttaatttttctcatctctgagtaactcagaggaacaaagagagaattacctttttccgcagcaacttatattcatgttttttcatcagcagttcgccaggttgatgaagaatagtcacttgagtaatcacaggcaaatgtcgttcagcctctaaaaatgagtaaaggattaggagccctgctgaggtcgtgtggtttggcagtgtgcaggtctttgcattttgctacttgataattatgtttaggaacttaaatttatatggcaactgagaagttcttctcagataacacataggtatcttagttgctcaagttatgctacttgttctatcatgcaagtatttgtggtactttaatattgagttctctttgagtatatattaaagattcacatgactgcaaaaggtttttgctgctgctgttactttaaattcaggaggatagagatagaacagtgggtgacttagagttctagtgcccagttagcacccaagtgagaatttaatgttcctgagtaaagctaaagtaatcatttacatttcagacaccatttaaaaatactgaattataatcaattttattgttgaagttgctgacaaatgatttcctagccagatacctggaatatcctgcaatcagttcacattgtcagtgtgttaagttgatatgtggcatccggaattttaaaggaatcctgcatgtcaatcagtgatcatgaagagggacatttatattccctaggctctgaactagtgtaatcagattatattgtcaattattagcatgagcgatagcaggacacataaactcatgtagatgtgtatgtcagaggaaacaatcacctttctatcctcaggctagatcctgggataataatgttcttgattatttgataatttctctctagaaaatggaatagcaagatacaaaatagcaacccttagtcagcttctccagaagtcaagtttccttagtggctaccaagggccaaatatagtgctgctgttctaatgtgggggtggggggcattgatgagacatgatgatcttaacattaactgtgactttgtgagttttgcatcaaacagcctcatgcagcctcagtagtgtattatttctcaagtctactttttagtcctgaagttctaatgtggctcttgtgtttgaataacagtagtcaattggtatcataaaatagccttgcctctcattataactgcagaaaatatggcccaggtttttagcatatcttttctgtcatagctatcacagtattaccttcatgcagctgcattgttcatgatttatttatttattcagttatacacttaagaactatttattaggtgctgaccatatgcaaaacactgtgccaagatgtattattttaagggtgaataagactaggctcctgccttcaaaaccttacaggctactggggagacattaggacattagcatagagtgcaatgcatgttaggaaagggtgcatattgctgtagtctcacccagatggaaaatataattatgatgctttctttcataaataacagaaaacctaattctacctagttttttaaaaagggaatattttggctcaccaaattaaaagtccagaggtaatagcttcaggcaaggcttgatcaaggtgcaaaagcatgacaaaaccaggtttttctttctttctcctccttactgaggactctgttctctgtagcccctgataggaggcctcatagtctcaaagtgcttgccaaccgttttgaaggttgcatgatcctagactaaagatagcacaaaagaggaaattctctttcctggtagctcaaacaaacaaacaacaaaaaaaagttctacaatcttattaggcacaattggcctctcagtcatgtgcatatctctgagttaattatttagatggataacagaatatgctaatttcttagttaacatggtcaggactcctgctctttgctcaccccaagctggaaatgggatcagtttaaccatattgtatggctgcacaatttaggacaataagagaaaggatgatgtggttgggagagggaggtctcaagattgggtctcattgaactaaatgaggtttgcctctcctcgaacctatcgctgggcctagattcaataagtcggagtctcaagtccaagctgggggctgaaagttggggataagtggaaagagttggccccatcacagagttgagggatgaatcattctgtccaatgatgacaacacaaccactcagtcatttaaacagggaacatttaaataattcttaacactaatagcagtttggaataacaagggattagctcataagaaatgacaagaactcttaaggaatatgggaatggcagatatgaggagaagctgctacccctggggctggcatagggcactctagggaggaccccaccctaccaggcctgagatccagatgttgttggagggtgtggccttgggtcacttgatgacaaaggagtcactaaggtgccacacaatataatggagcttgctagaaatctgccctttggattgttgaggaaagctgttcatggaggggtgtcttgctggaggcattctgctacagaattgcacagcggggcatactgagggaagctgctggccacctggtgctggagaagcttcctctgctgcaggagcctgttgaaggagcacaccagaaccaggaaccaaaccctttcctctggcagcgtctatgcaacaccctctactgacaaagcttaacatcaggccaactgggaaaggagtaatatttcagcggcccatccatattttcatagtgttagcagaaaaggtgaatttggatttgatagcctatgcaggaaaagagcatgttactgaaggaaaatagggttctattaccataagaagggagatgatagattcaggtcaggcaacagattttaactacagaaagagctttacgaaccaaggaaagaacaaaggcatgagattaagagaggagtcttggagtgtttgaaacaccagtgattctattgttggtgcatagtgggcaaggtggggagaggcaataacaaagttgaacagagagatccaggttatggacagtcttggataacatgataattagtttgcactctatatataggttatggggagccactgagtagtactaataatttgattcagattagtgatttagaaaaataattttggtagcagtgtggagaaggaattagaagaggaacacataaagagactgttgaaattatctaggccaatgaatgaatgaaaagctggctaagacaatggcagtgtttattgtgaaaaagaggtagattttacagatactcaggatatagaggcacagtgaatagaacttggagaccaatcatatggggcaaggctttagaaactcaccctttctgaaaaatcaatgcagcatagctcagaaattgagtatgggctctggagcaaactacctgggctcaaatccaggctcctacacttacttgctgtgagacttctgacaggttatacaactcctctcctccgatttcagtctctaccggataagcatagggaataagaaaaccatcaaattcaaagaactgttttttgggactaaataagatagacgtaagccatttagaacactatcttgtatatcagaagaactcaatgacactggtgtcatttttttttgtacaaactgaaaataactttggaaatatataataaactaaattgttgtgctttgtataacacacttatacacacatttgtataacacacattgatgcgctttaagcatcaatgacactagcatgtaatcattctttgcttctgatgaaatcatttttttcttcccttgttgacaaggaaagacacaatttaatcaagaagaccaacttaactttatggggcagaaatataaagtatgataatgctgagacaccaatggccataccagagtatctgattaaataagtacaatagttagatggcgggtcttacatgcattcattctttcatgcatttggccaactcctatttccaagatagttatttttaaatttcactgtaaaagtagactgtaacaagagatttacatatgatccattaaatagttttgtcagtgtcacttaaaatccagtcaacttaggtaacaatagtaaaccctggaatggggtcagtctgtccaaacagaaatgataatcataacagcaacgatttctagtaatggtatagccagcaattttctacagggaaccagaacacacagtgcaggcagggatgtatcagactcctcaattccacactatcccatccccagatgccgaccttatggtagactctgcataaatatttaatgaataaatgaattatagggctgctttatttatttatttgtttatttattttgagacggagtctcgcactgtcgcccaggctggagtgcagtggcgcgatctcggctcactgcaagctccgcctcccgggttcatgccattctggtgcctcagcctcctgagtagctgggactataggcacccaccaccacgcctggctaattttttgtatttttagtagagactgagtttcactgtgttagccaggatggtctcgaaatcctgacctcgtgatccgcccgcctcggcctcccgaagtgctgggattacaggcgtgagccaccgcggccagcctgcttttttatgttgaagtaagtaagtacagtttcaaccaggaaaattagacactgatttaatgactatctcaaacaatatgacacagttctagactaaataataggagtagacaggcttgctttaggaatggtggtacaggctattttgaacaggcctgcgaaaaggccaagattttaagagttgtaagtgacaagttctgaaaagaatttcttaacccactaaattgggaataaattttagtgtcttctctagaagtgtcagtcttttcagctttatctatgcactggttataaatattaaggacaaaaatacgtggtttagcaaagagttctggctttggtgtttataagcccagcctggtcagcgggagaagaatgcctggctgtaatgtccaagatcatgagggcatttttaatgggaaagggtatgacagctgcctctgagggatccctttatgtcagctcattagaaatcatttcccaatccaggacataagtgtcttccaaacctcccccttatcaaagggctcagccgttgacaccagtgtccttcttagagccatcactaggcagcccactgcctgtattctctctgcagctttctttctagttctgccagagcccctgtcatccacagactttccaagagtaagataaaaacctttatcttcaaaattattaaggcatttttcccccatgcagcaagttggtgtctctatttaatgagcccctaattcttgccatacattttgctaagcaaatgtatgattttgctaatatgtatgatttgatattttgcatttcttatctcctttaattcccacaaaatctgtgcatagtgtgtagacattattatcctcattttattaatgaagacgtgaggattggagaagttaaatagcttgccctggatcacagagcttgccaatgacatcgttggggttcaaatccagaccaatctgacctcatagccctcctcacacagttgtacttaacattcttcatggtggggcccagacaggtgtatcttggttaaagtgtcccagggttttcttctgtatcttctgctctttgttcaactcgcagtcctgaactcctccatgaacagtaaatgtttgagagcaaggtatttgtttgggccataggagtcactttcctttctctagctgcccagaaaggacaaaagatccttgactgttcaaaatccttgactgttcaaaaataaagacttaatttttatattaattttgaattgtcaatattgtctgttcactaaacttattttttcttctttttctacgtcccttcaatattctatctatctgtctatctatcaatcatccatcaatcatctatctaatctatctgtctatctatcctatccatccatccatctccatctctcatctatctactagtagtgtgtgcccataatccagactttagttccatttcctttatttctgtgggaccttggacagattctgccccgtgattctttgtgagaacttttagacttcttagatccttctggattcaaactctgcatgtaacttaagtttacctttacacggaaagaccccattcttggtgtttctttggaaaaatattttattgaattataagaaattaaaactggcatctagattcttcagagaaaaccactgagaaaataagttatgtgtaacaccgtaaaataagtattccaaattggtctgattaacagcctatgagaagcctgttttatatatattagaaaacaaatccagaatttagctccctctgagataattattgtgctcttccctggaaccagtttttatgtcccaagaagagatttacatctcaaataagcagcaggaacaaattagctgccaagaactgtcctttcaaagatgctgttgatagccaagttaagatgattataaatctattagaatgtacaacaccattgattttggtgttttaaagatctgaggtacgagattctctttaaactataacaatgttttaaaagtgcctttccataccataaaatgtaatttgacttgggtgcctaaaaaacctgacacatggcagttcctttttcaactgtacttcctttttcacatgagcactattagagcctagataggaattgggaatgactaacattgaggatttacatcatcgtttcatatttttataattagggaaaaaaagaagacgcatgctttccatagaagatgagaatggaaacttaaatttcccaatccaggacataaacgttatgtggcatctagattaacctccccccaacccctgccaccagtatcattccaaataacttcctttgcttgctacaactctttccttactaaaatgagttagcctatttggtaaattgaatggtattacatatctctgggacaaaaggcttgatgatattcattattactggtttagatacgtattctcttcctttgctcagtgcacttgataaggaagtgaaattagccacctttgtgattgcgtcaagcctcaattaagttcagatctgagttaatataatctatggttattttcagccattgtagttgtcatttgtgtttccgaattgtcaaacaatgcactgtctatataatgccctttaatttgcccaaaattacaagagccgatctgaattctgcccaagtattttttgcatttctcattactctttctttcaaagctgccttctcgctccattcctctctcaggaaatggaactagtcgggggcctctgtcagactcccttcatgtttaagaacagttgattttccaaaaacatgtctgtcttgtgctttattcactcaggactgtgttcttggctatttccattgatgaaattatttctataaagacactatctgactgacagggactgagcggactccttcaccacaatatcttaattttagtttaatggtgtccacagatggtataacttaaaggtttaccaattgtggaaattttcataccatattgaagttaagatcattgtggaggggagaataatatttttcaaaacttaaattatttataaaggaattttgatgaaattcacaattcaggtccaatgctactatggaaaagttcactgagacagtttgcagcgatttggaagcatggcacattggtagggcggtgtgcttgccatcatcctctccacccccattccactccagttgataccaccttcaaatagcaacaaaacttcaaattcacttgctttcaaggaatcaatatttcctctttccattggatggagaggtataaactcagcctaaaattataatccctttagtcccggtgctagagatgttgtcaacattggttgcagattcatgctgtcctaaatttttagcagctcaggaatttctccagtcttttgtttgtaaaccattttctcttctgaaggcttctagaattttttcttaacttcaatattttttctcaaatatattttccttagtgtttctacttaaaggtcgatatctttccaaatcatactttaataaaatataataaacacaggattttatatgcaccaggagttcagcaattgcttttttatatacaaaatatttttaagtcttgaataactatttaatctgactacacatgattgttagaggaactcttctcctattttttcatttacatgttaacacatactagtgttttagagtttttgggtgcaaattccatttctaacatgttgaataatatttaaatactatccactaataaatatgttgtttttcaccactgcaggtggaagaggccctggaagctgtcaaaaatgctacaaatgagcaagaccttgcaaaccgttttaaagagtttgggaaagagatggtgaaacttaactatgtagcagcaagaagacaacaggtgggaaagattttagaaatgctaggggagaaaatgggtgagtttaaataaccctgtagctttttaggcctgaacaatggatcaactgcatctgcttgctatcaaatgccctaagaacctgtgatgacaaaggttgcttcctgcaggggccagttgtgatgccttggtgggctctggaccactctctggcccccacctataagcaggccacagattatttgcttcactggtggacccaccctgctagccctaccacactctgatcttctatccactgtaggaacacagctctgatgtcaaataaaaaatattaaactgtggggtagtgctgtggtcagtctctggatgtcaccctttgccctcactttttgtctcctagtcttgtgaacaccaccacacatatacactcccaggatatgtagtatgtggggtgaaatttttctgaaagagaagaagaaaacatgaacaaaatgagaggaaatgcaggggtgggggaacggagaaagggagagagaacagggggaaaaggggaggggagtggggaaggggaggaagggaaaaaggggtgagaagagtgcaggtgagcgtgagtcactctcatgatgctgtgtgacctgggatctcctcagcctcagtattagtttgttctcatgctgttataaagaactgccctgagactgggtaatttctaaagaaaggagatttaactgactcacagttccacatgggtggggaggcctcaggaaacttacaatcatggtggaaggggaagtaggcgccttcttcacaaggtggcaggagagagtgagcaagagcagggaaaactgccttataaaaccatcagacccccgtgggaactcactcactatcacgagaacagcatggaggaaccacccctatgatccagtcacctcccttcctcgacacatggggattataggtccctccctccacatgtggggtttacaattcaagatgagatttgggtggggacacagagccaaaccatatcagcctcctttttgtctagggatttctcagtttcagctaactctgtttgctcactggatacctttagtattttgttcccatcgagtgggtttttattctttcgccatagaaaaaatatttccaaatgtggaaggatctcctaaaatcctttcacccatccttttgactgcttccagaattttttaaaacattttgggccattcgtagtttctctaactttctctctgaccaacaggaaagttccactcaacaaacatttattgaatgttcattctgtgccaggcttaagtgaggctgggattaggaacttaaccaagagccagtcctcagtgagacaggcacataaatgtgattttagtttatgtggttatttttaagtatgtttttatcagcagaattccttgttgaaagggaatcttgtatggtagcccaatgtgtaatataaacaggaacaaagttactctgaatagtgagagagagatagagagccccaggaggctactggtgcaggccccagagtctagaagcctaggaatctggtgttctgatgtccaaaggcaggaggagaagggcattctgctctggaagggagagagagaatgaattcacccttcctccacctttttgttctgtcgttgcccccagccgactggatggtacccacctacactgagggtgaagcttctccacttaattcactggctcacatgccagtcacctcctaaaacactctcacagtgacacattcaaaataatgcttcatcagccttctagatacccctcaatccagtcaagttgacacctaaaataaccaacacagatgtgccgattttgagatatccacattgaaacatcaaatagaagagaagtgttgcctggagatggaaacatgggccatcagcatgtagctgacattaaaagccacgagaatatatatgatgttcatatgaaaatgcctacattatttatttttacttcattaatactttgtttttaattgattgttagttcagactctttcaagaaaatttagaaaaacagtagaacagaaggaaaggggaaaaacacataataccctaccacccacaaagaatatggtgctgatattttggtatattttctttcagatatttatcttcacatattaatgcatttaaaatcatactatgcatacaaatatgcgtattgtgttctgctttttaatttatcttataaatattattcatgttattaatttttggaaaactaattttaattatcacatactccaatatgaatgtttcagtagttttttttcaaccaattcttggtaattcaatatttagattgtttccagttttcttcttatgattaaaacatgtttcttcaagtgttttatggagagattttcacaacccgcatttctcacttctgtatttagatctattttaccattttattattttttttagtatagatacccaggaatggaatttctggaccagatgttctgacattaataaaggttttcatgactgtttgggagaaacctacctctcgtgcccaaatcattgcccagtagagaatacattcaaatatttgttacctgtttatccattttcatctctggggctcaaattagataatcccaatttagaaattgtgttacctagcatccatcttttaatgcttaagcaaagggggaaaaagatggttcagtaaattgttcattatttattaccaattttcgtgacaatcttagatatcaaatataatgtgtttgtctcagaattgttttgaccaacaaaacagaagatgtgatttcttgttaccaggtcattcatctatcatgtgccaaatgagcaaataggaagagaagcccagtggttcaaatacgctttactgatgttttccagctggaagaatattctcccagagataacacagctggcaatcctgcatggctctcaaagagcaacactgctttaacatttctgaaaatcatttgaacattttcttaacaacagcctttaaagatggaaataaagagactccctagtggtattattttgtcatccaaaactaggaaaacaaatcatctttggcctgttattttctgttctctaaacttaatgatgagctgccattagaggctgtcaacaacaacaaagcaggaaccctattctgaaaatgataattaagggacactgatgtgttgagcaaaaatcagaagtttggtttcccatttgtaacagtaattgaatatggaggcaagtagggcctcagaagactgacgttttcaggttttctgtctgttcataactaactgtatggcccatgcaatcaatttaccttcttggtggcttggtttttatattatctcagcaatattttattgaatgcctcttataggccagccactttgctaatgactaaagagccactgaataagaaaactagggctccctgctgtcattagaggtacgttatagaagagaaatatatgctcaaaaaatacagtaaagtaggaagtgttagtgataggagaggaagagtgtcttgtgggaacagatgaaaggggacacagcttagaaagttgggtggaggatgtgccaagtcagtggagccctgtcaggtgaaagggtagggcagaggaggaaagctcaggcatttcacatagaagggacagtaggccaggtgtggttgctcatggctgtcattccagcactttgggaagcagaggtgggagaatcccttgaggccaggagttcaaggcccacctgggcaacatagccagaccccacttccacaacttttttttttttaactagcctggtgtggaagcatgcacctgtagttctagccacttaagaggttgaagagggaggatcacttgggcccaggagatggaggctgcagtgagctttgataacaccactgtactccaacctaggtcactatagagacctagctgtctctataaaacagacaaacaaacaaaagagtatatgcaaaggcctggcagctagaaacagcacaagggtttctgaagttcagtgtgttactaagagtctgtgactccaaactgtgttgcaaatatttctatgcaaatttcatgtgtgtgacagctttcatgtgttacacacacaggagctgaaggatcctcactgtcgggatgagatggcagccgcccgaggggctctgaagaagaatgccacaatgctgtacacggcctctcaagcatttctccgccacccagatgtcgccgctacgagagccaaccgagattatgtgttcaaacaagtccaggaggccatcgccggcatctccaatgctgctcaagctacctcgcccactgacgaagccaagggccacacgggcatcggcgagctggctgcggctcttaatgagtttgacgtaagcatcctggtgaggtacacagaggggtgggcactggtgttgacaaaaaaaaaaaatgtattgaggatgaagggccactacaataatttacattgatttttctcttttggaggttttaatagtaagataaactacataatgcatttctgtaatatattggctaagccattatcacttgtctttaaagaaacaactgtggctgcggtggctcacccctgtaatcccagaactttgggaggccgaggtgggtggatcacctgaggtcatgagttcgaacatggagaaaccccgtctctactaaaaatgtaaaacattagctgggcgtggtggcgcatgcctgtaatcccagctactcgggaggctgcggcaggagaatcgcttaaactcgggaggcggagattgcggtgagccgagatcgtgccattgcactccagcctgggcaacaacagcaaaactccgtctcggggaaaaaagaagaaacaactgtatttaagagtgcccaatcccttccaggtagatgagataacttacaggctattttagggacagttcataatttgacgatcatctttattattaaaggggcacatgttatgggcagcctagatgtacgttgcctctatgttgtgcctgcgtgaaaagctgccatcaatttctttgttttaaatcagtgataaagtacattgccctatgatcccacacaggaccctggtcttcattagaacagaccctctggggagagcctgtgttagttctctgaaagtcctacattctacactggctgtttctgtaggtgtgtcctggtgagggaagaagcaaggaggattgttcactgtgctgagccatatgtgaagcatcagtgtgagtgagaaggttgcacgcatgtcatcagcaccccgggatgacagcccccattccccccgggtcagaggacctgtgagaagttggaatttatttatcttatgatcaatgaaagcctacaaagatttataaataattagcatctactttccagggttaaataaccctgcaggggagatgagggaagtagaatgcactaaacaccatttaattgataaaacacaatgttacaggaattcatagaagaaaaataggttacttaatggtcatgaagaaagatgatgagcttgcttttgaatatgttgatgtgaatttttggcaagaaataactagttagcagctggaaaaaaaggtccaggagcaaagcaatgattgttcaaggcttggagatggatgatataactgaggaataattttaacagttcatactcaaatagttcttaccattttcatagtggtctctcctctttcccatatttttacagttagttatatgtatctcacaccatatattatttcctaaggttttttttgtgaggattaaatatgataatatatttaaagcacttgctacagaaatgaagacttaataataggtaattttattcacaaaattgcagcgagcaactgaaaattcatagaaaataatgagagttcaaaataatgtttactttatataacataaatatacaaaaatctctagattttcatcatgtaaaataaagtagaataacgaggagatattcacaaaacaaataatttttaaaaagttaattttattttattatttcttatatctgctagaaataagtctaatatagatgtgaaggacctaaaaagtcaaattatattactttattgagggacaagttttacttgtcagtaaatgatatcatgatcttgagtaggagaactattgatcctatcagttttcataatgttgaagcaatctcaatacaaattctaagaggattcttttggaacttgacagaggagtgataaaggatttttgtttgtttgtctttttttatattctagaataaagaatgaatgagcccatatttcagggaaaagtaaatgagcaggtcatacacacagatattaaaacattgtaatgctacattaattttaaaggtgtgtattgaaacacaaatggactcatccatgaaagaataaaaatcataggcaatctcaaatacaaaattattttataaattggtgtttattaaaattagttaagaatggattatttagtcagattttgacacaattacattattctagttataatttattttataatcaaaaataaacaacaaaacctaagtgaggagctggttaagagtgaaaatatgaagcacagagagaaggcctgtgaacagtccaggaacttcagctgctgccaccttctgtccaagagtgtgacaactgctgcttccccatgctgccttttgtttccagacgattttcattaaaagcaccttttatccccaattaatgtaacaaccgatgcgtcagtgcaacagtgcaaaaggctttcattcataaaaatcaaacttgaggtcatgtggggaaaatctattagcaaagtatgtcaacatgttgaatgttcaaggttttttttttgttgttgttgtttttcctgaagtgatatctcctcatgctggacaaataaggctttggaaatttaacacatgaatataaccatcaaacatgttttttataaaacatgatatatttgaaacagttggaaaaattaaaatataaagtataatatggtaaataagtcactaactatattttattaactttaaacttctatattaactaattatattacttataatattaactcagtatattatatatgaatgaaaaaattatattttatattagctaagtatattaatgaggtaatatattcttattaaatgtatactgtttctcaagctatgagaattacataaagcgttatctaatggtcaacattttacttcttggaggtcaacaaaaatcaaaatgtggaggctgtctgaattgcagttttgaaacaataattccatttgatgtggttccctaacaattgtcatttaacaaatgcaatttaatttcagcactttctcaaaagtagtaatgctagtaaattagtattgaatttacagactgtaatgtgattcacctgctgtagattttccatcacttctgacatcagcaaacctagacagtagttaatgatacttgaaattttctcattaaaataatataccgtttctctttattttatgactaaattataaatttctgttccatagttgtatgatgaatactgtttttttaaaaatttcttaggcatgctaacttgaaattgattttgaattcatggacatctgtcatgagtcctaaatgctattctcagatattaaacaaattgatatttcattgggtgaaaaactcactcaaacttcctgtggtttacttttctggcaaaatctcttactgatacttggtataatacctttctcatatagtgaaaatttaaataagtttaacgtctttgaaatgctgaagtaaaaggaaccataaaaatgcaaaatatattttcatagacagcacagctagtttgccctaaaatttattttttaaaaattttactttaagttccaggatacacgtgcaaaatgtgcaggtttgttatctaggtttacatgtgccatggtgatttgctgcacctattgacccatccactaagttcccttcccttgcccccaccccgcaacagtccctggtgtgtgttgttcccctccctgtgtccatgtgttctcattgttcaactcccacttaggaatgagaacatgtggtgtttggtgttctgttcctgtgttagtttgctgaggatgatggcttccagcttcatccacgtccctgcaaaggacatgatattattccttcttatggctgcatagtattccatggtgtatatgtagcacattttctttatccagtctatcattggtgggcatttgggttggttccataactttgccattgtaaatagtgctgcagtaaacatacatgtggatgtggctttacggtagaaagacttatattcctttgtgtatatacccaataatgggattgctgggtctaatggtatttctggttctagatctgtaaggaattgccatactgtcttccacaatagctgaactaatttacattcccaccaacagtgtaaaagcgtacctgtttctccacagccttgctagcaccaattgcatctatagcatctatctattcttgactttttaataattgccattctgactggcctgagatggtatctcattgtggttttgatttgcatttgtctaatgatgagtgatgttgagctttttttcatgtttgttggccatgtaaacatcttcttttgagaagtgtctgttcatatcctttctccacttttggatggggttgtttgtttttgtaaatttaagttccttgtaaattctgaatattagacttttgtcagatgagtcgattgtaaaaattttctcccattccgtagattgcctgttcactctgatgattcttttgctgtgcagaagctctttagtttggttagataccatttgtcaattttggcttttgttgcaattgcttttggtgttttcatcatgaagtctttgcccatgcctatttcctgaatggtattgcctaggttttcttctagggtttttatggttttgggttttacatttaagtctttaatacatcttgagttagtttttgcataaggtgtaaggaaggggtccagttttagttttctgcctatgactagccagttttccagcactatttatttaataggagattatttccccattgcttgtttttgtcagatttgtcaaagatcagatggttgtagatgtgtggtgttatttctgaggtctctcttctgttccgttggtctgtctgttttgggaccagtaccatgctgttttggttactgtagccttgtagtttagtttgaagtcaggtagcatgatgcctctagctttgttctttttgcttaggattgtcttggctatacggggtcttctttaattccatatgaaatttaaagtagtttctttttctaattctgtgaagaatgtcaatggtagtttgatggaagtagcatttattctataaattactctgggcagtatggccattttcacaatgctgattcttcctatccatgaggttggaatgtttttccatttttttgtgtcctctcttaattccttgagcagtggtttgtagttctccttgaagaggtccttcacatccttgttagctgtattcctaggtattttattatctttgtagctattgtgaatgggagttcattcatgatttggctctctgcttgtctgttattgatgtaaaggaatgcttgtgatttttgcacattgattttgtatcctgagactttgctgaagttgcttatcagtttagggagtttctgggctgacatgatggggttttcttgatatacaatcatgttgtctgcaaacagagaaaatttgacttcctatcttcctatttgaatatgctttatttctttatcttacctgattgccctgtccagaatttctaatactatattgaacaggagtggtgagagagggcagttttgttatgtattggtttccaaagggaatgcttcttgcttttgcccattcaatatgatattggttgtgggtttgtcatgaataactcttgttattttgaggtatgttccatcaatacttagtttattgagagtttttaatgtgaagcgatgttgaattttatcaaaggccttttctgcatctattgagataatcatgtggttttgtctttggttctgtttatgtgatggattacttttcttgatttgcctatgttgaaccagctttgcatcccagggatgaagctgacttggtcatggagggtaagttttttatgtgctgctggatttggttggtcagtatttgattgaggatttttgctttgatgttccttatggatattggcatgaagttttccttttttattgcatctcttctcagtttcagtatcaagatgatgcgggctccataaaatgagttagggaggagtccttccttttcagttgtttggaatagttacaaaaggaagggtaccatcttctctttgtacctctggtagaattcacctgtgaatccatctggtcctgggctttttttggttggtaggctattaattactgcctcaaattcagaacttgttattggtctattccataactttacttcttcctggtttagtcttgggagactgtatgtgtccaggaatttatccatttcttctagattttctagttgatttgcatagaggtgtttatagtattttctgatggtagtttgtatttctgtggggtcaatggtgatatctcctttataattttttattgtgcctatttgattcttctctcttttcttctttattggtctagttagtggtttatctattatgttatttttttcaaaaaattagctcctggattcattgatttttttggagggttttttgtgtctctgtctccttcaattctgctctgatcttagttatttcttatattctgctagctattggattagtttgctcttgcctctctagctcttttaattgtgatgttagtgtgtcgacttgagatctttctagctctctgatgtgggcatttagtgctataaatttcctcttaacactgctttaactgtgtcccagagattttggtatgttatctctgctctttggtttcaaagaacatcttgatttctgccttaatttcattatttacccaggagtcactcaggagtaggttgttcaatttccatgtgattgcatggttttgagtgagtttcttcatcctaagttctcatttgattgcactgtggtctgagagactgttatggtttcagttcttttgcatttgccaaggagtgttttacttccaattatgtggtcaattttataataagtgccatgtggcactgagaagaatgtatattctgttcatttggggtgcagagttctgtagatgtctattaggtacacttgatccagagctgagttcagtcctgaatatctttgttaattttctgtcttgttgatctctctaatattgacagtggggtgttaaagtctctcactattattgtgtgtagagacctattagtttctttgtaggtctctaagaacttgttttatgaatccggtgctcttgtattgggtgcatatatatttagaatagttagcttttcttgttgaattgtacccttcaccattatgtaatgcccttgtcatttttgatcttgtaggtttaaagtctgttttgtcaaagactaggtttgcaacccctgctttttttgctttccatttgcttggtaagttttccaccattcctttattttgagcctatgtgtgtctttgcatgcgagatgggtctcctgaatacagcacactgatgggtcttgactcttcattcaatttgccagtctgtgtcttttaattgggccatttagcccatttaaatttaaacttagtattgttatgtgtgaatctgatcctgtcatcatgatggtatttggttcttttgcacactagatgatacagtttcttcatagagtcgttggcctttatattttggtgtgtttttgcagtggctggtactgggtttcctttccatgtttagtgcccctttcaggagcttttgcaaggcaggcctgttggtaacaaaatctctcagcatttgcttgtctgtaaaggattttatttctcctttgcttatgaagcttagtttggctggatattaaattctgggttgaaaattcttttctttaagaatgttaaattttagaccccaagctcttctggcttgtagagtttctgctgaggagtctgctgttagtctgatggacttccctttgtaggtgacctggcctttctctctggctgcccttaacattttttccttcattttgaccttggagaatctgatgattatgtatcttggggttgattttctcatggagtatcttagtgatgttttctaacaccacagacactgtggccacccctccccctaggggctcaggcccagagagatccattttctgtccctgagtctctggctggagttattagagttgctgcagggaagccccacccaatgaggatggatgggtcaggctcaggcctgaagaggcactctggcagcagtctgccacagccggtgtgttgggctatggggaacaagtcttgggaccaagctgtccagcctccctggctccagcaggggaaaagcatggcctggagctatagaaatggatgtcacccttacccctcccaggaagcttagtgtgttaggcagttgtacctcccagggctggctgctgcccctccgccaaggagcataaatggcttagacagcaggcagccacagctgtggtgctggtcactactccccctgggagcttggcaggcttaagcaggttccagctgagatgctgctgagaatctgcgtagctctggggttgggatgctaggtgcctgtagcatgggtttgcaagtggcgtcttccgatccgtgggttgcacatttccatgaaaaaagcagttttgccggctgtgttgcatgctcactcactgccttccttggctgggggtgggggctcccatgccccatgtggctctgaggtgggccgcaccaccctgctcttcctctccgtggatcacgccagccacctagtcagttctgatgagagaacctgatactttggttgcggtgaaggattcatacgcttattaggtttcttttcaatgggagcctccgatcgcctctgtttctagttggccatcttggtcctgccctcccaaaattgaatttgaaacacacttcatattaatagtcacgagtgtgtcaaacccagttttatgggaggctggatgcagaagtgtcttaacattttatagttgatgagaacaagataaaaatagtattttcacatttatttgtctaaaattacaggattgatttctatctgagtagttataattgtggctaaatgcttggtgacctattttctggcatctacatgaatagttgatgtagtgatttatgaagcaaaagaatgaggaaaaaagcagtattttaacaacttgcaactgtcaagagagtttccaatgatataacagtaaaaagtaaaataattgataatcaatggaaaactcagcctctgtttagatgtggcagcttgagatggtcaattttaatctagtaaaactatctacaaaggaatattcaaaagatttaagaaaaatatagtgactgctcagaagtaaaacataatgtcgattttgactgccagaaaacaaactttcaatagtgggagagaggaatgttaaaagcaattcctacagaattttcttattttattaaagaaaagagagtataccatatcttgtttttggaatcttgttttgtagatgaagatactttcaaaaaatttcaactgacactgttcatgaagctcctttccaatatctttgagatgcttcaacatctcaaagatgttaaattatttaaattgtcattacattagaaaggtattacaccaagaatcagtaataaattttgccagaaaataagccacaggaagtttgagtaagtttttcacccaataaaatatcaatttgtttaatatctgagaataacatttagtactcaggacagatgtatattacaagctattgctgtaacaaattaaaagtgacaccatttgcaaaggtacattataatctttagctattcaccttttaaaaatgttgttttcttttaagtcagacagtacacattatcttgacttcttctaacatttagctttctatttgtgatttgctttctttctcccaacttgccctgggaatttgtttgactagtaattctcttgttcttgctccttcagtttctcctccacttgttccatctcctcaacctacagaaaatgtattccaattctaacaacctaaaaagaaaataaagcattgggctgctaaaattaccatattgccatattttcgttatcttttcttttcctgacaatccacaatcctctatgctaacctcggttcctccctgctcctcaggcactctacctgagtgtctccagagactgtcactcactcacaaaattgataggcttttattttctacttttcgaatacttcagctttggaagggagcacattattatactgaccatgcctcctctttctttctattaccactaatatctcttgtaagatttaaatatctgcacttgaggaataagacattctattctcaaccacattaagctgaaatgttaccctggtatagcaactctacataagttccccgtcctatttttacctaattttccctacctgcctttaccttcttacattttcttccctttttcatcatctctttaaatatgcttttttttttttttctgttcttggtcaaattgtaattctctttccgatctggtattcagtggatggaaatattggaatgttaacatgagcagtgatgcgacatctgcatctcagactggtgcacggaaaaataatccctggctggcaagaattgtatgtaggctaactgtgaggataaaataattgtctactgggggagcacgggccatgcttctgtggtcactgcccaaagcttatcccagttgtaggcttctctgggtgcacacagatattcaaggagctccaggccaaagaatgaagttcagccgtagtagttcacatggcagcagtcatttcaggttcccagcccatttaagggacattaagaggttgcaggacctttgaggggattcacaacccaagattagtatttggagatccagggttggagtgcattttcagtggagaacgaaacgctgtataggtaagtcagaggcccaaatataagacctaggagatctacactgaaggcttccgaataagtgagggtttttctgttgtgcctccatttcaaatgccacttttttatgttttttgagtattgtgataatcaattcttattgttcctagaatcagacagatactgctgtgtaagctctggtcccttaaggggccatggcccagagttctgactggctcatggattcttaatatgctttattgacttatgatttcttcaacatcagggaaggataagtgtctcctgggaaaataaaattttcaccaaggatcttgttctgtcccttctcaattctagtatttccttttgctgtagcaaccaatatacttatttatcagggaaacttgccccaggccttatctacttcgatattttataaagtcatttgactacagacatctagcaaccctccatgttaggctatgaagattgtaagtttcctatatcttacattacattagaatgaaggtgaagagttgagatgacagggcccttctattaatgctccataataattatctctgctatgtgtctgagaagtgattcccactgaatggccaatagaagtaaccaagaacactggaaagagtccaggacttggattcaggtattggctactactccaagctctacaaataactaagtatgtgtaagcatgggctactaagcccatctctaggccttggattttatatctcttaggataaggtttagccaccagatagctaagatcattcattcaaagtgtatatgtgccagatgagatagaacaataagggagtgtcatatgtaaaaggagaaaatacttagtaaacagctatagacgctgcaatgcataaatgctgctgcatacgcttacgtatatagtatccacttaacctattatgtgtgcgtaagggggtggaattgggcaagatgaaattgtggaataattcttggaagaggaggtaaatgagctgcatctaaaggctaagaaagaataaacatgatgaaatgtgaatgagagtatttctcaggtagaaagatcatcattgcatgcagttgtatggtgggtaaagcctgcataaagtgattatttctggggtacagaggatggggaaaagtcagtctaagtgggcaaataggagaccaatcctgaagagctattcagccttgcaagtggctgggcttcatgctgaaggccttaggaagttactggtgatctaaagaaggaaatggcagccaggcgcggtggctcacgcctgtaatcccagcactttgggaggccgaggcgggcggatcacgaggtcaggagatcaagaccatcctggctaacatggtgaaaacccgtctctactaaaaatacaaaaaattagttaggcgtggtggcgggcacctgtagtcccagctactcgggaggctgaggtaggagaatggcatgaacccgggaggcagagcttgcagtgagctgagatcacgccactgcactccagcctgggtgacagagcaagactccatctcaaaaaaaaaaaaaaaaaaaaaaaaaagaaggaaatggcatggtcagacttgtggggtttttgttgttgtcgttgttttgtttgtttttgtttttgagacagggtctccctctgtcacccaggctggagtgcagtggcatgatctcaactcactgcaacctctgcctcaagtaatcttcccacctcagcctcccgagtagctaggaccacaggcacaccaccacacccagcaagttttggtatttttagtagacacatggtttcgccatgttgtccaggctggtcttgaactcctgaactcaagtgatctgcccaactcagcttcccaaaatgctgggattacaggcgtgagccacagctcctggcccagacttgtgtttttgaagatccctgtggctgcagtggctgccggggggagaatgagtttgaagaagcaaagctgcagagtagggagacagataagcgtgagaaattaggaatgtctgcagtatatcaatagagtagaattaggaagaagtgggtgaatctgaaccatactgaggaagtagaatcaacaggtcatgagaattgtactttttatttccatatattgaaatagtgttttgtattgtcatgtaagctttagctaattaaaaaaccaaacattttctaggtctaattatgaaatcttgagaaatttcagtcattttttggaaaatttgatgtttttacataatataactttcttgcactgatttttttggctcttagttcatttccgttcccatcagtatgattgttaaatccctagtcatttatgcagatattatatattttgaatattcttaaacaaaattctacaaagtctaggatttttctaacttaggttaatctgtttgtgcttaattgggctcctactatgtgcttagcatgctctttttacttcttaaaaaagaaaaaaacaactttttgatacttttttgaaaagtggagacaaacttttccatctttagggcatagtatcagtaactgatgcttagtgggaaccagaaatcctcacctgttcatcgtatcttctcccagtggagtaccttccaaatttatttcttctttttcaatggcaaattaaactcatcaaaactgccttttcaattctttctaactggaaacaagcaggagcgttccagcattctttatcctacactgacatctggtggccaaacaaagcattaagaaacactcctgtgggttcttagatccctgtaaacatactacaatttatatatgtaatacgggctcaaacccaagggatgcaaatatggacagtgtgtagtcatccgtcaaaaagtgtttagtctacctatgacaaccttctgaacactaatgttatgcaatgcaagtccagctaattcttaaaaccatccctacctctgggatggtgataaagatagatgcaatacatgtgagcttataggaagaggagtgcaaggtagggtggtgagtcaaggctggttctgctgggtgcttggggaccaggttaggcatcatcgtagacaacatagtcttcactgcttcctgagctataccgcttcactttccagaatccatcttttctgcccagaaatctctttccgggttattgacacctcttgtataggttatcgatacctctgatattgcttctaaacagcttttctttcctaaggttttataaatctaggagtattttctgatagaatcatttacctttcaatttttttacttgctttaagaaatattccaaaacaatttacttttctcttgcgcatttcaatcactaaagatctctaaaaattgttgagcaaataaaagaatgaaatttgaagtacttttttttataattgcaatttatatcttgattttttggccccctatcaggtttaatcaaaattattatatttccaatcttgggttatttcttgaggcagcgaaaaatgtaagaatctgttttcttcctagtgtgactgatttttgcttttgagaatattgacagattctttaggtctgatttcacctttatttcaagttagtaccaaatataataatgaatactgatgtaattgattatgatattcaaaattgtctaacatgtgatggcaagtataattttgattgtcacttatctattagttatactttttcaaatttcggacccaaataaggccacttatctagtgaactctttattagagcaacatgtggtttatttaaaatgtttgattttttaatctttaaatacatttaatactttagtctttctgtgtgatttcttatgttagtactgctaatctttacttctccctccaggattatgacttctcgtgtgcttcctatgttacagtgctgggaacgtgatagggagttacttaaatgttctaagatttagtttgattcagtggtgaagtaaaccacacacaaacacacacacacacgtgcaacaactgcacgtgaagcatccatttggatttttcaaccatactgctcaacgtatttcctgaacttcttttccagcagaatattatggaaacttcactataacctattgagtcccattctttatttccccaaatgttctctgatactgtctttttttctgattgtataaattcattgagctaaggctgtagaaaaacaattactcatatgcacgtatgattagcaggcacccaacataactgagaacataaatagtcggttgtggtttgacctggttacattggccatgctaaacaatggtgggacagcatctcatagggcagagaacaggcttgtgtttgaatcttaccaaataactcttccctctgtgcctctgtttcttcatctataaaatgagataataatgttgactccaagttggtggtagttttgtgggatgaacatttatatgtgtctaatctatagtaggcactcataaatactagttttcttcttctcctacccatcttaatagacgtgttggccagacatctttcatccagattcagctgtgaagctattccctagaaaaaccctgggaaaaagctcctgactgaaaagttgttatgccactggagagtagctattgatattataatgtcatttgctctcccttgcctatagccaaaccctaatgcataacagactccaaagaaggtctggccaaagcataaagcagtcttgagaggctggccattctatgtgacaggagaaattccaaacagattaaattacctcttggtgtaagagtgattcttaacgtgagacctaacaagtccagtgtgaatactaagaatgtaagtttctccattgtgtctatttgggaattcttattgcttaaccagcttctgatgctgtgaatgccatttttagtttcacattaaatatgagatttcttctgctttgttggtctctgaagattgctcagcgagcacctggaataaagaggagcgaatggcagaaagcgggtagggataaagggagaaaagatgacatagactgtggtccctgatgaatccaggaaccacagcctgaagcagtttatcgtattttaaacatgttctgtccaaaagatgctgccaaataatcatgcaatctaagaatgtgcatggtatgcaaatgcagtttgaagacaggtcctgtctccctcccaaccagattgtctcttccccaagtgtcctgtgaaggagtttgaaactgacactgcttgttttccaggtttagtactttcctcactttagcagatcctatgaaaggaccaggaaaacattatttctccatccatctgtttgaaaatctcttgctgttatcatctacaaccttaatcatgcttcttaagcttatttgggacactgaggtctacactggtgatcgtctggatattattttcttttcctttcttctcttagttttggcatctgtttaaaaagttttaagataatctttcacaagtacacagcatataaaatatgttgtctcagtttgtttgggcttctgtaacagaataccttagactgagtcatttataaacaatggtaatttattgctcatggttttggaggccagggagttcaggataggtgttgacagactcagtttcttgtgagcgctcactctgtgcttcaaaggtgatgccttcttactgtgtcatcacatggtggaaggggcagggagcccctcaagcctcttttataagggcactaatcccattgataagggtagatccctccagatatagtcaccccacaaagcccacacctcttaatactatcactttgggtattaaattccaacatatgaattttgagggcacacagacattcagaccataggatatttggacatttttctatatcaaaataaaaagcgcagatctttacattttacagcttcatttcttccaggagatgcccatacatattacttgagggcccaaatgaatttatagttgggaggttttaactacagggtttcctaagatattttctgtgcctaccaaaactgaccagatttgcatggaagttaagaatcgtgttttattttaaagcaagtacatggctaatcttctcaggtgatgtatttgagaactgaatcgctgtgtagaatttttgctctaattaatttgaatatatatttcaaagattttaagatcctacattttaacaacacaatcttgtgtttggcacaagtacttaagataaaaaacatcactgaccaaatacaagttttccatggacatttttcttttacaaagatctgtcacagatttgaagaagatgacatttgtagagatctgatggagcggtaggtctcttagggaggagaagataacgcggttatctgccaccaacccccagagtgtggcagccctttggccagtggatgcatgctgtttttattttcagattctctcaagtctacatgtcagaatcactttcaaaatctggatcagcaaaataaacttaaaatgacataggcaaaggcacacttaataaatattacaataccttagaaattagttttcctgaagtaagtaggaagaaacaaatttatactgaaaatgcaaaacaacctgaaaatatatatatatatgtcaaaatgcttatgatttttcttttgagttgtggtgactgtgaatattttttcctatttttattattttccaaacttttttccatgaatattctttaataaaaaatatgcatagtatttgcgaaaaattaaatctgtttacagatatgttgcaaatattaaagtagtataaggaacactggtatgtcctttattaactattgttaatattttatcatattggcttgtcatttgtatacatgtttgctcttctcccatacacacactccttaactatttttaagtagataaaatcaactttattttacatttttacatccatatatatacatacagacacttcagagaatatttctttgattctgttaagatttgtggatttatagaagagttgtaccagagctcctgtaagcttgctagttttgcctagtttaagtattaatttaatggaaggctatgtataacaaaacctctgcaaatattgactttagacagtcatggccatgaaacattgtgtccctgcaaataatcactaaccaaagttatactaattcatgcacgcctattctcattacctgtattaaaaaaaaaccccacaaaatagagtaaaatttgttcctggtggattatgaaataatactgaaaactttcttttccgtattttatgaacctttacttaagaaacattatttaaaatataatagaatgtgatttccaattaggtcagtgtaaataataaaacacatgacattttaaagatagggcacttgtattttatccccagtaggggaaagaaagagaaagagacaggcagacaaagagacagacagagatctgcataatccattcatttctgaagataactagctactatgatgctgcatttcttttctcataggcccataaaacttcaaaattgagaaagatatttgaggccatccagtatcactttcataatattggaagttcccactgcaacatccataacatctggacttttgtctttgcaggacattattgagaggaaatattggggtggaggcagatgacttgttctaattgttaaaagctctaattgttaaaaataaagaaagagtttcttcttacactgacatttccaaagtaaattaccaaagcactatacccgtccctgattgttagactttaccacattattattatggtcacagacatgtcttatttccatgacgtggctgagaaatccttgatgagaaaatctcatagcaatctctccccagatcacttttcacatatgataggtagtaaaaaaatatttgagaatagttgattgtgccagactgttgtgtctcattatgaaaaaaagcctgttaagtgatatcttttccaccgttttgtcctccttcagcccgttttctcacatggccactaaagttaactttctaaaaatcataggcttccatgcctctcttctcttctgcttacacaagaatctctttccagaggtcccactcacaactacaagtaggttgacttatttttttatgggattgggaagaggaggaggctgctggttcttgtgaggttttcaagtggaactgccttggttacctctttggttaaaagttaaagatattaagtttcaatatttgttactttaacaaaatgtatgctatacattgagttaatattgaccaactctttaatttgggctccccaattttagacatttacaatccaacctaaattaatatatggtggccaattgccacacccttgaaaaagtaaatgatgagtttattattagagaataatatgctaggaaataaggtataaatcatatgtatcagtctttgacccaaaagcttccaacaaactgattctcaaaccagtgtaactttgattttctattacttttgctaatgtcaacaaccctaatcctgcagtttgttctttagagatattttaagtcaattatgctatttatgtttttacatttataattatacaaataatagttttttagactaactttatctgaggataactaaactttctcctgagctctagacatctgtttagctgtgtatgtaacatctgaatttgaatgatttttaagtatctgaaaaattctctaactaaattgagcatttttattctgtcaagcttaggctgttttcttcttcttcttcttcttcttcttcttcttcttcttcttcttcttcttcttcttcttcttcttcttcttcttcctcctcctcctcctccttcttcttcttctctttcttcctcttcttcttttttaagctaaaggaactacgtttggtaatatagccattgaatccagaaaactgagaatcctgcccacttttctctccagttaaccttgatatgctatgaattcagttccctttagaactcttgatttgtttctcccatcttcatgaacactggctaatcaggcccatattttttgcctggatcattgcaataacttcctaactggttgccctgccccccgccccaccaactccttccctctgtattccatcatcttggtaagcccagcctttctaaaatgctagtcacatattatttactagtaaaactctgtcttcaggatcaactttaaagctcttagcacagtaccaaatcgtttccgtaggtccctgcatacatctcccattgcatagcctccttttccacacattgtattccacattctgccgtaatgaactgtttatcattttcaggtacatagtcactgtttaatccatgtgttggccctcatgggagttcctctgtctgttccttccttcccttcttttctgaataataaatttatattcagccttccagatctacttattttttgaaacctttcctaactaccccaatttctatgccactattccttctatgctactattgtactttatgcatattgttaagaatattgttctgttttttgtttctgtctctccaaatgtgagcaccaaatagacagagatcatgtattgttcacactttcacatgcacttttagcacaaagacattaaagaaatatttgttgaatggctgcttaaatgaatatattaactgtttgatcttagtagctatcagtttatccatcctaacttctcagtcttctggaatgttggtatatgccataccaatcacaatagatagcccatggctacatgatcatgctattatgttccaatgggcacgcatcatcttcttgagttaactctcttagggcttctcttttccagtgttacacagaaaatctattatatataatttaaatgatcgttaacagatgtgcatcacaattcagagttcaaaagagaacatgacattctcattaagcaaaaagcgtattttcaggccatgcaatgtttcttgagaagcaattaacatatcacacattattcctgtgagacaaaaactgtttctttcccatcttaatttgcctgcttaaaaatagacagaagaagatagatgagtttatgctcaaggtgtatgcatttcccttgcggcccgtgaacacatttccttttcatatttgcagaatattggtacaattattctttcatcagacatgaaatttgagtgtataaccagtttgtggttatcacctactaatttattaggttgataacagcaattaagccacaattgcttctgagaaatatgaattgactttccgttttaaatggataatttagcatctcaaaccaccgacatagagtttaactaatttctgggataagaagtttgtttctcctagtattaaacttaaaaaaaattcaaccattgatcatccagttactaattatttaattgtgggattatgtggtttgtgaaatttcttaatttttttttttttttttggctgcatgccttttgactatttatgggtatcgtaagggagaggattttggacagaaatgtaacatatcagtagtaggcccatggtttatccaccgacttaaaaatgtaaaaattattattagctttataagcttaagaccatataaaaatgggcagcagatctattttggtccacagaccattgtttgttgaccctggcttaatcaaatcttcagaggagattctcagaatttaccaaccacaggaggtggctgtctcagctggtctcctgcccattgaaagtagaattaggctgagtgtggtggttcatgcccataatcccagcactttgggaggctgagggaggtggatcgcctgagtctgggaggtcgaaaccagcctgggcaatgtggcaaaacgctgtatctacaaaaaatacaaacattagccaggtgtggtgccatgtgcctgtagtcccagctgtttgggaggctggaatagaaggatcacttgagcctggcaggcagaaattgcagtgagccaaaatcgtgccactgtactccagcctgagcaacagagtatgagaccctgtctcaaaaaaaaaaaaggagaactaacgtttgtcatatgacaataggttactcatccccattccaataattctgaatctcaagtacactgaaccacatcaattgctactgtagacctaaatgtacatatctaactaaaaggccatccacatatattcatctgcaaatattaggttcactgtagtgacctattttgctccagaagccttttggtaaaggttgggaaaaggatattcttgttttaggaatcctgactccactaatcagcaaatgtttatcaaatacttatgtatgaaacattcagctgggtggagcagaagataccgacctataaggaaagcatcctaactggtgatctgtttctctcacacacacgtgtgtgcacacaggcgcactgctgccagtgcatggtaatatcagacaagagccaaaagggaaatttgaataagtgaaaagaagcttaataatgggaattaaagaggaaagttttgtacacaagagagttaaagatcgtgtttccagagaaggatccacatacgctgccaagaagcatcagagaggaaggggctgaaacagtcagcagagaagaattaataacacggttacacatgaagcatactggggtggggcaatgcagagaccactttggcaggagccgggggttcatgaggagagacgaagtttgagaggcagagacttgcgccggattgctgagaatcttgaaggccaggcatcttagtcatgaactgagtagaggtgagattatattttttttacacaatgcttgctgaaaatgacatctcaattcaagggctggatgaaaatgcaactcattgctttattcccttatgaattttgatataactcacaaaattaatctaatagaaatgaaattggagaattactaggtaagagtccagcatctgaaacttgtcgggtcctagataataacctattacaggccatggggagccgttgaaggtttgaggccagtggggtagtgtggttaagcaggattttaagactaggctgttaggaaaatatgctttaccgagaaaaaaaaaagataaatttaaagtctcgatgaaggaaatgggagatgatcatgacttgaataaggggggaatatggactgaccatggaaatataaagtattacattaaaaatagctatttgaaatgatttgatgtttaatatctataactcactacatttcatatattgttcaaatctctttacttatattatttaactttctcaacaacactgttgtataggtactgctaagattcattcctgtttttcaaatgaggaagctgagacgcttttagcatttaagcaacctactcagctagaaagaattacaactagaaggaattggagccaggtttctaatccaagccatctatcttagtccatttgtgcttctaaaaccaaatacccaagaatgggtaatttacaaagagcaaaattttgtttcctcacagttatagcactgggaaatccaagatcaaagtgccagcatgtttggttgtctggtgagggttgttctctgctcccaagatggtgcccttcccctatggaggggaagaatgctggatcctggtatggcggaaggcagaagggcaagctagccaaatgctccttgaaacctcttttataagtgccttaatccagttcaaaagggaggagccttatgtcccaatcagctattaaacgtgccacctcttaatattatcaccttggcaacacctgaattttggaggtgacacatgtaaaccatatcaccatccaactcttaacccctgtaacattttataccttggtcttagattatatatatggtttcttttctttcttttttctttttttgagatggagtctcactttgtcacccaggctggtgtgcagtggtgtgatctcagctcattgcaacctctgcctcccgggttcaagtgattctcctgcctcagcctcccgagtagctgggattataggtgcccgccaccatgcccaggtaagtttttttttatttttagtagagatggggtttcaccatattgagcaggctggtctcgaactcctgaccttgtgatccacccgctttggactcccaaagtgctgggattacagatgtgagccactgtgcccggccggtcttagattatattgatgcttgatctttcaacataggttcccaagagaacacagctacaagtgcacgggccttggagtcagaaagacttctcaagtcttccactgtgtggccttcatcaagtcacctaacctgaccgaggaacggttcttgcatttataaagtgaagatttctcattaattctaatttctcattaggagaatgaagggagattatggattcttgtttcccttctacttccatttttcctccttataagtgagagtgttaggttttggaggaaaatgagaagtactttctcatacatctgatatttgaggtgatggcagaactcccaacagatcatgtccagtgtacagctgtagtaagggccagcttcttagagggtcgggattggacatggtactttggttctctttcacaagcaggtgatagtagagagtagttgagccctctaagaaagagttgttgagaggactactgagaacagggagcagggccttgagatataccaacttactgaggtagatccaggaagaagaactgggcaagtgaagggaaggaggagtatgaatagaaccacagtaaagcagggttttgtaaagcataggggaggcttaacttagtcagcgggtggtaaattgtgttcaaaacacacagagctcaaagaggatgaatactgaataaaaacgatggtcaagaatgtagaacgttccaggagactagagataacatgactgttttttttcaggaaaagaataaaatccatttcctttgttaagccctctaaaaatctgatttgattaagtgcattttggatactcactttctaatcaattcataatataaagctaaggattattatctttgccctgctttacgtacttaattgtaaactagtatccttgtcggagctagagaatgtgctcctgaaatgccatagcaactcagcaacacacagagatgatgggattagggaaaatgaagttggcatccactagatttcacaatccagtaggaacagcccagagctgaacttcctcgcccagtttattcatttgctttggtaaatcactttgtctttctaaatataagcttcttctcaaaaacgaagctaatgtgagcttaggtaaatttctcttaaaaaacacattaagtatctaaggatagaaagtgctgtttaattattaagtcattatctttgtcatttatttccaattaaactgaactgtttaattacaaataacatcttaagtagataaatggcataattagtttatttttaactatatgcctgcgaagcaaaagttatttataaaatactttgcaatttaaaaattaaggcaaatctaaaatggtggttagaatttttctgtagcttaataaaaaatacatgattaaaactcaaggtccttggtatctttcattcctagtgctaccccaattacgtcaagagaaacttttcatgtaaagatagaaagattcaccctgggaaagcttggcacagaatgaaaaagatgaaaatgtatctgtattaattattgatacactacagggagagtaagtgtttaaaaccaaacaaataacattcttttgatttagacacctcggttaatttatttaaatgatcttgatttatgcttttatctcagagtccagtctttaaaataagtatttaaagcattcagagccagaattatgatcatgcctcattgtctataggtgtctttcattctcaattttcagtgctgtaaaattccaattttatttccctgtttataggcattttaatgggaaactgggagaggctgcctcaggggttactagtcaagtattttaagctggatagcaaacttttttctttgttttaagaaggattccatagtgaagagttaatcagtaggtattgctggacttgtttatgttgttttgtttggtttgggattgtatcagtgcatcaaaataacataatgaataaaataaaatgctttaacaaattttgatcccactaaagctttctgtgacctagacacttggtaatgggtcaacacagcatgaagtcctaagctaaaccaaagctaacatttctatagtcatgctcagtcactgtcatatttcacctgacctatggcatcggtacctgcgactacatggctttgccccctcttcgttatgtggaaagaaacagaatcttgaatttaatgcttgggaggaagaaggaaggaagctctgtggtatccgtgaaatataaaacttacccagttataccccaagacaaggcaaaccacaaaatttaaatattaaaaggtaaatagaagagccaataataattcataatacatttaaaaataactaaaagagtataatgggaatgtttgtaacacagagaaacgataaatgcttgaggtgatggacacctcatttaccctgatgtgattattacacattgtatgcctgtctcaaaatatcctgtgtaccccataaatagatacacgtactatgtagccttaaagactaaaaatttaaaaatataaattttttaaagggtacatagaatggggatgatgattaagttacaaaagacagaaagtgaagacatgggtacattgtagcacattgctgggaaaagctcagaataattaatggagaaatatacctacatttaaacatgcattgtcatttaggttttctggttttcattgctttaattgccccatatcagaaggacatattcctttgaaagaatgactttgactaatgttaactttctctttcagttttttttttttttaagatttaaaagataaaagtgaatgactgcatagaggcatgttgacatttattctttcttctgcttgcttgattcaaaatagtcatgctggacagcaggtggtaagtgcctggtgtttatgaggcagaacagcaatttactattttccttacttgttgccttgaactatgaaggtagtaaaaatccaggacacatttgtcttacagaattgtcacaatcaacaaagaaaatcacagaatcacaggactttttcataccactagcatttgcattttccatgctgattagcttagattttggaaaaaaagttatgaaaatcagccacactttatattatcaaattgctttctttgttgtctttcttggcattttgaaaattctgtgtacgtttcagatgactaagtagttcacttaaaggtttaaccaatgttgaaagccagaaagtgtaaagatgagtaagattttcttcctactctttaacaagctgtttcttggctagtaaagaccattgtcagctgtgcactaaaagtctttgaaacataatctgtgggtaaaaccattgaattagtgttctatgtgtgctagagctttcctactgacttaactgtaattaaaaacattactttatgctccaggtcttgtcaggtatgcccatctttctcaattacagctgagtacaattagatacaaactcagctttaagacggttaactcctagccaaagaaagactgagcaatatttgtatttaccttcttggtagaagaaatatattgtaatacctactgaccagtttgaaacagaggtgaggattaaaattaggagaaagtagcattttagaggttttattcctggtgattatttgctgtttttgatcccctcttgaagtatgaaagaataatatgctactgtgctactgtgactttagtttttgaaatggggaaatggctgttgcattgattccctcacgatgattagcatcgtgcatgcagaaaggatacatgaggtaaacaattagtgcagtggctaagagcatagacgccagagctagagggcacgcatcccaattccagccctgctctttgccctgaggtcatgcctgcacaataattcatctctctgaacacatttcttgctacatctacttgacatctaggtgtgtttttttgctttgcatttcttgttattggatattaggtcttcctattgggtattccttgtttatatgaaggcgatagattttgcatattaatacaggtgcccataccactacccgatgttcatatacttataatcaaccttccaccagacttctccagttaaagggctcataagaacttcacctgctcttcatctgttatctttcacagttgttcaaggatcagcaaatgttttcttcctcttctttttttttttttttgagatggagtctggctctgtcgcccaggctggagtgcagtggtgcgagctcagctcactgcaacttctgcctcccaggttcaagcaattctcctgcctcagcctcccaagttgttgggattacaggtgtgtgccaccatgcccggctaatttttgtatttttagtagaggcggggtttcaccatattggccaggctggtctcgcactcctgaccttgtgatctgcctgcctcagcctcccaaagtgctgggattacgggcatgagccactgcgcccggtcagcaaatgttttcttgaagggccaagagtaaatattccaaggtttgtgtgccatacagtttctgtcctaaccattcccctctaacattgcagtgtaaaaataggcatagacagtatgtaaatgaatgagcctgactgtgttctaataaaactttatttgcaaagtaggagtttgactcctaggatgtagtttgctgatatctgcattattggtgttgttagtgttagaggtctaggttttatctttgtctccttctccctcattgtcatagcctatatattttcaaatcctgccagattgacattctacatttttcttaaattcattaccttctctttatccatatagacacaatcctgatttgtagtttcctcacctctcttttgggctctgaaggcttgatgctgtcctgccttctgcttgcagtcctgccaaagctaacttccttagctgcaataagaaactgtctaaacccaaacaggattatgtcactcctttgctttaagatctctgatgattcatcattgcctaaaggggtgttctcaaattgaaaactttgtaacatggcagagaagtcgcttcagaacctggttctttctctctctccaactgcatctcccattcctatttatgtccattcaggcccttgaggaagcaaggtagatgggattttatgtataaggaggaattgcctgtgaaggataaaataggagtgactgggcttttgtggagcttttagactgctatggggacaaacacctttgaaaggagagcaggaaagaaagtggattgagtaggaagaggctcagcactgttcccagcaagtcccagtcaggccagtggggagcccggatcaggagctgaagctggtcattggaggagtccctgttgggcaggagcatgcgcctgtgcttagtgattgactggcgctgcctggggtcaagtgcagcctacacatgagactgcagtagaactacaggtgcagcagatggagatggtcagttaactatgccccccagcagtttaactcagaggagagtggcttggggcccctctatggcaccgtacatgtgaccagcttcagttgatctcttgtaatatttttcatataatatgccatctctcacctcctagcccatctgcattgccccttcctgctcctaactttgcttggccaaccgcttttcactctttaagtctcagctgagggataaactcttctggaagtatttttttactttctacctctcaactgtgcaaattgccatcattcagtcattccataacatcattagccatttctccattacaattggttgtacatatttttgtgcttgattagagagtcaacctcttgaagaaaggattatttaatatgtgctcttagactcctacagtaactggcactcatttgttgaatgaatgattatactctcagttatctattgggagggttaggtgactcagatagcataaaaaggacagcatgacagataatacttaagtattatatttaatttaaaagaattaaattttcgttttaaagtaatatactttataattgtaattatgacatattagactcatttcacctaaatgtggacaatcttatacagttgaaggaacactgggcttgaaatcaaaagacctgtgctcaaatcctggtgaccttatttgtgagctgaatgaccatgggacaacatctctggcatcatttccctattcaataagatgggaagatagggatctcaaagacactgcattttgaacccatcaaaccatttgtaatacatccaaatacttgctttgatggaggtctgtctgttttctcctcttatgtcagagcttgcatcaagccagctcggtgtctcattgtatactgaaattttagatcacatagctttttgtggagacaatgaatgataagagcaatttaaaagtagtgctgttacaacaattgtgtgtgtggtgagtgctggtaaatgtattattctgggaagtagtttcgaactacatagtctgctaaattattttaggttaaaatttttatagagcgccacatgagagcaaatgggagatcaattatgtgagactagagagactgttatagcaccgacttgaaggcagaataggattctagtcttgttggcttgggggtgaattattgtggctgttatctttatgtccatgcattccaattgccactccataaactgtaagaatgaaaacaataattttttaaagtagagatgttaataaaaataagtaaaactcataaagcacaaaatagtatgcaaagcaaataagcaaataagaaaatagacatgataaacatagattaacttaaaacataagaaaaagataaaataagaaatgcaggccctctatctgtaaatgaactaaaatgacaatgtaagatggaactaaaaggtcaaaaagataaaatgactaaatgagctttaagaatgccgacaggagatggggatatttacaatgtaaaagaatgaactaaaataagtctgtaaagttgtaaacagcataagagccggtcacaggagcatacttttgctgcgaagggagagacaggaaggcttctcctcatcctttcactctttggtgttggtgtgctgccctcttaaagtattcttctgtgaccagggaggggaatctggctcctggatgttgatgatgatgatgatgatggtgatgatggtggtggtggtgatttggtgccccttcctgctagcagagggcagccactcagagaggtgaggacaggcagagctggtatggagaactgaggcctgttagagccctgtgttcatggctgtttgctgatctgaatgtccctgaagtgtgttaggatagatggcttacctgggtgtttcttagttttttaattactttcaaattatacaatggcaaatactcctccttcttttcactttttcattctctgtatatttcttgctcaggatggattcatttccaggggttggttttttatttgtaggaactatagatacagccttttcctctagctcttgagcctctggtttcatttctgttttttccttattttctcgcttgttggagcctgttggaaacctggccaattctctaaaaacagacagagacagacacatacaactacatacacacaaataagccacagccccttccatacacatgcccgtgtgcatatacacacacgtacacatacatgcatccactccacccatgcatacatactgtaccgacccattcatagattcataaacacacacacaaatagcacatatcttgccccatacacacatacacacacagctccacatacacacaaccagtgcccatctcatccgggatacacacacacacacacacagacacacacccacatgcaatcagtacctcttcccgtgcacatgtgcatgcacacacttacacaggcccacgtgcactggccttttttctttgtgccttttgtctcccgagcggcttctccctgctgcttttcacatccatcattgcaatgctccccatctgtactgcagatacagatctgaatattgtaaaattattgtttcttttccagggagattttttaaaaagcttttccactgtgatctgtaaataatgaataattccattagaaatgtgatggatagtgtaacttttatgcagagtttgtcaagctcaatgtttcaggcttttactttcacaacagccccaggccatggcaggtaggaaactcaattggctgacactccaaagtctctcttgtcacatttcccaaagtgtgttccttgggttctcatagataattcatgcgttttaaaagcagcactttccatgctcgaatagatttgggaaacgctacagtgaactgactcctttagtgcagagctccccaaagcatttcatatgataatttgctgtaggtcatgcggtatttccaaaacatatttggccagggaaccttattttttcatcaaaacattatatctctaagctcagtgttccatggaaaataatttaggaaatagtattctaatgacactagtacattctctctactgcagagaaactgttttacaattgtccttactgaagagttcaaatttacctccccatatttccatcacatttgcagttcttgacacgtttagtcctaaagtacaataaatacctgttctaaagccagtatatgattctgaagagtctcctgaaatcttaaagcagaacatatggttttcattatgttttatgttaatatggttttctataaaataggtctttgaaaatcagtaatctttataagtaagatagtctaattatatttttaccaggtatttcttcaattagaatattatttcttaacgtatattatatggattatatatatacacacacacacacacacatacatatatacatatgttcatcataaatgcatcaacagaaaggcagtagaaagcgagagagagtatgtgagagaaagagagatggttccaatggatgcccctggaaagagacattgcagacacaacactagtacgtatagcaggaatatctgtgctcccctctcagctttcctttgggactttcacctgtaataatgaaccctatagggccatccactgtattgcagcctccacatgattttttgacgctcaacagctgtgcctaaaaccaaggcacaaaggacaaaacccaaatagcacattttgggtaaagtaaacatccctttttcatccgttttctaagatataagagagtacaaatgtaagaatgatcatcttgccaaagctggcacagaatagctgtcttatctgcaagatttcatgcactgctttctaaattgaaaagaggctttgaccaattagtgattttctaaaaaatccaagattccagtggacttcagacatggtctgtgtttggtgtatacctgttcctttctaagtcccaacctacctacactcattccttaagacttcaacattcttgtgcccaaaggttctatctctctgctctggagatttgcattttaacaggaatcagagaattggagcccagatattctgcacacaacctgaacaaacaccctaggatgctttggagggttacaacaaactttcccagagcatacagctggacttcactttgtaataacttaagcagttattgtatatactacatcagcataaaaaatccataaaagcatcttttatctccccttctttttagcattaagtacagtagtaggcatatagtaggtcttcggcaggtgcagattagcaatagaataactacctattctcatttatgtttcgtattgtatttgtaaatatggtaaattgttcttttcttacaactctttaaatttggtgaatatataaggaataaggaacgtcaaaagaagcagtaacagagtggcaattgcaccatagtattctacagttggaagaccatttgccccatcattgccactctggttcttggacctctgagagtgcacccccaatgaagcacaccatttcctgcagcaggtcattctaccttatcattgtggaatgaacttctttgcttcaggcagaaaaggctccccaaaggaaaccagcctttggtcaatgtcacctttgcttctagacttcacacagttaatgatcacataccatcacgctctaccctcctcatttgctgggagttttccaagttctgtttctatctttctgactaccctttctgtcttcctttttgattctggtccttctgtataggggtcttctctggcctgctcttctggctctattcactttactagtatgtaattcactagtttatgtccaaatacccctgacatttaccagatccctataaagactgttatagctcctgaattttggacgcatatttccatctacctcggggcatctctgcccacatgtttccaggctcctaaaacttggctggggaaatgctaagctcatgttctatgtgacgccttccttttaggaaatatcactattttcctcttatataggctccttccaaacaggtaaatacctttataaggatactgtcagttatttgtgacaagtctcatacacacattaggaatccttttctagaacactagcataaattaacctgtactgaatatgcctgttgggtgttatgtgcccaagtttcaaaaggcatcctgccatgggaatatctgcttctcatgaggaggattaacgtgtgtgtatacaagccacagctaatgcataattaagatgttgattatttatcatgttttagctctaaaatctttatataattccccaaagcattacactgaaatgttctttccttaaaggctacgtattttaaaaatgccaaaaaagtgtcctaatcttatttgaaagctcttccgttgagatagcctttgccaagaacatattcttcaaataagatgtgctcttttagctgaagattacatttaggacaaaatatctagaaaaagttaatactttgtcaaggcaactttagaatttgagtaaccagtttctcctccttggggactcctgttcttgcctcagatatttctggtttcaaaacagggtgccaaggcagacctctcttctctgctgatttttgtgtgtgtgtgtgtgatactttcagaataagattatcctggaccccatgacgttcagcgaggccaggttccggccgtccctggaggagaggctggagagcagcatcatcagcggcgcagcgctgatggccgactcctcctgcacgcgagacgaccggcgcgagaggatcgtggcggagtgcaacgccgtgcggcaggcgctccaggacctgctcagcgagtacatgaataatgtaagtcttgggatctccattctcatgtcttggtggattctgttctgcaatcgtgttgctcttttggaagcatagatagcaggaaaagagaacagaccaggtgtttaccaaagagagtcaggtgaaaccaaagaactgctttgggagagcgcgtgtcgtgtgtgttgtttctgaatccattttttgtttgtttgttttaatatggaacaggtggatggagaataagctctttcactttttacttggctgatttcttctcggtcattttagtggctgcattttgaagtaggtaagatttcaattggtaaaggtagatgattgatggaaacagctgaggatatagtaagtcctctgttacaaagagcacttttaaacctaaggatagctgtagatgcgaatcttcacccctaagaggcattaataaatctactaggtttaaaaaacgtgtggatagggttgtttaaggaaaagttctaaatgtagtaaaatttggaggtgttttattgattcatagtcaggaattgcttataagagtgagtctcttaagttttcaaataggtatgtatgactggtatctaattgtattttggcacataatagccatcctctcctatagttgtaaaatgtgacagtttctgtgtacctgtaacctgcaagaaggtgatgaaactcatattctttgccttgaaaggcactaaattatggctgtattgatttgctacattcattcagcagaggcgatgcttgcaacagtggatgatctgtgcttccccctttcctggactttcgggtttgagataatttagcacaaattggggaaaaatgtagataaagtgaggtctcgatattacattttgaaggaatgccctgtatagctaccaggtgggtaacagagacactgaaaatctgctcacagctactgaagtccatgttaggtattattagaacaccccgaggcaatgctgaaacaaagcagccattcagtgtctctccctccagcatcttaccactcccatcatgagtaaaaatatgtagctaacagacatgcaagcaaggaatgagtgttgacagtagcagtgctcctcctgctgaccctccagagaactcactgagaaagcaaaaagatgtcaatgagaaaacctaacaaactaaaaaaaacaaaatttgtttcctttccatgaaccttcagattctttgattttggaagacttggcctttttcagcacacaaagaataaaatgtggatgcatcatgtggcacccagctgcttatgaggacgtctctataggaccctggatgaccaacactttctgtaattttgatccatggtattacgtagggtgcagctagaaatgttgaccccacagtctcccagctgagtgaatcttttgaatagcagatgtgtcaacgaagaatgcttatgaaatctgagacgctgtttgtttgttcgttgttgttgttaacaaaatagcaaagggctaattacatggatgtggaatttggttttacattaaggcacgctagtggttctattaatgaatagttactgccaaagaaggaagtagaaactacagagatcacagtgatggttaagatctcaatataaataaatcagacaaaaaagtatgttcttctaaatagaaatcacagaacgtgactaaataagagttgatcaacacgtgacatgtaattttcagtttggtgtctagaatcctgccaactagaagtttttctttcagtgtaatctcatgcagatcagcagagctgatggatttttgtattttattgactccaggcactttttgttttctgttcgcagcctcgtgatgcaggaatgttttgtgctttattgaaatcttagtttctattttgacatggttacagacaatacatcaatgggtatagtgcttaaatttcaaaatgcacaagttctattcacattgaaccatcatgatcaaagcctgaaataaaacacctcctacttgacatttatgtaaactgtataacatttagttggacttcacacttgtttggtgatttcaaggtagaattggatgcagccagatcaccttcataattcctgtccagtgcactcatttctcctgctgcacagtcaatttgtatttattttgatatagcatgtatgaatacaaaaacacatacacatccatgccctgactgaaaagtctattgtagttaacagcaaacagtaaatcagtctatcgttcctgggctgttatctttctctttcaatttcataagctctgagaataaaggtattatcaaatgatcaccttgcaagttttcatcctaatgtgctaggcagtaccattaggataaacaagttgttaaactgaaaatatttaaaaatcagcataactgacatttctgttttctaaaaatctcctcatcagtcccagatgaacattccacttacacaatgcttgcttgtggctgaagctgttctaaaattgtatacatgccaaattgtatgacacagagggagacagaggttgtggagagaagctgtgtatcacacctgatagaaaaagggtcttcatggagcatgggctatgacttagccacgtagcttccattgagctcaataggatagcagtcacatgttagatatttccacaaatgtgtattctacttaatgaacgtgggtgtgcaacttgaagatgtcaacagaattgtgcagttaaaagaagtggtgatatttgaaaaaaggctgggtgaacagaggcatggggtgaaaatcatcacagatcatggcggtggtagaaaggatggttggaattcttttaggaaagccttggctagacttaagttgctttatcaagttgaagatataatccaaagtgaaaagattcttaaaaaataatccccctttaagtaaactattattattgtacatatgtgaagactaatgggtagagagagacttaaaaggatgcgcggcctatagatgttaattgggatgagtgccgtcagtgtggtggttgaagtattatgctgagtactttaaatagttccaaattatagtgaacacataaaccttccttgggaacttataattttatgcagctttctttggtggcagtataaacataacattttatgggttttattaataagaatattgtgaggaatgcaaatttagaatattttattcattcaacaaatgtgtattgtctgctggccatttgtgccaggcattgctctaggcttctggggatacagaaagtaccagaacaggtaaaattctctgcttgctctcatgcagcttacactgttgtgggaggagacagacagtaaatactaagtgatatgagcaagagtcacttcagatagtgatatatgcaaagaggaagtctaaaacatgggagttagaggacgctgggtagtactgaagttaagaatggcctaggaaggtgcgttgaaaggatgacattagatcaaagacttctcagaagtgaggaagcaaagaggccttgaggaggaagggatgacaaggtcaagggccttgctgtgaatgggtgcctggtgcacccacccgtttgaagcaccatgggagtcacagcagctattgtgagtagaggggtagcaggagatggcgtctgtatggtgctgaggcatcagtcggtgcagggtgtggtgaaccattatacagaatttgactttcattctaatggaatgagaggccattgcacagtagtgagtgaaaaatgccatgattcaggtgctgagaacaggccacaaaggcaaaaggcgtaaaagcaggaggacaggtgaggaggccctgcgtcccgtaatattcatgagaggatggtctcttgggccaggggatagcaatagaagtggcataaagtattcaaatactgactataaataaaatttgcttataaattaactagtaagaagaatgtgtctgttttatgaacataaaatcaatatttgcattttggatgatttgcattttgaatgacagttgcagttgtatcaattgcagctcatatgatatcttcatttggttttggttgcacaggaaattctgatttacttgggtgttgaaagtagcttacttgggccgggcacggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtggtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaagtagcttacttggcaatgcctggacactctgctagacagattgcatttgaaaggggagttaagtagaaaaattttgtttcaacgttgtatcaccaaaaatgtctaagtatggttcacattcttataaaagactagaaaaatttaatacttattctaagtattaaactgtaatgcagaactgtaaggagaaaaattactacttattctaggtactaaaactgtaaatgaagaacaataaggaaattcattaaactgttacttctttatgcacaattcatggttaggcctatgatgagaatatgcaatgagcagatgtgcctggtccttgttgtgtcttgtgctgctgtacaacctgtttcaattttatatgcataaactctctgtgtagctcgaattttttttaagactaatttagagctacagttttcttaaacaatcatgcagttaaactattttcaaatgatggcagagatcctggtggcataaagtaatgctgctgttctctgctgtaaaatatggtgagacatttttaattgtatttttaaaaataattacaattgtatatttttttaaattttggatccaactttttttcaagcctcttgaagcatctaagtggatccctggggttaacaatttataaaccattaatatatagaaggtattaaaagcacatgaagacatattgatatgggaacatatatacatattacaagtgtttgaagcattgtcatagcctttgttagagagtagaatttaacataaagtgggttcctgaaggagcccacttgtgaggatttgaggactaaaataggatctaaaaaggttatttccagcccggttttatggcctatacacagcaagcctccagcatgctgttccacaacactagatgagtaatacatgagatgatatccagggccacgagatctctaagaatgtggcttttacatttttgtatagtggaaaagaaatatatgttcactagaaagaacaaaaagacaaagaagaaaataaaacatctcatcccccaaaataactgctaataatttggtatgtgtctttccaatgtttctgagcatataggagtggtatatttacacacacacacaaacacacacacacacacacacacacattacactttgcttattttttataaaatggactcatattgtaaatgctgttttgcaatctattctctttactcaatatattgtgaatatgttaccatatcaataaacattctctaaccttatgtttactggctgcatagcattttattatatgaatatgtgataattcatttagaagcaattcattttgagtgtatttttagggaagagccttggaaaagataagtagggaaaacttttcctgctggcagtacagagttctgattttagacccaaagcgtgactaggaacaaaatgagaacgaagtgaggacacagctttacagtttctgtggttcaggggatccctgacaagtcttgtgcaatcggatttttgcatataaacaaaatttaagtgcctctgggattctatttgaaataatcttatgtttatttatattcattttctatataaatctgatttttatctatcagaatttatttaagttggctgtatattactgccgagagaggcccagaacaactagttggcaagttcagtatttgggtttgatctaaaatcccagagaaagatcgaaaccttccgaagggactgtcatcagaaagataactttgccataggaattgctatactgccacatttctcccatatgggaagcatgaaaaagactgagtagctcttattacttaagaataaggctcatcgttgattaaacatgaaatttgttttgagtattatctggatcttctcttttctctccttcctattattatgtagatgagggaatgcaactccctgaagtcagcttggctaataataactttctctattaaaaggtgtgacaacacaatatagaaagtaatgtttgaaaatgtttgtgggcaatcgagatcgaatgttgcccatacctttgcctaatggccctgcattctaacgcaaaattaagagctgcctaatgagattggtagcttcattcaaggggaagagtcctaatattctacattggtgcctgtggtgaggttttccttgcgtttttcttacttgtatcttttcttctctttcctgttctctttcttcactgtatgttcaatgccctcatctctattaattttgaacttcagattcctctgtgcatttacacttcccatgcaaaacttttgcttccttgaacagagttttctaattcttccccctcccctcccctcccctcccctcccctcccctcccctcccctcccctcccttctccttttttttttttttgacggaggagtctcgctgtatcacccatgctggagtacagtggtgcagtggcatgatctcggctagctgcaagctccacctcctgggttcaagcgattcccctgcctcagcctcgctagtagctgggacaacaggattctcctgcctcagcctcccgagtagctgggactacaggcacccaccaccacgcccagctaattttttgaattcttagtagagacggggtttcacccgtgttagcgaggatggtctcgatctcctgacctagtgatccgcccaacttggcctctcaaagtgctaggattacaggcttgagccgctgtgcccagctttttttgttttttgtttgtttgtttgttttgttttgttttttgagacggagtctggctctattgcccaggctagagagcagtggcgcgatcttagctcactgaaacctccgcctctcaggttcaagcaattctcagccttatttatttatttatttatttatttttttgagacggagtcttgctttgtggccaggctgtagtggagtggtgcgatctcggctcactgcaacttcagcctcccaggttcaagtgattttcctgcctcagcctgccgagtagctgggactacaggtgcctgccaccacgtccagctaattttttatttttagtagagacgggtttcagcatgttggccaggatggtcttgatctcttgatctcgtgatccgcctgccttggcctcccaaagtgctgggattacaggtgtgagccaccgtgcctggcctttaaatttgtttttaattggtatttcttgctcagatattgccagagtacagctatgttaccaatcctttctctgaggtgaaaaactatcctttgaatctactcctcaaaagaaatatacatagttggcacggaagtctttctgcccttgcaacatggcacttacaattctgtttggctgcatttctaggtagatttcactctaactcccagagaaactgggaaactggtagagggttttttttcttacttcctttttcttacattattatgatcatactccctttctaaaggtgctcaactgtgtttactgtaatgcgatcttagagagccaatggatgttgtgcagggatatgttggctggtgctgacccaggcacaggtggtgggagaatctccagtcatgctggcaggacatcttctctggtagaatcatgacagggagagtgtgagagcttgtgtcaggttcaggtgttgcccagagcatgtgtgcactggctttgaaaagttccaggaggagatctagactggcatgagggtgttctggatacagtacccatcagagctatggaacacagatgtaggtaacatccaggccctgtgggaacatggcaggtcttcttgggccttaatgtgcccaaggtatgggatgattattcaagtgggggacttaggtcctctgaaaagtatgacaactccaggagctccctgttgccttcattgcggtgaaaaaacagtattgaacaatcaatacttctatctcattcccccactcactgccctctaacccaacattttatctccttccttccctccctctttttcttccttccaactgtatgcctggtgaaatccttaaaaactcttttgaattcatgaatgaactcataggaatgtaagggcattactagaagaaaagaaatgacaagaaagtaattaactggagatgggcctgcagacttttcatggcctagacttgggttttaagtgaggcattaggtgcaaagaacaggacaaagaacattgattcaaagaacaaagcctgatgacccagctagatggccagctagattaggggcctcagcagaaagtctggattcccagttaatgaaaccattggggtttgatctaagaaagtaaaacttccatacagagagtaaaaatgggaatgtgtgctgtcttggcctttaaagagctataaaacaaaaacaccttatcctctaaaaatttctaaccacaagcccataatcactcagtatcagggccagaagctagattccagcatgacctaaagtttatccagaatgtattttaaaggcattttgggtggtgggttgccaggtacttggtagaagcaaatactaatgccttccagaggaacatactttaaacctggggctcaaaaaatttccaaagataaagttacaaagaacataagttgaccttccagaatccctaaaagcaaaacagaacaagccactgtgaatgagagttggcaataacaaccggttatggattagccctacagggtttcaagtttgcaattattaggtacagattataaaatatttcaaagaaattgaagagaatattggacatgtgatgaaggagcaggaggctgtcagcactgactgggcagacttggaaagcagggctgggagttgtggtgctagagggatatgggcttacttgaatgggtggggcaggcggttcttggccaagcctcctcttggtagccttctatgccacaagcctggacaaataaggaagaaggaaacatggtagctgagagtgtctggcctttgctgttcagagcggtgctgttggtaaactcttgactgggatctggtaatctcttagcaaccctgtggttgggtatcattcagcttatccatggcagacttctctaaatgaactcttcctggtaacagaatggaaaaagaaaatctgccaaatgaaagaggagatggaaataaaaatctgcctcaacagcaaaattaagttccgcacttagaactctagctagtttctctccttatcaaacaaactccttactgagcccttgaaaggtggttcggtcaataggatgaggaagagcaagtaatattatgagagaggaaagggctttctctgacttagtagctgagattgttgacagagctgacagccaagtcatcagatttggccagtctggacagcacatacctggacagcacaattgatcttctcggaagaggcttctggtatttcaaagaagacctcacaaaattgtcagggagagcagcaggctgcactccaccatcaaaatgatgaacctgggaaaaccttccctttgaattaacaaagtatgtaagaagatctgaacgctggatctctcgttcccgaatggcttgttccaaagataagctcccttgctggggcccctccttgctcaggttcaatgcggccttgaactctgagaggtatttttcttgattcagttcgaaaattgttacactctaagaactgagtgtttcactggttggtgatgtctctaacacctctccatgcttcaatcacaccaagtactttacagttaccatctctctgattaaaatgttatttccttttggaggccgaggtgggtggattacctgaggtcaggagttcgagaccagcctgactaacatggtgaaaccccgtctctacaaaaaatacaaaaaatagctgagtgtggtggcgcatgcctgtaatcccagctacttgggaggctgaggcaggagaattgcttgaacccaggaggcagaggtttcagtgagctgagattgtgtcactgcactccaacctaggcaatgagagtgaaactccatctcaaaaaaacaaaaacaaaaacaagtgttctttcataaactttgcatagatggctgcttctcctcccaccaagtttcagctcaaatatgttgctcttgactacattagtgcatttatttctactataacacttgccacactccaaaatcacatcatcttattgtttgtgttatcatctgctcctctgttggaatttactttccgtgaagagggatgttgtattgtttacaatccccagtatctggtgtatttggcctggcacataggaggctgcaaataaatattttttgaacaaataaatgaattccctttcatccccctcttctcctctaataataaagaaacaacataacctatgtgttttgagaactttcagtcacatagcttggaacccaatgattgatcttctttctctgctctactacctgataaaacactcagtgcattagctaaggttaactatgcttggcttcttcatgactcactatgcagtgcccaggcttttcactatagttaaagctttatttaaggccctgtcagaggccacatcaattctttcaagaaatggatagaatgatcccagtaactattagtagagataaaagtgatgcaaagcatgtcacttgcttgcttttcagttcaaagggctcccccaagctgctcactcttatttctgtcgctacagagtgacctgtttcggcatgagctcttaaggatgtgtctgagggcttggaggagctggaccatttttagttcacagcattctgcaggctggactggggactttggaaatttcttaactcatcacttcctaaaagacacaaaataatttgcatatgtacctgaagagatacatcgacagaagacaagggtcacagttaagctttttgaaagtaggtactgtgtttgcagagtcccagccccacctacagaataacagtctcctgctgagggggttttgatctctaaattgagcaagtaccccagctgattcttatgagcaggcatgttagggaacacctgatgtaataagtaagtgtatcaaatcaagagttgatttaatatagcacgggttaaaaacggggtttctttttgtgagtggggataaataactttgtaagaaatcatcaagtgaaatatctttcgggaagcctttttgggctatatattagtcagcctagacattcacaatatgagaggagactcgtgaagctggatagttaatctcttctttgaattccttagaaacagatgagcaaatcttcaccagcactttgccctgcgagatactaattgaagggtagttgtttttcaaaacttctaactttcacctcaccactctcaaacacacctcatcctactcatctacttttccatttataaaaggtcattttttatccttggaaggactgtactctcaaatgccagaaggagaatatcaagcctcatggattattcagaaattctctttcttaacagcttaattgctgacttcagtaatctattaactctgctggtttgaatgcagctgagagacttagagcatcaacccagagctatgccatttacaccttgaattgagctttcgttctaggttcttttggtgactattgtagggaacagcttctaagaggaaggagcattttgcccgactgctcctgcaattcttatatctgtgtatcaggacatgaggagatttttaaaaacacatattccaggttcctgccttggtcctaaatgataaaatctccagggaaagagctgggaaggtttattttagcaaatatcccagaggattctcctgcctccagtcctgcaccagccttggactatgccagtattgagaattatctgacgtaatcaacactggattcagagacaggtatcatacatttcctttttccgttttcttaatcacattttcacagtgttatttattgttatttctcttcactgtctaaattatcctccactactccttgccatggaactagtgaagacctttggaggccaatattttcttctttttccccctaaagtgactcaagaagacatcatttgcatattatgtaagtttcacctcaatagttttaaaaaaagacattggccttttttattattttgtctgcacacttgggtgttaggagggatcagtcctgtgatctggtgattaatttcacactattattcctgaaaaatagacagatacctcttcttccgtgtatcttatggatgtggtaaatgctgcacccatgagaaaattaaagagatgctgattctctgaccttctcttcttattacagacattgcctttttttttccaccgctgccctaattttaggcttctaatctcttctgttgccccttttcctcatctgtttattttcaaccacttgtaaaacctttaaaaccatatcagttttttacttttttttttttttttagttctttcaagattctggaaggatcaccacccattttcctaaaacctctgttttgtgatttcagattatttagatgaaaatgagtagcatgctatcttcaatgaaacaaatggttaaggacccgcccaaggtcacatgtttagatacaactaaaattggaactcaggtcttctcgtctctttattgccactctgtgattcttttcattactttgtgttatatattaatgaatctagagacaacattggattttcggtattctattctctccatttaaagccctacattgtgtagtgcccatcttttccctaatgtgtatattttgaatccctcagagttagttagatggtagactctggacaaatatccaatctgtaggtatctacagatcctagcagaaccctgccagcactccaaatagaaggcagacagcagcagccttgtgggatatttcttacagaggggcaaagaagagcctgttttgtcaggagtaggtgttaatgcagctaatgcagaaaatcgtatatttttcaagaatacagaattggcttcagtatctagttggagactgtcgatcatgtaagagacaatggtagaggcaacaaccatagcagccagcactagtatatctactttttcataattccataggggttcagtgcagtggctctgccctcagctagccatttctgtacagagatctgacttttgtttttttctgaaaataaacacctagttgcttgcaattttgagtaggagagaagatctggtggtctgcttttaataattaattaaattgacaagtaataattgtatatatttatggggtactatgtgatgtttggatatgtgtataaattctagaaagattacatcaaactaattaacatatcaatcaccttaccaacttaccatttgtttgtgtgatgagcaggtataaaatctcttttggcaactttgaaatataaaatacattattattaactattgtactgtgtaactatttcatgctgtgaaacggatcactaaaatgaattcctcctgtttaactgaaaagtaccctttgaccatcatctccccgtgtttcatccccctcgctgctcagcctttggaactgtttctctactctctgtttctatgggatccgcttttgtagattccacataaaattgagattgtatagtatttgtcattttgtgttggcaggaaagtaaattagtgcagctattttggaaaacagaatgaaagttctacaaaaaactaaaaatagaattaacatatgatccagcaatcccacttgtgggtatatattcaaagtaattgaaatcagtatgttgaaggcatctctgcactgccatgtttattgcagcattattcacaacagtcaagatgtggaagcaacccaagtgttcatgagtggatgaatggataaagaaaatgtgatgtatacatacaatggaatactattcagtctttaaaaaaaaggaaattctgtcatttttggcaatggggatgaacctggaggtgtaactgctttttaaatagagtttcaaggaatcatcttttttaaaacctcacctttctcttttctttattccaggagaagctgatgtctcaaatttctacatctttggggttttgcagtataaattgtgttgttctgagcttccccattgctggcttaggatttggctttctctggcctgctaaacaggctagtacacctctttctgaaatccagctttcagaatactactgctgtttgcttctgttgtctttgtccttagaattaatgtctttaaaaggaaatggcttatatgataattttaatggaatttcagaaaagagcagtgataaatatgtgtgttaaatcaatcagccatcttcagccacaccttgcttttgtttttaagcaaggttttagatttcttccatcgctacgttcaggggctataactagacatagggatggttgttttgtaccctaacttgaccaaggggttgaatcaagataaaatgatcaaagtgcattattcaaagtgagttgagattttgggataaaagtagaggtgagataaaatgtgttggaataaagcttagttggaggatctatttgatctaggcactctgttgtatttgattgtctatctcattcctaatgacagcattatagatacttgttcctgtttagaggttgaagaaagtgtggttgtgaataccttgtctttgttgttcatgtaacgtaactatagaaatcgggcatttatcacatgatgataattctttagaaactttgtttcagagtctgttgaatgctacattccccttagtggctgataacagtcgcacaagtgatatcacaatatgatccatagcacagtgttaaaggataatcgagtccaatgttattatctcaaccattttataattttaagtatctctcccagtatatttagaaccacaagatccttgtaaatggattattcccatttatttgttgcatttatttgtttactaaaggttacatttatcttttgtacgattgctgttttttcctctgtaatattattttacatattagtcttgaacttatgtctttttaatccttagaacttttattaggtatgtgacccaatgatttgatttataaacatgcacattgatatttctaacaattcatatttttatataaagtgtatactcacctgccagaaacagtgacaagagaaatatacatgaaatatttaaattcaggacaaccattagggaagttcttgtgatatattcctaatgtattgtgattattagcattccttaaaatttccctaaaaatttaacacccattcaccaaataattcttactaatgaaaggattatttactagcaaatcacatatagtttgacacatctatatgtttaaaggataagaaaaagcaaaatttgttttgcttttaatttagttaatttattagttttgatgctgcatttcatggagccttaggtgcttccgggtccccattagtaagtgaccaggagagaggaatgagtgtgactcttagttccctctgtcccccagatctgtttttccctgagaatccctgacactaattgaattcaatatttggtttttatgtaaaattgtatttggaaaaaaaccagatcctgtttttaagacagatttttaaaataatggcattctttgtttatacatctaagactttttttttttctgaaatacccagataattgacagggaagttaattgggagatatgaattatttagattttcggccaatctgtgataatactcatggatctgaagattacgatagaatagagaagcccagctctttgcagatagcagacctatcctgaaatatccaaatgaattcacaaattatgagcttcttatcactgtttggctatcaagttatactggctgtataaaatctcttcgaattaatgagaatggttctggccccctcttcacgcctaacctaagtttctcagcagttcctggttaaatattctactccacagggtttccttcattattccccagtgactctatgccataccttccaggtgaagaatagcatgctgtcttatagagtacgatactagaactcttggcatgcatcattttcaccatgttctttagaaagtgtcaggatttttagtttttagaagaatatagatgtaatattttgcagcatacataagttataatattccaaaacatcccgtaagaccttttatttatttcctttattgtgaagcatgttctttcctgatagctacagatgaactggaggccttttcttatcctgtaatgaaacattgaattatacccatacagtttagcagaacgaatgcttacccactggctgaataaatcaggctgttcatattttctttaacacaaaaaggaaatgataattaatgaacttgaggataaggttttaaatgtgtatagttattatagtataacagtgctgcgggggctacttgctgacaagggtaagggcaattttatttccttataaataaaatttagaattgaacatctaaaacaggaaaaaaaattaagagtttattgagtgttatgttttgggagttatactagatacaacagtattaaataatatgcaatagaatgagagacttattgtgcaggtcttaaatgttgtaagcctattaagtcccttccaaataataaagacaaatgcatatcaagatagaaataggtagatatgagttaggttttcagagagagagctgggttgagatactgaattattcatgacagaagtagagcttgaaatatttgaaaggtgtacagcaataagagaaatcaaagatggagagtatactttggggctagggatgacataaagcaaaatttgttataggaatgtgtatggtacattctgagcacagtgaagcctgcttgattagattaaaggacatcgaatagagaaaaaatatgtttgcaaaggaaagttgagattaagttgcagagggataggattctaaattaagaaatgcatgctttattatggtaggcagttattaaatttttatttgttttggtttgatttgttttggttgggcttggtgttatcatgatcatattaggtaatatatgcagtgtttgggaacagctatcctgcctgcagaggtggagagtggctcttgagagtgtccatgggagataagaggccatagagacctactagtggacttttaggaaagtacagatggaagacaatggagtctgaactacagagaagacagtgggaatgaaaaggagaaaaacagattcaaggagaataactaaaataacctgaagatggattttttttcaacaagaagatagatgggagaaggaaccaaaatattgcctttctcttttcatgagatgtatttatcaattattcattgaactcacatgtcagctaagttagggctgatcaaattcattgacaatattttttgaagaaaagcatttaacagtgtttaaaatctgtcatatattaggttttgatcatataatgttactctgtaaatatttgtcttcacctgttgcttattgtattcacacagtagactattagtgcttttgatttaatcattatgctatcaaaactcatagtatgaagcatgttgcagttctgctgaggcctgggtttgggtctcacattccagggtctctttgaaggctctgatatcatggcctagtggacaggccagtatctgcctctttggtggtcatttttggctcaatatatggagcataataacttccaggttgttattttaaaagttaaaaaaaaattatttctttgtgggaaaaaggttggccttatagaagatactcatgtttacgttgggtttgttgaatcttaaggggtcatttagctttcacaggtattctttaattgtaccttttaaattgtgtgttagagaaggattgtgagcattaaatttcattaatacctcaggatacaccccttaagaagctcaaggatcttgtctaagtgtgatctgttacctggagccttcctttaggttgttctctgtcctatggcagctgtggttttaattgtcatgcactttgttgacttacatcgggtagtatttctattattcaactgtgttcaaatatttatttggtatccattttatacaaaacactattgtagatactttggaacaggaaaaaattgaataagtgagccactgactgtaccttcaaggaaattataccttgtagtgtccagaaatatactattctattcattatttctgatttgaaataactacattttgaacattgtggtcgttcaggttgttcatgacatgatagagaatagggtattttgttgattaagatgaatctgagtcagatgaaatttgatacattattatccaagaaataaactattacctaccactggaaaaccaatgtgtctgcccaatttccaatcagcctgaagccagtttcattttgcatgggtgatacagatgatagaggtggatcatccagcagcttcatgtatattcatacttatcagatagggtcaacgcctcttagtttggtttgaaatctcactgggaaatgtacttcttcctttgatagatttatcaggtgatatagtccaaccattcctgaaacaatacatgaaaaaaaatgttaatagttacctattaactataaatataactaaaaatagttaatagttaatactgaccttgaggtatatattgtctgtttcataataacaacaggcaaaattgcaaaacacattattaaagggatgatttgtgggttcatagattaagtatctgtaaataccacagccctacatgtgtttactaaatacaagccatgtaaggataaccttcctttgacagggagatgtgacagggactggggctccagcaaagactttccacgtttttaatgtctttctgggtagctttaggggcattttggtggattagcaactgaatatatcatttcatccaaaagtaggtagtaaattaattccagggggaaatttatagtagtaattttcagagagtaaccagacaggtaggtactcaaaattgcaagattcaaggaatcagagatgttttgattagaaaaagatagtgagaggagaataactgccttcaaatatttaaagaactcttttgtaaaagaaaaaaagggacgtattccgaaactgtatgtatgaccacagggaaatatttaggctcaatagaaagcaaaaactttagaatagccagagctctccaacaaattctatcatctgaagcactctgagctgcctcaaaggctagtgagttctctctcactggattgtgtgttgtgagcatttagcaggaatgctgtaactagaaattaaaacatgaggctgaactttaaggtttctcctttccctgacattatcactttcataattttctagacatgcatctgttggttgtaggatggccccatcatcgaggaaattcttcattccttgtattctacttgtctagttttctttggtccattttatacaagaagctggtttgaaaaatgagagggaagtttgggcttttagatgatcaggctggaaatgataatcagttccatattgcttattcatcagttcttgacggaaaaattttgcagtttacctagtgtctggctgagtaggtcatttacacagaaagaacctggctatgatttagcaaagatgaggatagttcttccatatcataaaaagtaatctgggttcctggccagccgtggtggcaaatgcctgtaatcccagcactttgagaggctaaggtggacagatcacctgaggttggaagtttgagactagcctggccaacgtggcaaaaccccatctctactaaaaatacaaaaattagccgggtgtggtggtgcgcacctgtagtcccagcttcttgggaggctgaggcatgagaatcacttgaacctgggaggcagaggtggaggttgcagtgagccaagatcatgccattgcactgtagcctgggtgacagagcgagactctgtctcaaagaaagaaagaaagaaagaaagaaagaaagaaagagagagagagagaaagagaaagaaagaaagaaagaaagaaagaaagaaagaaagaaagaaagaaagaaagaaagaaagaatgaacacgggttctagccacctcctccctcacttcagaggactctttgacataacctttgtagagcaaccttaggttctcttatatttgcctttgttcctggagacagtaaaggcaaccaggccttggtgcaactggtggagaatgaaacttttgcgaaataaggattgcattatgatgcctggacgtccattttggatttctgcaatgtactttgaatctggctacccactatagacttcctggatgcccagatcttctgactgtcaattaatgataatgattctgggcaagttttctccaaaggctaaactggaagttatattttctgatgttgctgccagaaaatcaattctattctatgaagtcattcctaatgtgagtccattcctctagggaggtcaactctagtatgatttctttaagcatcaaattaatattttacttcttaaaatgcaaagtatgtttctgttgaaggtacagttaggcaggtctttggaatatccctggcttgttaagaattttctctgcagcaagtattactcaacagtatgaagcagattttagagcttgctttctggcagagcaattggacttggaatttgcctctttattcaacctgtatttgacttgacttgttaactgtaaaaataatatatgattttttttatatctggtgattttgattagacaatttttaaattatgaaatttcatgggataattttaatccattaaactcttcagtatgcagaatttcaatccattaaactctgcaatatgcattaatatcctgcacaatgcaactgttcactgtgtatgtgttaactagtggttaaaagaccttgtatgttattgactcaccaataagttgtagttttatatcatttaaattcatcttgtctttttaattatatttatctatgaatatcggatatgttttaaaatgcaaaatttaattatgaagaatgggtttcttttgtttttctttttctcccctatacccactcccctttaccccattatcccagcccttattaaccaccattctattctatgcttctgtgacttttttagattccacatataagtgaggtcatggaggagaatgcatttcttaattgatttgtacccatggtcctcaaagtgtgatgtgaggactagcactagtctgtaagctatttgttactagtcttcaacaagatatgtacaataattgtcagcatttagaaacttttgtagtaattttgcatttcctcaacaatggcacagaattttacaaaggttgatcagttctcaatggactggaagtttgtttttttaactacttttcatcccagatagtctgggaagcctcgtttcacctttcagttggtagtaccctaaaaggggagagaggcagacaaccacaaaaatacaagcagatgtttgcaaaggcaatacaggcaagcaagttcagcttaatgctatacaaggctcctaatccaaacatgggaatccagggatttgtggatcctggagaggtcacctactctcagaatctctctctccttacccagtcttactgccccaaatccccagcactagctttttagacaaaaacagttgcgtatggaaggtactgtttaaaatgcatgcggtcagcaactgcccattgagcctctctcacaccttcagattctttgatgaggttggcttacaaagctcaggaccgaggtacattctgatccaatggatttctgtggggacgagcctcacccacctggggctgagtggagcaactcttactgttgtacacccagactgcagaacctgagccctaaaggctatggggacctgcccttcctccccacactctacctccagagccctccctttctctgaaaaaacaatgctttattatagttatacaggatggaaaagaagaatgatgagaggaaagagaagaaacagataaaagggaaagaggagcaggggagaaagctaactgtgtgatggagaagagggaaccagtgaacttgggatttgagagtatgtgaaatcatagtttaaaacctttaaggttttgtcttttaactccggccacctctcagccacctatgctgagatacttgtgtgtgagattctttttttttttttctttttttggtgttttcttaatgctagatcaatgaaaatactgtttcagcttgaatttatgatgtaagtgagccagttattgaagtaagcttgctgtgtgtacaccatgaactactcaatttacaatatgaaaataattcccaatattaagtgtaaataaagtatgatttacattttatgtaactgctagtttatgagtactcaagactttgtacattttaacaaggcctatttttaattgaatattgaaaaactagatcctcaaacttttcatcacatacattgagttacaaacttgacaaaccaccccatcttcttccttgcatttttaccaccacactttgtatttcatgccgtggtcatgacaggcacctgttgatacccagaaaaagaactttgaatgtgtctactgtaatagtgtgcattgatcctgttgatccctgtgatctttgaagtgtgtgtttcaccagtcattaatttattttgtctgtacgtacgtcattttaggtcagctctctgttgtcaatatttctagcatatatatttgattagctctaagtggagatttttgtttgtggatatcttggacaattatagttatcatttcatgctttatagggtttttgttttctgtgttaacatcaccactaccaccataatcacaatggtatttattgagcaacctctgtgtaaattgggtagacattttctcttaggtcatagattcatgggtttaatataaaaaaggggcgggcagaggaagcttatatttattggatatttattgtgtacccaccatgttacgggctatcatattgaacctttctaacaacactgttcggctaggatttgtatcttcattttttaaatgagaaaattgaatctcacagagttaagctactagacctagtgaaacaaagaggctgaaattcaaatctagatctttgggcttctggtattctcttttttttttttttgagatggagtcttcctctgtcgcccaggctggagtacaatggcaagatctcggctcactgcaacctctgcgtcccgggttcatgccattctcctgcctcagcctccctagtagccaggattacaggcacctgccaccacacctgactaatttttgtatttttagtagagacggggtttcaccatgttggccaggctggtctcgaactcctgacctcaggtgatccacctgcctcggcctcccaaagtgctgggattacaggcatgagccatcgcacccagccctggaattactattctttacatggtctaaccacctgtatgcttttaagcacacttaaaatgtttctgtgcttcatttacctgcattaatgctttgtgtggttttagttttttaacattttttgaatagttgtgacagcttgatcacatctccagataacattgcatatggagcatttaaagatcagtaataaatataaaatttaaggaagttccatgaggtaatagaaaccattccaaaatgaaaacagaagaggtctatgttttaggttcaggtcggcactaagctgtaactataaactttgaatattttatttatgtataaaatgagaaagcagagatacataatttctaaggttgagctttaaaattatatgcctatatggtctgaaaaacattcttgaactattttaattttgcctatcatccaaatacattttaaaaagaaattctattttctctgactttgtgtttgaattaagaagatgaaaatcaatttggcctgattacagaacttaactatattaggctggtgcaaaagtaactgtaaaaacagcaattacttttgcaccaatctaataatatcagcaacagccaaacactaatagcaataataatttgcctacttttaaaatcatgtgttatctttaactgtgcaactctacaaaattgttgagtggttgttcccatttcacagataaataaattgaggctcaaataagtcaatatgattggggtcagaagagctactacaggtgggacttgagtttacactcagctttccttgtattctaagcccattgtccttacatcattccaaaggcaagtcccagcccagaagtctttgagcatcccaagtagggagggtatgtggcttaagggactggttgcctcttctgtgatgaaagctgtgtccttgctctgcagctcaggattagacactaccagatgtgatatacagaggggaacaaggtgagctcttcctcatttccccccaaaaaagacatgggaccctttggtgtaatgaaagaacctagcccaatggcttaaatcctattttatgttacaaatgtaggtagcattactgaaaagagatagatttagaataaatgcaccaaggttttactttcaaagataagtagaagtttgaatgagtttgctaagaggaattttagaatggatgtataaatagggctcaatagttatttggatgagattgcagttgcatagatccttaacaagttatacagttaaagttggtatatttttttgatgtttgccagagagggggagcagagttagcattatctccttgacggacacccatcttcctccctaatgaataataacaacaatgaaaataatgactacattactgacaggctattctctgccagccgtggtgttaggtgctttgcacttattacttcttttgattctgctgacagccatactagggaagaacactattgtctttgttttatagatgagggggcagagcctccaaaaaattaaatgccttgtccaaagtcacatggaggcaaaaccacaatttagactggtctgcccagagcccgtatttcttctttctctctctctctttttttttttttaactttttatttggaaataattttaaatttacaaaaagttgcagaaaagtacaaagaacgatatatgctttactcagatttgcctgttaacattttgccctatttttgaccccacactctcctgttacactgcagcctcacaaagagaggctatcatttatttttagtgccctggatttagttgatctcatgatcagcccagtctggctcaccttgttcaatgctctagtgaaattctacatttcaaatatctttgaaatagaagaattggtgtcacattgtagttatacgaagactatacatgagatgaatgcataaatctaactggggtggagaaatgactaccttttacaaattgtccctctaaaacgttttggggtttgctgattattttcgaaagaatgttgacagaggcctggcagtaataaataatacaccttgtgttatttttccttgcagagatttcctttttgagtggcatttttttccctttttaggtttatttacccagttgttgaaatcaaaattaaatgcaagtcacagttctttggactgtcaaaggacatgaccagaagagggcagacttgcatgctgcaaccgtttcccgtgtaattgagcaatctgcatgctgatgttatagaatggcaatgaagagagatttaataataactaaaatgaaaggcttatgcttatttggtacaggatttctaataagacatcagagtcaaagaggcttaaaagaacaatgtgctctatttagtgtattctaaatgtgaagaaaaccatattcgtttgattctattttttttttctttctgaggcagtactcgtttcctcagtatttctgagtttgtttttttttattttttttctcatgctgggattttttttttttctctgtagtcacccagagaattttcagtggtgaatgcttttgaatgccttataaaggtacaaagtttatctacagtttacggtattatttaattgtcatacctgtgaaaggaggaatggtgaaaatcccttatttatgcctctacttcctgaatgtgccctgtgggaacagagttacagacaacccgacccccttttcctcctcttggctcttgcctgcaaccggcatcctctggcccttcgagtgccaccatctagtggctgtttctggaaactccaagcgtccttttttttttttcctagcatctttcaacccacctcagttgtagacaggcttaattaaagttgtctaaggaagcttctttcttttggatactggcataaccattttccttaccttaagccatcgttcctcaccttaatccatcttgcctcattatattagagaagtttcacagtctttccaggggtagaggtctaaaatttatacacttgggagactctagttaaaaataatacaaaatcatgaataaacattagataccaggatttagaggaggcctgtgcagatgaagagtcttgaagcttgaagtctcttagatttttctcttatctcctccccacactcacctttctttcgttttctgtcatgttacatgacctaagtaagccgcgaaagagccacttttcttatcctgtttgctaagtattgatgtgaaggtagtttccattgttttgtgatgaaattacacatagaaaataatgccattgacctccagatgtctttttatgacctcttcctcccttcttattaaatattcttcccaatggaaaacaaatattcataaaaattacatagaggtttcttattcaatttcttgtcatttctacttaattgtcaacatcataatagtatttggtagtgctttgctttaaacatcaatttttgtttcaaatgtaagccagttgacttacattctaagttagggttttctggcctggctggaagaactaacagccacatatagcacttttataaaggaaactactatcagtgttacaaacaacaaatttagaaatgaaatttgagaaaacaacctgctcataagatggggccagtctacgtgacgtggaagacaatccatcgtttcacttagcattctgcatgtagtgtctgcaatcttcaggctatgtcttcactcatgatttcttgacatatctgcacatacccctcattatttcatatttctctaaattttctcacttttcaaatcatctgtatttacaaggctaatggtatattactatgccttcaaaggaacattagtatcatttgtcataattagaagataaccacagaaaaaaatacaatgacatgaaaatgaaattaaatattaagaagatactgaagccggccaagggccctgttccctctattaaaaaggaagattagaacaggctggagaggcttaaagtaaaagaaatgaagactgtattctaaagctaatcagaagactgaaaagacaattaaaagaggactacatttctttctaagtaattctgtggtgcttaatgtcccatcctggttctatttaaaatagtctttgagaaacactgatgaagaaagtttttgtttttactcttgtagacattccacatgcctttcgagattcattctattgaccttttagagggtgggattaatcatgatgtgttgaggcagacatgttttttaaactctatgttactcagatttgattggtatgacaccaacttcccatggctattttaactgttaaattagaaaacacatggaaaaaagcctagaacagtggttttccctcaaaaatggcagtgccctcaaatctgctcccatctcccaaccaaggaggagctgagaagtaagggaggaggggagaaccagctcactgtcgcctatttcattgtgtaaagcaaatgagccctttgtttttatagatatgtaataatatgaataaacatatacattgtagagcttgatttgtagaacagaatttggatcctcattatatgattttttcacagtttcagaaaatggagtatcagaaacagtgatgaagatgtatttggattgacagtctaattaaagatatttctcagtgtaacatttatacatatgagtagattcacaatttggaagattttaagacactttcctgtatgtgtgtgtgtgcttatgtgtgttggagggatttgtagctgtcagaaaatattattatccaacatttttagagagtgaaccgaattgtaagaacagcgagcgatctgttcgcattatgcacttaaattatgactaaaatcacaggcataaaatcagagtatgcactttttgcataaagacaaagcatttgttcttcaaatgagatggaggtggctccaaagagatagccatggctttaaatggcacttgccaattttttttaaaagtattatctagaacactttagggcacaatgtgtagtaatgtagttactacaaggctgtttgattcattgccaaatagtactcagaattcagagatcagataaattagattttaattgggttttaaagctaagatgaataggtagataaggtagaattggtcaaaaacatactaatgtaataaaacctttggttctctaaggctcttgcattaaagaccaggcagctatcactgacagacaatgccatggagtggtcctgaaagatcgatattaacaggtggagtgtgcactgggttccaacataatcatgttacctggagccatggaaaaacagaggcctgacttgaactctccgttatattatagaattttgaacacaaaatgaaatggagttttaccagcctgataggactctcaaacacagagtttattattgttttgttagcaattttaaaaaaaatattcaaggcacagcaccaagttgtttatgtctgagtgtgttgagtgcctgattgtgtagacatgggtagctgaagtagcttgtagcatctgactccaaattgagacttgtgactttttagacttaactttctgtgtaagtctgttattttccatccgtctgtccattaccgcagtatttacctgtttacattggaataaatatattcaaatgactgttattttacaatgtttataaaatacatacactgaactcattttgttttctgcagtcttaaaatgagttttttttccttaatatttagagatcttttgttaaaaaagctatagaaatcttttgttactttctctcccaaaatgctgtttcctttgggaattttatttttattttagttgtttgttttccttgtttgtaatatcctatttttttattctacaattagccattttgtcaataaactcaattagaaaactcttagaactaaaagtttagcaataagtctagatacatgtaaacatcaatgaatgatcttacatattagcaataatcaattagaaaatataaagaaataaaattcctactcacagaattgtgaaaccatgattttcttaaaaacacatggacccggctgggcatggtgactcatgcctgtaatcccagcactttgggaggccgaggtgggcagatcacctgacgtcgggagttcgagaccagcctgaccaacagggagaaatcccgtctctactaaaaatacaaaattagctgggcgtggtggcatatgcctgcagtctcagctacttgggaggctgaggcaggagaattgcttgaacctgggaggcagaggttgtggtgagccgagattgcaccattccgtctcaaacaaaaccaaaccaaaccaaaaccaaaacaaacaaaaacccacatggaccctactaatttgcctaaaatatttttaagaaaagtcaatatagaatcttttctttttataaattagatagtgttagaatatactttgtattgttttagtatttaggagcaggagcttataaaatccaagaacaaatttatttaccaagaaaataaagaagaaagtgaaaagacaagcttttaaagaaattttctacagattttctgaaattttctgatggaaaggttttgttttgttgtgtttttaaagataattgcaaaatgcttattatacatgtgaaattgcagataaataccgatttgatctttggcattattttttgcttggggaatactcattgctgctattataaatctttcaccccatcctcacttcttctatccctgtgcttcctctgcctagcaacctgaaaaaagcaagccttctagcaggcagcagatgaaggttgccatgaaaactgtgaatcagtcaggacccaggcatccatgtgtgtggggagctgtcagcaacctctctttctgatgttgtgcctttttcctctggcacatttctgttggtgtgctcaaggggtctgtagtgcaaatgcaacctgtggaccatcatagcttagcctagcctaccttaaatgtgttcggcacacttacagtagcctatgggtgggcaaaataatctaatacagagcctattttataacaaaatgttaaatatctcatgtaatttattgaatatcgcatgaaaagagaaacagaatggttgtatggctactcaaaaatcgatttctactgaatgcatattgctttctcaccatcaaaatgttgaaaaattctaagttgaaccattgtaagtcgaggaccatgcatactgctttatcccaaaagagtgatctttatagcatgaatttcagaagccacaagaagcctactgagggactggtagtcttgagcttctgcatttctaatcagctttgtggctgccaggtccagcttatgtggattctgcagatcccagcattgctctcgtgtttgacttttattcccatgttcttttgcaccattattgaaaaattgacatcctcaactttgccagcctgtttctcagcaatagcttttatttccctatagcctatatttgaatgttaacctttcaatgtggtcttatactcatttattttgactggcctgtccttaactctactatttcaggacagattgcatcaatctggactctggccactccctctcttattcctgtactgctccagttatgcagagtgctccagcagcaaccattctggtgttccgggccgttgattgcattctgagaccttgtcatgggacacctagagtgctacttgatgataaacatgatgcattaatctcactaatggtattgccccacaagtagcaggaatccccactgagttagatttctataggtgggctagcagtgagtgctggatgatatcagtctttaaaccacacgattgtagaacaaagacagaaaacttattttttcttttttcctaaaatggagtctcactctgccacccaggctgaagtgcagtgacaagatctcggctcactgcaacctccacctcccaagttcaagtgattctcctgtgtcagcctcctaagtagctgggattacaggcatctaccaccatgccgggctaatttttgtatttgcagtagaggtggggtgtcaccatgttggccaggctgatcttaaactcctgacctcaagtgatctccttccctcagcctcccaaaatgctgggattacaggtgtgagccactgcgcccagctcagaaaactattttttaaaggatctgtagaaattcttaaagatcctacaatccaaattctcatattgtaattaattataataataacaaccataacatcatgttggcataaggtctaagcataagtcgtttatggcataagctccaggcataagtgctttctatcaactggctcatttaatcatcaccccaacaggatggggagaaaccattattaatcaaatcttacaggtgagggcactgagcattagagagggtcactatcttgcccaggaccttgcagccagcaagtgcctatgccaggaatcaggtccatgcagactgactctagatggctggacagaccaggaagccgagaaccaggaaggcagtggtttgctcaaagccacacatctggtagatggcagagatgatcaggttaccaggtccatggctcccagaccagtatatggctgcccatcatgcctctcttggtgatattttagattctgttttgataagaggttgttctcagtcatcatttgtaggagacacgaagaaaacaaaagggaaaacattattgtaataggtagcactgaaagcagcagaaataaaatatagcgagccctgaatcctaaaagtttggctctaccaggccaggtactctgatggtaggaacagtgtgccaaatgaggaggtcttgccaataatattctgataatgtctaccatttattgttcttatacactaaaggacaacttacccaagaggcacagttaccaacccaagaggcatacttgccatatccccagtaagtggtggagttgggattaattaggacccctatctgtctggcaacacatctcttttgtgttctacaaaaattttcctgcatcctatccttgcatgcaggaaaattatatgagatgaaatgtagaaatgaaaaaccctgcatggactggtccacttgacacattgacaacaagaagttccatttatgaatgttagtcttcattgaatcctaatttaagagaagtcagctgagcatggtggcttatgcctgtaatcccagcgctttgagaggccgaggtgggtggatcacctgaggtcagaagttcaagaccattctggccaatgtgttgaaaccccatctctgctaaaaataaaaaaattagctgggcattgtggcacgtgcctgtaatcccagctactcggtaggctgaagccagagaatcgcttgaacctgggaggtggaggttgcagtgagccgaaatcacgcaattgtattccagcctgggcaacaaaagcgagcgggggtggggcagggggaagtcattcagaacacttagttcataaaacaactttgcagaagagaaagttaaaaagaaagtggattttctagcaaactcaccccagaagaggggaatcggttaagaattagattcagttactattggagacccaaataccaaatactaaaaagatgagtgtttgtatatcatgtagaaaaaaaagaagtccagagacaaacatggtcctggtgactctgagtatcatcagtatctaggttccttctatgtttcagcactgacatccatagtgctgactccattctcaaggttgtctcatagacctaggttcagacttcttatccccattccagacaggaaaagcaagaggacacttgccagctcagcacttgccttttaaagttttcccaaagcaccatgtaacttcctctctgctcattgccagttcttttccataaagaaagctggaaatatagagaggtgtagtatttttacctgggtacattgttacctccaaaaatataaaggctttataaataaaagagtgcttgaaaatgaacattgtttaagcaaatgatagcctttgccacaaggcatgggaagatcctaaacagtgtccaaaaattaacagtaaccaaaattgataattctgccataattaatctataatatgcttaaagatatgcaataaaatatataatcataatgtgttagttctagtataatccatgtagatataatatacttaaggatgggagattcttgagaatgagttcacccattaattaatatgccaatttttcttcccttgtgtctgtttctaaatgagaatgctgcagcctgaaattgcctaaaataaaagaaacaaataacttacagggaaattaacaaaggaggattctgaaataatctcattcacagtcattatttattgaaagcctattacgtgccatgcattgggctaggtactgggggatgggagggtgggaactaggcaagcacagactttaaaacctgcacagtctaatcatttaattaaaaaaccttaccctaacaccttgaaacaacccactagatgtagccagtgtttttggatgaaaatgttttgtttcctttaagttgtaaaaactaggagctatatactttattaattcagtaaacaagtcatatatgtacccaactttaaagtgatgactcagatattcagaaaaaaagtttggacttctaggagtttactcaaacacaatgtctgtcctttcacttatacctcagtgaactgtcaaatggtcacataggccactatgtcactccagtataatggggactacaaatactggggcatggtacagaaatcagtgaccacaaagtacagtgcagtgtggagcggggtgggggtagggacctggaaatctaagcttgaaagtgattgcaacaaaagttttagcataaggagatccatgagtacatctttgaaatataccaacatctaagcacatgaggagaatcctggagtagaagggtgaaacacttcaaattatattcattaatcataagaaactgtcatattcaataagtagagaaggagaaaaagggctcacacagtgtcctccatacacaatgacagcattgttttaaacatttcattaagcctgttaaggttcattaaagacagtttatgaacacatgtttcatataagttccttgtatttcatgtatcaacatttgtttgcaggaatatacattgccattctcagaagggcaaaaatgagagtacttaatgttttcatttaccttttctcataaataagtttattgtttggttgttgttttttgttttgttttgttttgtcttttgagacagggtctcattctgtcacccaggctggagtgcagtggcaccaccttggctcactgcagctttgacctgctgggttcaagcagtccttccacttcagtctcccaagtagctgggattacaggcatgcaccaccacacctggataattttttatttttgtagagacagggtctcgctatgttgcccaggctggtcttacattcctgggctcaagcaatcctcccgccttgacctcccaaagtgctggggtaacaggagtgagccactgtgctttgccgttatttgtttttttaaattatttgaatcttaaaggtaataatactccttgtattggaatatataaaattaattagggcagaaaaagactactatatctcatcactcaaacacaactacttttaacattcgatgtaaatatttccattatttttctatgcaaaggttttaatattcttttcctacctagttagcatcctgtgcgttcattgaccaatgtgtttaattctctcctttttaatagacatgaccatttaactgtctatttgaaatcagcaaagcactaggtttttgacttattggttaaattatatccatttacttctgtatctgccatatgtcaaatatcatgcttagtcctggagatgaatagtaaaataagtcacaagccatatcctctgagattctagagaaattaatttatccagcagacatttagttcagtatccattatgtcctcataaagtacggggcaccaagaatccaatggtcaagacggtctattaggggaggctcccaagtgcttcagtgttcattttattgtgtcatgcttgctaagacagagctgcacacacggtgctatgggagcagaaaacatggggtaactaaattagacctagtgaattaggggtgaaataattcaaggagaaggtaatagtttggctaatttttgaaggagttacatgaaaaggtaagaaagaatattctaggcagaaggaagtacatggcaaaagaaggaaattaaaagataatacctcattagagtggtcagagccccctgcatccatcaagtctaatgctctcccctcccaggggagagaactgaggcccagagaggttaatgtgctcaacatcaaataactaatgaaagccaaaatgggaactagagccatgtctcttgactctatcctatcagactgggagctgttgccaggaacaaaggctaaattaagcctccttattccgtttcatatttaacactaagtgagaggaatgatctatacttcacaatgatagaaatatttggagaccctttggctcaccatgttaattacactgagaactgaactgagagtctattactttaaaccgaacactgagtcattactttgccccatgaaggagatttttcaagtggtatttttcttaaggttgaatatcgaagtatatatctaaatgatataaatagaaatgtctggtgtagtccaatattaaacacagcaaaatttcaattagccaaataaaaatttcacagccctccattataatttaatcttgcttttcctttcagagaggaaatcatatgaaagaggtgtgttatcagacaacaagctgaagatatgtcaggcactgtgttctgagcccccacagtgggctacctgatatgttgaaagctctttgttactttcagtaagaggggtgcccattgggagcatatagttgaagtgaattgacagagatttatttcagaaagtcactttcagggtcagcacaatgagccaaagcttctgttgttctgcaaaagcaccaaaaactgttcacagcaatggccttcaggcgtggaagagaccagtctccaagaaggagacagacatcgttatgttctgctgatccaaagataaagggactaatttaggtgaaaataatcaaatatccagaattatacacactaaaaattctggtgtattaagtctctggcatatataaattatattttcacagtggttatattatctcaggtctaaaagtactgccttgttacactttaaatcctacataagaagagataactttcaaaattctgggatcatatttagtatgttaaaataaattgcaataattcaggaaaacatttattatcaatttcagtggaaaatctgactccttaatgagcacatttttttcactaaagccctttattcatgtttattagagaggtttctgttctattaggatatataacacatagatgggtcaaatatcctagttatgttttcatagattgtgtgtccagttgggtctagaagatttattttcttgaaattgagggttggaatgcttatttgttttctaagtttttaaaaataataccctacattgtaatgatgcaaagtagtgctcatataacagacaggattataaggtaatagcctttcttataaagtagtagacacagaaacaaaaccaaaaaatacctaggatttgcattgccattgaacagataaaccattagattggtttcaagtgtaagttccttttagtcaaataagttactacaataagcacttgtcagatgtttgctacttgtcatggtattgttattaaaataagtattttccatatactgggtgcagggagatgagggtgtattaaggttttataggatacaccctctgttccctgagtctgtagtaattcagcacctagaagatgagtgcacataggccatgtcatgaagtggtgtaagtgccccaaagaaaggggcaaggagaggtaaagaggactaaaagagtgttatgaaagaggtaatgtttgctatggacttaaagaggcagatttgataaggcggtaaaaaatgaaggcagcaactcaggggactgtgtggcaacagtgaccacagatcacctagatgactgaggtgcccagtgttcccgtccctgccctgcaagaaaggtctggctaggtcatgtggtaatgtctgcagtcccctcatcacacagcagagtgccttatgcacactagcagctcaatgcatatgtgctaggtgaataaaaggaagaggacttatagttatttccatagccattaaggagttgtttcttcaacaagagagtgagatccctatggaaagcagtcctgccctgcattgcattcatcttccctagcacagagctgcatacaaaggatgctcacagtacatccatggttgccggctggtatatctcagtgtatcacatcaaattcacctaaatcatgaaattaaaatgttggtatttcttgcattgaagtgtgactaagaggaataccacgtcattatgatggcagtataaactaattgctaacaatagccttcatgacttagattccttatctataaaatgggaataatgatagtacctacctcgtagttgtgataattaaatggattaatgacagtgaagtgctgcaaacagtgcatggcgcatagcgttatgatttttgttttgttaaaagagaagatattgatgtgagagagctaagctctgacaattagttagaagaaagaggagacaatttatccaagaggacagtccatgtctattccaggaaaatattaatgactgttcaacctattaaatttcacctgttgctgggtgcggtggctcacgcctgtaatctcagcactttgggaggccgaggcgggcggatcacgaggccaggagatggacaccatcctggctaacacggggaaaccccgtctctattaaaaatacaaaaaaatagccgggcgtggtgacgggtgcctgtagtcccagctactcaggaggctaaggcaggagaatggcgtgaacccgggaggcggagcttgcagtgaactgagattgtgccactgcactccagcctgggcgacagagccagactccgtctcaaaaataaataaataaataaataaaataaatggataaataaataaataaatttaacctgtcagcctgataatccctatcatattgtttataaatatgagccatagaagttggagatgtttatctgaacaagaaagatattatataaactttcaaatgctgatgcatttgaaagaaacagtatacacaatttaattatctttgctttgcatttcaagtctcaataggataatcacttatatttcatattgtaaggagcaagtatgttatgacccccaaggccttgtttagatttgatgaaggaataacgtgcgtgggattattgcctctgtaattgtgtaaatgtctttcatatttgaaaatacttcaaatgaaacaggaatgttctagactgattgttttatgcagaaaatgttaactttgtacatatgttatgtggaagaccattttaactttcagaactggtattcagatttgttcagatttcaagaaaacggggttcattttaaaaatgaggagatgcctggcgaagtggctcatccctataatcccagtactttgggaggcaaaggcaggaggatcacttgagcccaggggtttgacatcagcctgggcaacatagctagaccttgcctctacaaagtaagtaagtaaataaataaattaggccaacattgtggtacctgcctatagtcacagctatttgggaagctgaaatagaaggatcacttgggcccagtagttcgaggctgtagggacccatgatcacaccactgccctccagcctgggtgaaagagtgaaagcctgtcttaagaaaaaaaaacatggagactaattagcttctaaaatacttgatagtgctattttgaagtcagaatgctaacttttcaattcttttccatattttagttatttgaataccatcagccagatatctttaatatattaactgtaattgttggaggattgatttttttctgaacgtttatagaaatctttccagagagtagattcctctttaagcaatatagttatgtgactgaaaatgtacatggaaaagaaaatgtatgctgcatagttactggagtaaagaaaaatttaatcttagctaaaatataagttggcattacatgtaagcattagcattattacttaagatcaatacagattttgtgaaaaaaaaaaaccataaactaatccttgtattaagaaaaatgtagtgacattaagagagaaagcatcctatgtgagagaaaaattgtattcattacgaacaaaaaaccacacctgcaaatatttgtccctttctgtaaatttcatattgaatctcaggagaattcaatagtgtggtaaatgtaatttgtagttctttacaattatggcctaaatagatgaagtctaaagggagttttcctatttgattttcaaatttgcatcacttaaaatccaatcaggccaactgttcagatttttgttagatatgaaatacatgaatgggttcagaggcttcgctgtgtattgaaagaacatatctgactttacggcaggccttacctaaggggttcagtcagcttgtggttcaaccccattcctgtaaagaatgtttactgactgcttgatttgctaacatattatacccttcgattttcagcaaccagtgttttataggccagcagattgcctttgatttttgagaatttgtggtaacatattgagcttaccagatttatgcaggaatgtaaaataaaaatagtgtagcaggcactcgggatttttgaacacagaggggattagctttacagatggctggcacatataatggcattgagtaatttagccatgtaaggtaatctgttgttgacagaatacattaacatttacccaccatacacaggtgtttgggttgcactgcgcttctgactcagaacaagcagcatcatttgtagagtcagtctaaaagtttgaaatctctaaaacatgcttgggtttaaggacttattttagggagatattctaagagtttgccaaaatatactatataatttattcagcccctctgtccttaaaatcattatcctctgttggctacttcgtaaaatccaaatcatcagagaatttttaaaggattctgatttaattaatggaaatattctagcaaaagagcagaaaactacatatctaactataatttcacaaacaatgtaaagtctattatccattctcctgcaataatagttcttaatttagccatatattagaataatctgtgggacttactaaaaaagtacagatatcaaaacatatacacagccaccccgcccaaagataaagtgcttcaggtgattctaatgtacagccagggttagtaatcttttcccaataattaaatttacccctgcatttaaaatatgtacacattgccaggagtggtgactcacggctgtaatgccagcactttcggtggctgaggtggacggatcacttgaggtcaggattcgagaccagcctggccagcatggtgaaaccccatctctactaaaaatacaaaaatagctgggcatggtggtgtgcacttgtaatcccagctacatgggaaacggaggcaggagaatcacttgaacctgggaggcagaggttgcagtgagccgagattgtgccatagtactctagcctggatgacagagtgagaccctgtctcaaaaattaaaaaataagataagttaaaataaaataaaataaaataaaataagtacccataaaagcatctttgtttctaggtttctccattcaaactatcctacccacaactatcaactttccaaaagcactccttgaatcgtctttcatttccccaggaacctctgatgatcctgatgccaatgctgtcaactctaaactcggcttcctacagtcctacagcttctggatcattttcttttgacaattgcatgtgcatttctgggcacttccccagttaagtctgtaccatggctgctcatttcataggccatgctgttgcagtctctaggtctttgctcacagctgtgccttctccctggaatgcattctttgctcttgctgcctgccacctccatccaaatccaagttctctccctaggtctctaaatcacattcttaggatccccacccaaccctagtaaaagtaaatttgtattgtatttgtggtctctccaggccacctaacttagcactcccactgcttattttttatagtcttcactgattgcttcaggcatgtcatgtcttatatttgtcctgttacctactacccactagcctgaccttctaccaagccaccccacaccgtgccagtccaaacccaaataaacaggcaaagcaaagcaacaacaacaacaaccgaaactttgcacagggatggacagacactagatgctcaattaataactgctgaaataattgtgctcaaaaagggaggtaaagattaatggtgatgcttgtagaagtctgtgactatttaaaaaccactgaattgaacactttcaaggggtgaatttcatgtcatataaattacatctcaatagagttgttataaaaaatgaggtaaaaaattttatgaaagacattttgaaaatgtgaattttacttttctagcaaaagaaaagatataaaacaataatacaagaacgaaattgaatcctagtctgggaatattctgaggactggcagtttttgtggtgtttcttgttatgtgaaacttgagaacagggctggcaaactatggcctggcgcatgtttttgtaaataaagtttcattatgttgtctgtggctgctttcacactacaagggcagagttgagtagtggtgatggagaccatctgccctgaaaagatgaaagtatttactgtctggttctatggagaaacagtctgcctatccctactttagaatgtatgcgtgaagctatgttaacttgtattatttatacagcatactcatgagaagctaaaattcttaacaaagtctttctgatgctgacaaggtttttgtgatgtctcaggatgtagccctgtgaaactaacatcctatgaatgaagataatccctttcttcagagtttttgttaattcaagcacagcgattgacatcgaggcatgtgggtccttctgctgacgttcaattctcacttccatcccctctgtccttcagagcccttctccaacaccactcttcctagtgagttgaccctcactctcttctggaaggtagattcccactttttaacccttcttacgtttggcacctctccctgaagcatttctttcactgtaccttggttggaaattatttgcataattttcactccaaaaacctgaaataaataccggtctttgcacagttccagacgagggaggcacagagatgaatgtgatatggtatgtacgcctgagttcacactcctgtcctcatgaaggcagccagctttcttggactcccccactttccctctcctttctgcattacctgtagccaatttgtatgactgtttgctttcttctgcatcaacaaggaagaaccacacaggtagattgtcaaaatttcaccctcgctccagcacttttctaagtccactggtgaagtacgactgacacacagacaggcgattattgggtaggagtatgggtcctgccatcttgtgcctgcttctggatcatggctcctccaacaacttttgtgtgaacttaacctcacgttctttatctgtaaaatggaaacccagttctttgggttatcatgtggattgaagggaatgatatttggtaacattgctggatatgtatgaaactgtcagaacatgttacccattattatttcatttttcatttctagctcagtgcttattcactaatttttaggtcaggtagttagaatgagggccagtatcataggttatggttctccacttagtttacacttccagaatattatgaagtaatagaatattgtatcagttcattttcacactgctatctagacactacctgaaaagggctaatttataaaggaaagaggtttagttgactcacagttctgcatggctgaagaggcctcaggaaacttacaatcatggtggaaggccaaggggaagcaaggcacctccttcacaggcagcaggagagaagtgagtgaggacacaggaaaaactaccatttataaaaccatcagatcacgtgagaattcactcactatcatgagaacagcatgggggaaaccaccccaaaaatccagtgattttgctacctcaacacgtggggattacaattcgagatgagagttgggtggggacacagagacaaaccatatcaaatacgtagcaatttataattggtccataaaaggggtatgacttacttcattgtcatgattaaaaaataaattcagctcttctactctggactgcagatctcaaatccagtcttctcttgtttcactccttgtctctttctctttcatttctctgtgttacagatgttgctgtcatataaatgtcttcctatttgtaaagccattgacctcacctgattgttacgtataatttttggctgcacaaattacctaaacccttccaagagcataattagactcagcaaactgtttatctttgtgtgtttttcactgtaaggttcaagcagcaatacaaatggaacaaaaagaatctgtgagtcaactacactgtgcacactggtcccatgaattctaagtcatatgagtctaagactaaaatctgtggtgatcatgcagagatgcaaagtatatgccaggttttcaaggatcttattttgattagacctgtgggtttttttcttttcaatatcgttgttattcagagaacataaatgagttatgaggtagacaaaggcatgaatacttgtgatatattttacctaaaatctgctgtttcagagttggttgggagcagtacataccaacttcagaagaaatacccttctctttgaacaaaatgaaaattaaaatgatgcccttttgttcctaggaatgctgcctcaaacttaacattagttgtaatttcttggacatcatttcaaaccaaaccagaggttaccctcagtctgactgcaccagtttaaagcacatattttcatatttgacatgttttattatggcagaatctgaaagtatggagcagtatgacgtattaaatatctgcagcaccatatgtttagatctcttcatcttgataaatgtcccactccccaattctgctacctcccttttattgtgattcaagatctctcttcccttcatgtggtttaatagattaaattttagaagccagaaaaaaattaaaacaatgaaggggagtttcgtgttatgcttttgtagtgctctgagagggatctaaaaagaaagggggaggatgactttatttctttaagtctgatgtgcttcatgatacccgtgtcctcattccacaggtcagagtgtagagaagaccacggtaacaggggcagttgaaatgcagctatctgaccctcacctgcttggtcaggatttcagttgtttgcagtttgtctgcaaacagttctggagttccccaggtgacatcagagagtctcgctctgtcactcaggctgcaatgcaatggtgcaaccacagccttgaccttccaggcttaagtgaaccacaggcacatgctaccatgcccagctaatttttttttgattttttgtagagacagaagtctgcctatatttcccaggcttgtttggaactcctgggcttaagcgatccttctgccttggcctcccaaagtgctgggattacaggtgtgagccaccacactcggcccccaggggacctatgggttcacacacaaggctgctcccatggacatcacctggcctctgctaggagccgatgagtatacacctgccagtcactggtgaaagtggaggtctgaggacaatgcttacataccaggtttctgataagaagtaaaagaggccacctctgtcctcctcagttcaccagaataacaggatgtgtgcaattcctgtttatgcttaaactgctgcatagatttaggctaatgactgaatacaaaaaccaggcatagtagtttcaacccaagaagctgtggagcctcaggctataataagtagccagagagaggttgaatgggaacctccctgttgcctccactcctgactcatccaaagcaactcaacttttatgtgttttacacactgagactccagaaaattttgcttaaaattttactctgccctaatcagtcaatttctgcttgtgttttatgatttgcattttagtcttatacaaaatactttccttttaacagaatacttatgaattttgcgattataaacatgatcttataataccttaggacaatatttacgtttaaagaaaacacaccaacagtatattgaaagctgatgggaaaatgaactctgagaaggaaaagtgctttcatacaacttttaagaaccattcctttatcaatataaagtattcccttatttgaaggtttgggcaaaaaaggcaggagagttttatttcataattattgtcaatttctaggggttgaataatgaacacaaaattcattagcattaagctttagcgatgagagagaatttatcgaacccatttttctgaactatcaaaggtatcttgaaagtctcaagtcatccagtttcaatgcatacctcagaatattcccctggccaccttagtggatggaagggcaggcaaataaagatagctattccaaagacagaaagagtaatacaatgtcttatccagagagtttacagaatcttgagtagttttcatttactatgaatacgtgtgggtttttttttttttttttttttttttcagtgtatgaagctatttaaggcagttaggtttgaaaggaaatgaaaaaataaagtggatctagtgcagaatgatgagtgaggaaacggagaatcagagaattccatggagaaaagtaacaaaatctcatccaaacactgattactaatgtgaattccttttcaacatccccagatcctcttctgtaacttcagtgatagagaagcccctgagagataggcagtgcactgtcatgggaaatgcttagcatctcatgctttaaaggctcacatttgagttctggccctacaagactccttctagagtgagaccctgagaaaattttcagcttctccaaatcccgatgtcttcatttgtaaaataaacatatagtgctgtgctggtcattatgcatcttgtccctcattctttacccttatctctgtccttctctttgccctaggaggcttgacctctacagaaagcatcttccatgtctctttgcttaccagcatcctgttgggttgtgtccatggaaggcaccagcaggagatggaggagggcgcaaggagagagaacacagtacttctttactggtctctgactgctctgggctgtgtattctggctgtatccttccctgtctacagctgctttggttttatgtcaacagggtctttcctggctcctgtaaagttagttctttcccatacctcttcagggccaggagtaataaagtcttctccttccttcctgctgttgcaatctctgagaatctctatgtctcttgttctctttgctctgacctctgtgtcaaccattcaaagtgtcttgaaccacctgcactggattctcattcctgtcaggaccctgtctcatcccagtaactagtctttctcagatttgttgagaagttctaatgcagtactatatgaaggctttttaagaattttacagctgttacttttcaaccttattgtaccaaactagccatttctttttcattgagctctcatacttattatcttaaacttgcttgtacattaatatgatgtctcctttcatattagggattaaatgtaatcattgacagctcttcagattcttaaagacagtggcatttgcacccaggccttctgttctttgagctaatcagtcaaaattacttcaaatattattcacatgacttggttttaagtttttcctccattgtagtcattctgttgcgcacatcccagttccagatcatttcctctgtaatgttcagaacttgactcaatatcccagatatcatctcaccagacaggagttaactattttttccttttcgtttgtctatcagcctcttctctgcagcacttttttcctttttcttttttaaccttgtacattaggcagaacagaccccccaaagatgtccatgccctaatatctatgaattagtaacagaacttgtgaaccaatgagtatgttacagaaatcttccatggttaaagggactttgcagatgtaatttagttaaggatctggagatggagagactgtcctggattgttcgagtggcccctaggtaatcacaaaggtccttaaaggaggagggaggcagaaaaggaggtcagagtgatgccatatgagagctcaacttgctgttgctgggcttgaagatggaggaagggaccatgagccaagaaatgttagaggcctctaaaacctggaaaaggcaaggaattagattgttccctaaagcacccagaaaggaatgccggtctcctaacaccttgattttagtccagtgagacccatgtcttatagacctgtgaaaataagtctataagataatacatttgagtcgtattaagcaactgaacttgtggtaattttttttagcacaagaataaacaatacactttgtatgaaacattgatctcatttttttttcttttcataagattggccctatcattccaggttgttgagaatatctttactcatatttctattatttattggattaagtgtctgttgaggattcattcattcctaaatttgttctgcatggtaaccatgttacttatgtaggtcttggccacagctggatcctgataaaagtccaaaggtttgatatttggcatttctctctaaattcgcaaggatgtattaatcaacaccatttgtaaccgtatcttactcgactgtagctccgtttttttttctttctttcttttctggaggcagggtctcagtctgtacccaggctgtagtgtgatcacagctcactgtagccctgcatccttaacctcctgggctcaggagatcctcccacctcagcctcctgagtaactgggcctttagctactatttgtctatattatccaccagaccatcaggacagatttgttacttttttttcatgagaagcatatttagagaaatttgccatctcccctatctactactctagtaattctatcaaaaattgatatcagagtagtctagtgagtaatttagaacacagttgaaaaaactttcaaattaaaatcccaatttcattacttatgaccattctgtagcctgataatccacacaaagaagaacaagaaacattgccagaattaattacttttacatctcctttttcaatagctagagtgggtttgtcttacgccactcttaatgccttgcctctatgtgaaaatgcaggattcctggaaggcgcaatcctttgggaacttgcagaagcaacttcatgtattagtggtcatcaagtaaacaatcagctaccttgctaatagtgtcatgagggtaactcctgaactgctgtgctactttgctttgggcattagtggttttgtggccccttctaagccatttacacaagtaggagcagtgagatttgctcttttcattggatcatattttcttcttgcgcagaaagccttgtattttctgctaggcacttggttggaatgggatccatatcaatttgtctcagctgctgaatggtacttactatgttatatggtgagctataaagctctgttcttaataaataggtgaactgcttttccatccctgtttctcatttaatttaatttaatggagaatattcaaattggctacatgatgctaattcatgtttaaaagtgtctgagtttggaattcaagtccttagagtatgtcaggacaaagaggtttatgagagaaggtgtatttattgttgagatgagtagaagaacttaattttagttttattttaatatttagcatcttcatagctacttttaaaatccactagagaaaatctgctcaggtcatatttctaagatcctgacaaaagaaaaagccattctcttgaaggttggggaaagattgtcttgcaattctgctgactcaactgtaaagttacaatgagtacatctcatacaattgagtagtggccagtagtaaggaatttggtgtttgacatgtttaatataactcacatacatttgcaatttcaaggaaacacaatattgtttatagaagccctctaattttcataagttgctaccttcatttggtacctactgattatcatgtgctaactaggagaaaacacctacaagcaaacaatattatagtgctgcgattgattctgctttaatgttgcttgttcaggtagcaaagccattagctacttcttgatagtttttatgaatagacttagcacctagtattgagcaaccactgaagaatgcatcttccgttaaaaggttgatttattagtttatatgtaaaagaacactggaggttataaaggtaacaaagaccttaaacattacattgatttttttttctcagagctttttttcttcttgttgtattgcagggtaataaaatttcactaggcccattggatctataaaatctgaagtacaaccaccaactgatacaaatgaaattgtttgactggagcgataagcaaggacttggctttgaactctgagcagtataagtcgtttctctggcccgtgagggtgaattacagcctgctgtgcattaaaggacaggcatgtatttgtaggagctcccagttcagtaatcactgggtgatacagtgacctttacatggccactgtagtttcacaaagaggctctttagacatggaaaatcaacaccatgcctttttaatagaacttagatatttcattatgcgaattaaaattgtggatggatataagatctttgatttctgaaataaaaagtagaataggaaaataggaagttttgtttgcaaatctcaggatgtattatatttaagatagtgagcttttctttctttgtgtgagttgcaggctccccatagtataatgtgctgttctgtgacagactagaattttttgggcctctactatgtgctgggcacagacttaagtaaattcttggcatgcgaaccattagctcatgttacctttgtctccctgtagccccagtactgtcccttgcagctcccagcactctatcactctatcacccagtgcttgaggcatgattcccttattaccagcctcatcagtcaagtacaatagagagccagtgggaaagagctctgaaacctacccagcaaagtgaagttctgattgcaacggtgaaggcttgagagcagtatgcaaattagcgaaaaagtaggcgaggtctaccttaaagctggcccggcctggcgtggtggctcacgcctgtaatcccagcagtttgggaggctgaggcgggcggatcaccaggtcaggagatagagaccatcctggctaacacggtgaaaccccgtctctactaaaaatacaaaaaattagccgggcgtggtggcgggcgcctgtagtcccagctactcgggaggctgaggcaagagaatggcgtgaacccggggggcagagcctgcggtgagccgagatcgtgccactgcactccagcctgggtgacagagcgagactccgtctcaaaaaaaaaaaaaaaaaaaaaagctggctctgttgccatttttgtaaattgatatagaagtgattcagatggacctttccctggccagctagcaaaatttttaattcatccagataagtgacctgaagtctccaaaggtataatttaaaggcatccttgactgctatcacatacctgggggtggctagagtgggaagtaaattcacaataactagctcttcgtctgttactgccatgacgaggcaacctgaagccactgaggccttaaatcaaagccatatgctagacaagtagccatctttcaaaggtactgtcttagtctgttcaggctgctataacaaaataccacaattggctggcaactgacttttatttctcacagatctggaggctgggaattccaagatcaagacactggcagatttggagtctggcgatggcctgttcctcatagatagtgccttctagctgtgttctcacacaatggaagggcaagatagctttctgcagcctcttttaggagggcatctaatcgtattattcatgacctattcacctcccaaaggcatgcctcttaatactgtcacactggggatgaggttttaacatatgaattttggagggatacgaacattcagaccatagcaggtgcatttatcatcttttattttttggagcctaaattcaaatttgtctttcctgtcacttttaccataaccacagatttatttgtttttcattttgctttaggtattatgtgttgcatataatatgccatattaatccccaacacagtggagaaccaactgtgctggagaggttaggatgggggtcaaagaggtgctaagttccgactggtaggtccctcttttagtttgatagatatgattggagcacatgttggtgcacattggagccaggtgcagaaatttgactgttcttgcaatgaattaatgttacacaaaattggccgggcgcggtggctcacgcctgtaatcccagcactttgggaggccgaggcgggcggatcacgaggtcaggagatcgagaccatcctgggtaacatggtgaaaccccgtctctactaaaaatataaaaaattaaccgggcgtagtggcgggcgcctgtagtcccagctacttgggaggctgaggcaggagaacggtgtgaacccgggaggcggaacttgcagtgagctgagattgcgccactgcactccagcctgggcgacagagccagactccgtctcaaaaaaaaaaaaaaaaaaaaaaaaaatgttacacaaaattgtgtctcacatattgccatattgcctaaagattgtgttctaaatgaatatctgatagggtccaatttacttttgcaaataaaatgccctgaagtctcacattactcctatgcatatgtgtgttcgtttacattgtatgactgccagtcttgtgtaagtgaagtggaaacatgtacataaagagcagatgagtgttacacacattctcatgttatgccaggatggtgctgatggaaggctaagtcaagcgccacagtctaggtaagttcttgcagcaaaggttcctaaaccagggtagacaaatacgatgtatacatccagcagcatttcatgccagccatcactgcttgatgagagctttctttctgaaaccacaaaatgcatctcaacactgcattccagatagcccatgtcagtcactcactgctgtcataccaacaggaatccaactgccttttgccacccttaccctagaagatcactctaatggccactgggcagagctgctttgctgccagcagaaatagacatgagtttaatgtgggccacagggtacacgtcacacctgccagcccacccacattatcccagcaaaacaatgggctaagtaattactttgccacaaaatgtccgtttcccttgtgattgagtcagtgctaaatgcatcttaccttagctggtagaaatgacctaaatgatataacaaagcacagccaaacccctgccaggtagacctttggaaatttgattctcaagcaagtagcgtttatctttctgactgatgtctagccatgtttctatttctgtatctatctggagctctgcctatctaatcctttgttattgctggtaatttcaggaaggggttgggggtggaaattgcctttgaatggagtaaaatttaacatcaaacctgtgaaacataccttggggtgttccagtggttatcagctctaagaccacacattctgcagacagagcatgtcctagaatacctgcatggccagttgattcgtctcagaaatcccacatcttgattttcctctatcttctgttattgtctcacttaaactaggttgatcttattgaaggggaagaggaaattcacatgtcctgaccggtgtcagaatctttacagttatttcatttaatccatataatgccactgagacatgggcattattatctcatttttcacatgagacaaccaaggctaatagagtttaaggcacttactgatgatcttcacaatattgcttaaatttatgaatgggagagccaacattcaaatatgggtttggaaaaaaaaaagccaagctgtttatctaatgaaggatattacttttccccttttagcaactcatgagaaaaagaagtctttatgaaatttttctttgaaaaatgtcattaaaagtttgtttttgttccaataatccaaacctttgtgggttctagtttatgaaaaaaagatgtgccttattccgtgatttccttctaaataatgaattagagagaggtaaggtaattctctgaaggatgcagatagacgaattacacaagttctgggtaaatgtgctgacaataatgaatagaattcctatgcaacttgatttggtgcaatattgcccagttcatatggtgccaaccctcattcttccccacccctccagcctcgttgcttctcttcattttacctgattcttttcagaaaaggtgggaattagatgtgtgaaacttacatgataacccagggatcccctttttccagtttctctaagctaaaataagtgacatggtctaactcatcctatgtgtaggtgggatgccaatatttcacctctacaaaccacattaagtggcaagggatacctgaaatgtaaataacactccattaaagtataacttttaagaaattggcagaatcaaatccctgtgcttgaatggcatttcgaagcactgttaattccaagaatttttctctctgttcaagtcactccgaggagtcattttcatttgcctgtctgttcaggattttatggcatgtaagtgacaagcactccctgtaacacatcgtgggagggcacccgctaaaagagagctcaaactgaatgacattggatgtgaaatgcaacctttttctgccaggctgtgtgatatttagcatgccttgacatatgctaagctacaaaattttaaagcacagatcccttgggaatgttacatggaatatgtgggtcagaattctctcgtgattagttaaaatgtctaaaacatttttcacaatttcaaatgaattttttcttgagctctaccataaaaatttgacatattgaacatgactttacagactttagtctctaagtaaatggcttcacactattggaagaatcaattatggtggatctttctaatgcatactgtctataaaaacaagccaggctcggtggttcacacctgtaatcccagcacttttggaggccaaggggggcggatcacttgaggtcaggagtttaagaccagcctggtcaacatagagaaacgctgtctctactacaaatacaaaaattagccaggtgtggtgtcgcatgcctgtaatcccagatacttgggaggctgaggcatgagaatcacttgacgctaggaggcagaggttgcagtgagacaagatggcaccactgccactgtactcctgcctgggtgatggagtgagactatgtcaaaaaaaaaaaaaaaaaaaaaaagaagaaaagaaagaaaagaaaagaaaaagaaaaagacaaagaaggaaagaaactgacaagttttaataatcaagatattggtatcttgaaacatctaaaaataaaataattactggtgataggtgaggggaatacatacgtatattttttgcttgcccacaaaattctgggtatgttactatttgctgtccttcatatccaaaagagatgctcgtaacccattcatttttctatggtgagtttttttaatatcatttattgaagtttgtggccatattcaaacaggcaggtattttatttcctctattagataaggtatttatttatgttgctagcacttgatggttatgttctccttgcttccgtcttatatatatatatgtgtgactagaatcttttttgggggacagggtcttgctttatcacccaggcaggagtgcagtggcacagtcatggctcactgcagccttgaaccatggggctcaagcgatcctcccacctcagcctctcaagtagctgggaccacaggccccctccaccacaccaagctattatttttattttttgtagagataaagtctttctatgttgtttagcctggtctcaaatgcttgggctccattgatcctcccgccttggcttctcaaagtgctaggattacaggctttagcctctgtgcctggcctgtaactgggacctttacacctacgtcattaaccttaacagccctctggggcaagagcatacctgtgatcataacaggaaggaaaaaagctgggaagaaaagaaagaaggcagccaatgaagagatattcagaatgattgttgtcctcgccactccatggaaattgctcttttcaaagcatcagtgacttctgtcttgccaaatccaaatgtcgtatcttttacgacttttagcaacattcaaaccaggtgattactatgcctttattgcaactttttttattctattatttccttccttcctaccttccttcccttcctcctgagacacacaccttcctgttttttcccctaaccataccaggcattttttccagaaccactttcctggaggttcttctgctcctgattctaaaattcgcagtgccttggctcttctccttctaaacacactctttagcaggtcctgtctatttgtttccaaggctgtaaattcctcctgtccattcatgacttccaagtttataaccccagccctgacttctctgtgctcaagcctatgcgtgcacacacgcgcacgcacgtgtgtgtgtgtgtgtgtgtgtatgttactgcatagttgagctttctagtgcaatgtcaaacaggcagctcaaactttatatgtgtaaactagaatcattgttttttgaatcaagactgcttcctctccaactgttcctaccccaaccatcctcatctcagtgtgtgcaccgctgatcatccaggcgtctaggtcccaaacttaggagttgtgcttgcctcctacctcacattcaatgcacctgcaggtcctgtagtcttctccttcaaaaggtctcaatctctacaggctcactagcccaacaagtttcacctcctcaactaatgcaagggattctaatgtgtctctttgtttcctctcttgcctcatgatgaccaattctccaaatagtagctagggtgatcttttataaatgcacgtgaaaacatcccatttttctgtttgagccttctcgaataaaatcctaatgccttaccctgatggatcaacaagatgagctaatttctccaacaaacaatccataaaactcagtgatttaaacagatttaccttaaaagttatacatagaattactgtatagcccagcaagtccactcctaagtatatactccaaagaattgaacatagtcactcaaacaaatacaggtacacacatattcatcacagtgttgttcacaatagccaaatggtggaataacccaaatggctatcaacagatgattggataaaaaattgcggtaatgttctctagccattaaaaaggaatgaataaccaatatatacttcaatgtggatgaactcaagaacattatgctatataaaagaagccaaagcaaatggttatatattgcatgattccctttatataaaatatccagaattggcaaatctatagagaaagaacataggttggtggttatcatgggctgaggaaagggagaaatgggaattttaacaggcctggagtttccttttggagtgatggcaatgttttcacactagatagaagtggtggttgcacaaaattgtgagtgtactaaataccactgaattgtttactttaaattgatgaattttatgttaattttacttcaataaaaaaaaaacagagctcatttatatcacaccctcatctagagtagctgaaattcctgctctatgtgttggtcattttcagtctcagaacccaggctgacagagtagccactgtttagggcattctttgtaaaatacaaaattcatgagaacagaaaattgtttcattaaatagttttaaaataggctgagtgcagtggtggctatgaacccaggaatcagcttgggaacagttttccttttctccatatggagcaaaacatgcaacccagtagctggtagcaatagtctccgtggtccattcaggaaatggcagaggagattaagaggctgagagttattccagcattttgggaggccaagtcaggaggatcagttgaggccaggagttcgagaccagcctgggcaatattgtaagaccctcaactctgcaaaaccaaacaacacaaaaaacaaaatataaacaatccccccacacaaaataaagatatacaaggaaaaaatacctgtttgacaaaaattccatttcgtatggttacttgatatctgtatgttagttatttgtcttcgccttatttagagagttgaagttcaagtgtttacatggcatgacccttctttttttttttactttgaatcccttcgttgctccagtgttattccagatttcattactgatcttccaactacccctttttgtattgagaccatttgtgttaaagaaactgttgaacataatcacatttttcgtcttaatagccctatgagacagatactatgattatccttatttaattggtggtgaagtaggctcagggtaagcagtttgtctgtggtcacaccatctattaagagacatcattacttatggagtgcagactgttgacttcagggaccaaatctaatgactaaattatgctggctttccttgtgcactaccaaccaatattaaatccagtttaagtgactaaattaacaagaacaacaacaacaaaaaaattttaatgtgaacaagaagagcacacatttattaggtagctggccagggattggaactcaatattttgggggaacaacaaactaagccaactatttcttgtgcctcttttggagccccgtgctctaaagatggctcttttgaaattcaaggacagcaaattatatgcatttgttcctgattaagctaattcactaagcactttgcataagaacatggctaaagagaggactgtccttccatccactggatttcaataacgcggttaaaagaaagaggtcagaaataaagaaattacaggtttgtttcaccttccttttaaaatccttattacagacataggaatgtttccaaataaattgagagaagaacagaagtaaactacctgtatatgagaacttaaggagaccacatagagacagatagatactttggttgagtctttagcttataacttaaacagtggtggtaggggactcactgtgcttttttctgccttctctgtcttcctttggttgcttttcctttcactcttggccagtgattattgaaataaagcatttatctctgtgtgtgatcaattaaatcggaaacactttttgggttttacaattctgttcaaggtattgtttggctttgtggtttctaagatatattccatgccaaaagtgtggttttattgacaaatgaatacatttagctggaagagcaagacagctttggaggaggtggaggaggtagaaataacttactagatggcacgatttgaaagtgaccaaagcactcccaccacctgtgaaagcgactgatattctactgttactacatgtgaaaggtttagatccttacagtaaataggtgcatactcctagtaggggtaagcatttatgccctcatgaactaatgcctttcttggggcatggtgaatgaacagcctttgggaacagtgttatagagaaagggaattcagatgggaatgggaggagcaagcaatggtaggaggacagtaatggagagcaagaggaaaggctcccccaaagtcaacctgcttcaccaccaggccaacctcttgctagatcaggggcttatttctactccacgggtatgaggctgcttgaaacctcttttcaaaaatgccttggggaagaaattctaactatgctgattgtgtcaaagagcctgtcttaattctgaaacataattccaaatatttctggccttctagaatactgtacctattctaacttagtcatgtcagtctcagcctgttattctcctctgctataccctgaatagaccacggtggccattgctaccacctacggggctgcatgttttgctccgtatggagaagaggaaaagcgtttccaagctgattcctggattcacagcatctatgttaagtatattagcaccttccatttgcaactgggagggtttcctcaggaattttattctgtcgggtattagatacaataataataggtggcaggccatactggagaatggagggcaccagtaaattactgtgaggaaagcaatttgacatcctttcatcctttgatgaaagctaaatgtgaaatctaggtgtaaacgtctaaaaaaattgaaagtcacactcagagggggagacctaggagtgtggcgaaatcactactcagagagggaaaagacttgaggttggactgtgatttgacaacattatttctttccaagattaatgtgtctgtggaactacttggccttattcctgggtcctatcaatttagcaaggacatttacacaaatggcttctgtagtctagctgatattggggccagaaacactggcccaagaattcaggttcttctgttttgaaagacgtataatgctggggaggcgagacagccccattttggcatccttaacttgtttctatccttctacctaaggctgtctgataaggactgtgaattttacctcactatgtctttgttcaatgtttcttgtaaactcaaaagcaaatgtacagacatagtcagctatttcctcccctcaccttccactcaaaaatatactttctttgaactaatttattttcccttcctcaagacacgcatataacatattatcatcactattatcatcatatttccttatatcgtttattaatagtttcatatatacatctcatttcctgaattaatggtgtttttctctgaggcgggtctttatctccacagtgcctcgataaagaatatgaacgctagctcttatgtggtacctacttatcctaaggcaggtgctatgttaagcactttgcatggatgacctcatttactgctttcaaaccctgatacatttggtatttataattatcccccttttcagaagtgggaaatatggctttaacgtattgtcttacatcacaaaaatgtgagagcagagggatttgaactcaggtttggttgcatgaagagctatgttgtacttttttcttagtaaatatgtgatacttaatggtgccttagtgctttggaacacactttcttgaaacgctgtggcttaaaacagcaccattttctttttttgctcctaagtctgcccctgagtttgtagtttggacaaggctaagcaaggatagctctactgtgtgtcagctggagcaactctactgggctggaggtcccatctaagggggtcttacaagttggttctagttgctggctcagttctcagctggggctgtaagttgaaaacctcattgctccaccacctagtgagttgggattcttgcaacacaaaggcaggaaatgccaaggcttcttatggcttgggccccaaagtggcacagcatcacttccaaatcattctttggttgcagcagatcacggggccaaccagactcagagaggggaccatacaagaacatgaatactggcaggcacagttcatcgtcatggttcaaagttaagagtctgccacacaaaaggagcagaacctttgttcattgttttattatcagcaaaaaatctattaagtacccattttattaccatttatgcagcgctacaataaggatagagaagaagatacagcttctacttgtgctctataatagtacctgataccccagaaattcaaacagaaaccaaaacaaagccaatcaaaatgacaagcaagagtggtgagtataaacatgctgcacattggaaaatttggcattttcattctggagatatttttaagagcaacaacatccaaaatagtattttattctaattcgtggtatgtgtgctcctttattttaggcactttgactggcatgatcttcacaagacagggaaaagacactcaaacacatgcacgtctttacgtctaggtgcaaatggagtaaaaattagatatgctggagttaggttacaagtggagtaagagctgcgggtgtctggattaatgtggtggtttattccaagagcagtaataaagagtcatatcactttctattgcagcagggcatccatttagggaagtggatcttcaggttttgtttccaaaatagagcacatattttcagtgctcaatgaaagaaacaagggagagtgggtgacagggtgctatggcagccctcgttatttatagtttggcaatactgttagtgttcacccggtggagaactgaatcccatctaagctcgtaattttcatatctttggaaagcttttagctcctctctgcctgttggcatggtaacgtgacaagagttatgatgtcaaaaccatatgaactcatgattgatctaaaattatttgggaaactttcccatttcaaatttccattgagagagagaaagaggccatgcagcaacttcattcaaaagagaaaaaacaatccgtttttttttaattgccctgaaataaattctctattttcctttctatgtaatgctaaaaagattactgtctttctgatgtctttggcattttctttcaaaatcagatattttaatttccctttctcttggttatttttttccctattctaatcaaaatcaatggctgatgttagcacgtttttcatgctgcaagtacaaagcagggtaggcatgcaggctgatggatggcctctgggattctcaggtctttcctgaagcgaagttggccctgaggaaatgttgagggttggcagagaggccggtactatctgttgggtacttgcaagctagagatattattatcacttccatgtagaggagagaaaaacagagggtcacacagatgaggtaagttgcctgaagccagaaaatggtggaacagagaagatttattggaaaaaaatattgaagcctgttaacaggaggaataggttttgcccaggtgaaaataagtagaaaacatactcctaaggtgtgtcaacctaaaaaacaaacagagcctcaccaaaatctgatatttattcaggaatagggcattgcaatggacaacctgtggcatagtaaactatgtatgtattcacagaggtaagggaagccaaaggattttaaggaaaaactgaggagtgttacataattgttttgaggtaattatccttagctacaaggatcagtaccaagggcgaaaccagtgtaaggttggacaggcagttgctgggcttgtgtcttcacagaagtacctgatagtccagaagttcaaacagaaaccaaaacaaagtatttgtcaatcaaagtgacaagcaagagtggagtttctttagttttgtttgtttgtttgttttgttttgtttttgagtaatgttgcagtggcctttgtccaaggttggggttttcagagacttttgtgatactttttgttatcaggcattcatgtatgagagccttccctttgtcgccatcttcaactctttttgtcattttttttaaacacagataactacattttgaatctgaaaactttcgcaggtgtatcaccttgggaaacttaggaaacttattgagcatgatttcttttagtctcagtttaccaatctgtaaaatggggataataatagaagtctgctgtagagataatatatgagaagtggagctaaagataaagcccaatgcccgtcgtgaaggagacaaataaatgctaattgccctgtagaagcaaatgggtttatgtggaatcctaaaaggttagcgagaaggttcaacacgtttcttatttcaggcaccattttctgtgttacttaagacattggacttgaccataaggctggacattgacgtacttacttctgctaccaaaataatttcctgtctctaaccaagtctcaaactgaccacatttaagtaaagttcttcatcttcagtcttcaacatcatcccttagcagcattcctagtcaaagaaggatttaaagttggaggaagttatgatattttttctaatattatttgattcacattcatatatatttttagagcagatataggttgaagggtcaggcactcttctaggcaaaagctgaatgaaatggacaaaatccccattattggggagcttaaattttggtgtgggagacagataatacaaattataaacaaataaaacatgcaatgttataaagtgaaaatgctaagacattaatcaatgagaagaaattaagttggggaggagtcagacgaagcgtaggaggggtaaagactgagcttgaggtcttagattaggtagctctgaaaggtgtcattgaggtgactttccatgcagatacctggagaacagagcgtcataccaagtagaggggataacaggtgcaaaggccctgaggcccagagtgttcaggaacatcaagaggctggtgagcttggaacacggtgaatgaggaggaggcttgttttctcattttctgccctaagaatatccttcatgaggtacggagcacttggaccaacaatctgaaataaatggataaggagtgacttgccttattcgtgaaacaaaatgattttgagttagaggcagactctgggttctctccatggtatcattccagtggaacttggtcttcagctgttcctcacagttggtttcattcagagtcatcaaatcattgttcacccttcatgtatatgagagatgtaaggatttggaaaaacaaactcagtttttcctactctactgtcacaacaccgtcaacacaaaacacttctgagaccccagatgtgtgggagtttccccccacacactaagagatcaattttgcagcagattcttcagcagacaccagctgggtgtcctctacgtcaattcggttctgacctagaggtagtgtcagatcctacaggttgagggctcagtcccatgaggctgtccctcacttcagatgccatagcaagcacaggttgtggcctgtgcttctgaccaaccagctataaatcagcattcccacgaccctttcctcaggtccgattaatttgctaaagtggctcatagagcttggagacataccttacttacatttacagtttattatgaaggatattacaaaagatacagatgaataaccaggtggaagacatgtgttagggcaaggtacggggaaggggagtggagctcctatgccctctgtaggcgcaccaccctccaaggaagctacacaagttcaaattatctggaagctcttccaaactcagtcctgttaggttttactgggaacttcattatgtagacatgattgattaaaccattggccgttagtgaggcgcccaaccttcagcttctatcccctaccaggaagttgggggttggggctgaaactcccaatcctctaatcatgccttggtcttctggtgaccagctcccaagctgaatttatctagggatccccagccacctcattaacatacaatagacactcatcactctggaaattctaagggttttaggaactacatgtcaggaaacagagaagaagatcaaatatgtatttcacattctcacaagaggaaaattttataagcttttctaatctgtgggcatgtgtctgtaataattccatttaaatataattaatgcctatctctggtataacaaggatttttgcttgccattcctcactaaactgtggggagaaattcaggccaactgaacaggagacggattgtgactgaataagacaccataccctggagttgaatttcaatggaatgtgattcacacaactaccttctgcagaatgctccttcctttttattgagatgtaaacggattatgtctccattcgagagcacttttgctttctctagatggctgcaaaagtgtcttcttcaggcctttccatcagtgcaagttcaaatattgctgtcccagtggattaaaagttctatttgttgatttgtttgttccatacatttaagattttgaaagaattttaagggcttttgtatcaggcacaggcattacgattacattttaacctcacagtgacctgaaaggtatattgtcccattgcatagacaataaagctttgagaaatttaatacgttcttccaaaatgtatatagtacagaagagccactgtttccttggtgaaggtgtttgcttgtaggtgtagagtgtttggccagttccttccccacttggggcacagccacgataatgcagagaacagcaatcatacttgccctcttaaagaaaaagggaaagcctcatatttctgcagtgcatttaggcacatcatggcttcctgcctttcagtgatcaaattgtttcttaaatatgagacttgttctcagagttatacaatgaatcctatgctaatccactgtagaactgccattttgttctttcctccctgtggtttagactttctgattcacacagagcttgaaacttaaatgttctacatatatttaaaatagtgtttcacagaaatgtattaataggatagtcttactaaataattgggggtaatttatccctaatttatgtgaatcaataaatgcatgagtgatgtaattgcaaacgtacacacacacgtgcacatgcatatgcatgcacacacacacacacacacacacacacacacacactggttctcactcttctttgatatgagagatgtaattatcatgtagacccaggggcagttttgcactccaagggacatgtggtaaacgtcaagcatttttggttcccaaaactggggcaatggtgctactggcatgtatgtgtagaggccaaggaagctgctaaacaccctgtagtgtacaggacagcccccaccacgagaatgatccagcccagaaggtcaacagcacctatttagacttgcctatttttaatattaccacctttactggaagcttgaatttggaatcatgctatcctagaaaatatttctgttctaatatcaaaaatgctttaaaaatacagttattacatgcatagttttaaatagtgcattataatacaaacatactaacactaattggggaaaaatgtagatttttctctgttggaaacctaaaatataacgctttttaaaaaatcttaaaaatacttgttttcctagatttctcctccctccccctctttttctttattttttctttcattttgtgagctttcagactcaataagccttgccagtctgtgatgtgtaaaattatctttctctggccagagggaattatatccttctcagcctcaattcaactcatctgtcagcctttactgagtacctgttgggtgctcaagcttgggtggtgagtacagtggaaagaagggagtaatgcagggactctccagctgaaatactagtacagagcagcagcgggtggtgactcaggcctcaaactgccaaatgcaaaatctactttgattcccacttccacatgaacaggccttcactgaagttcgcatagggtaaggttttaccattgagatgcatattgtttttttcttatggaagagaaggatagttttaacttagggaattcagttgcattcatttcataataatgatactaagacattcgggccatacattttgaccgtatatttgtcttgcacggattacttgggtcaaagttagggagaaggagctctgccacagttattcatcaggagagccctggctttcgacatcggccacccttcccatttcctttgtttgggatgtgtgttccatcaagaatttaagccttgttcatctgtcatctctggcagttagaagtttgcatctaacctgtgctgtgagaactaaattgttctctggccacgggtaccatataataatgactatcatcaagggacactactcccccttccccaccaatagttctgaagatcaagtcatgtaaagcgttagtcaccagttgccttcatcttttagtccagaatcaatagacaatccattgttaccagtctagaagccttaagtaggatgctaggggagaaaagagtttgattcatatctgtccatttgcttcccagtctacacagttgctcataagtgctgtaagagccaccaactactgatgaggagcagttggaaacacgcctctaggcttttcctagagcaaaatagtattaattctggggtcactaattcttcatcttttcatggtgcttcataatcttccattaacaataagagctaacagtgaaacaggaacaattttaaatagtttgtgtattatctcatttataccctgccagcaatgctctattttatcatgccctcttgacataaagaaaactgagtctcaaagaggttaagtcatttgctcaatgtcaagacttttgtaaatggccaagttcatcagattttaattcaaggagtctggctctagaacctgctcacctgttgattattcagtgatacatccctgagggaatcacactcttggatgaaagcagtgtgattttctgataggccggacacagtggctcaagcctgtaatccccgagactccagaggctaaggtgggaggatcacatcagtccaggattttgaccagcctgggcagcatagtgagacttcatttccaaaaaaattaaaaaactatccaggtgcagtggtgcctgcctgtagtcccagctactcatgcggctgaggtgagagggttgcttgagcccaggagtttgaggttagagtgaactatgatcatgccactgtactccagcctgggtgacaaagcaagaccctatctctaaaaaaggaaaaccctgataacatgagtgtgggcctgtggagtatgagatttagaacatcatttcggtgtcccagcacagaacccaacattcttgattggttggttgctttacatattggggaaaattagctgcaagtttcaaacctaaaatgtttagctcccctagtccctagaaaataaaataccagaattggatggggctttgaaattatttaattttgtttgttaatttatttatacctagctaattacagaaaggatttgaagtggtttgtgataaaactacagtacgacaagacaaaaagaaagtgagaaaatccaggaatgggaaaataagtatttaaaaaaaaaatactaagataaagccagagatatcaggctttaaggccctgcacacttacaagtatcagaccgcatatttaaatatcaattcctagcaactaatgcagagaaaggagcttggctagatgttgacttatataaagcaaaaccttttaccttttacgcagtaggaacttaattgttcatggtactgagacattgaagcagacatgaaatataacctgagactttgtgttctcatctataactggagatgttgcatccgatgacctctaagtgcttctccatctctaagtatctaagactcatgccttattcaaacttaatgaacaccttccagtttttaaagggaaaattatctgtgttttcttagatttgcatttctttttctcatcctaatttctttttcttctagacccagtaactcttgttgttctatgattaagtaaactatgcaggagaaaagcatcctggagaatcacaaagaggatttgcactacattggtcctgaaatgacattgtcatttttaaatgcaagtttaaaaatgcaagtttttaacttgctcatatgagtaaatgcatatactcatatttcatagggacgatttgtcacatgacatcatctaattcttttgaaggctcagaaaagaaacagggctatgacattgattagtactggtaatatcaacctcattggttttaatatttttaactccaaagccctctaattgcaaaaattaggctcttagtgatgcatttcctctgaaattatagcagttattactgaaatttctaattgtttttattgattctacaattacattttgaaacctcatttgtaatatttatatggatatttataaacctcattataattatgtaaacatatttaaaatcgtttttaagattttttaaaagtaaaatataatgttaagagcaaagggctatagtgtgaatttgtcttacacgcatcatatgcatgttttgctaatttggatagatttcaagtttttcacactgcttgttttagaaaaataagcaattagaaattaatttagaaataaaagctgcatgatcatcattttgtagtcacactttagtaaataagtaattaactgaaatatttaagttgcaatattacttattcattttgctcatcgtttacaaatcaacaaagaaacaattctttctttcttttttttttaacagtcaaacattctgtgctgtcttcctcgatatattctgaatgggctcacttgttttcactaggctttgcttggtattagaatttgtggttgatgcggctcatttatcagccacgtatggagagattctgaaagatgttttgtcattttccactgtcaaaatgatacattcgcttctgtcctggtttctttgaaagagcttgagttgcacttattttgcagggtaaagcatggaaataaatgatacaaaactaagtaaacagaggggaaaaaacaggactcagaaaaccaaaaaatagggggcttcatttttaagcacgcatttttagactaaggggagataaaataaaatgtccatagctacatttttttaggattgatccggttacctacttgcatcctgactattacagtgagtcttcaattcttgtggatacagatatgaaaagagaagtaactttcccaagttatggtgggagaatagtttatttgatcttttagttttccctgctttgtgttttctgggtgtaatttttcagctattttatttgttcacttaccatgaaaataggaaagaactatgatgtgacactgacacctgtaactcgctaacagagtctgcttattacagactcctaactctaacatgtattccagaagacagttggaaaacacggccacagtacacaatagacttgctttgtaattaaagtcattcttatggaccctaggaaaatcagttattatcataatgtaaagcaattttatcgagcaaaagcttactttttcagaaaagaaaatgtccagtcaaacttgcccattatttatttcgtaaattttttatgttcagatttttaagtgtaaatacctaactaatgtatgtcctttctggagaaatgaaataggaaaaaaaagtataaatcctggcaaactttgatttaaacctggatccgtaacccagaattagcctttcttgattaaacgactttgagtttcagtttcctcattaggataaataaagataatagaatatgaacttcaaaagattgttgtaaggattatatataaaaacagccaagttcttggttcatggtagtgttttgtttttgtttttgtttttattttgagacagggtcttgctctgttatccaggctggagtgcagtggcatgatcacagttcactgcagccgcaaactcactggctcaagagattctcccacctcagcctccagagtacctgagaccacaggcatgtgccactatatatatatatatatatatatatatatatatatatatatatatatatgtatgtatatgtacacacacacataacatatatataatatatataacatatataacatatataaaacatatataacatatataacacacatataaaacatatataacctatataacctatataacatatatataacatatataacatatataacatatataacatataacacatatataacacatatataacatatatataacagaatctgcttattacagactcctaactacacacacacacacacacacacacacacatgcacgcacacacacacatatatatattttgtagaaatggggtctctccatgttgcccagtcttcatggtaggtttctgatgtttctgttaattgctctttgcttcctattagcatatcctttcctactcagtgtaaaatgacaactatgtgctatgccggtggcaccccctggaggcctgtgacagtattttggtctgtcgtcctcagtgcttgcgtttttttctctgggaaattttgctttcacctattgatctccatttttgtgcttttacagacatacaattagttgagtcaacatcatactgtttttacttattgatacatatgtaaactttttaaaaactcactttcctctatctctctttcaaatttgactgatggattaaaggaataactctctctctcttgaccacagattatttcatttatgaggaaccaagctattttgatgtctgtgaatgaacttaaaagaatggttctcagcctgggtctctctatcaaataattgatggccactggttttggaattaaattggagaaaatagagaaatcctgcccccaaattacacaaccctggaaagcaactatataacccctcaaggtccagtcaacagttttatatatatatgtgtatatatatatatattttgtatatcacatctatattaatacatatatgttttatatattcatatacctatattaatatacaacatatccatattaatataataataaatttttatagtttaacattatatacatttttatacatataaaattcaacacttgtgggatgaagaagacaaagtccctgcttgcgtgaaacttatatccaaatggaggagacacacaataaatacatagaaaaataaataataaacatttttataaacactgtgaagaaactgacccagtgcgacagtacagatgctgactaggatagggagggtctcctttagatactcatggtgcgtgcttctctaagagaacttggtaattagaaggatgtagacatttaaaactcacttggaaatgtgttgcagactaatgcaacagaaaccattaaggcccagttaagaacaagcttggagtcttcaaagaatagaggccagtgcgtcttgtgtcaaatgaacaggtaggaggagagtgctgtaactgataagaacctcggaatgaatcctgtgtctctcttgtatttccttaaattctctgtttttaagaaaacttgaaaataaaagattttctaatcttaaaattgtgtttgatttgcttaattactagtactgcaaagccattgcttcttactgtttttatgtcatttctctttgggtttaaatgaatgttgaagggctagcctgggaactgactcacgtttataccatgctcctgagagaaaatataatccaaattgcactgaaaactttggaacatagttctttttcagatagggacaacctatactggagtgattaaaaaaaataaaagcaggtcctcatttatcataaagcctcattactccaaaacctcggtttctactcaagctgtgccgaagattacctttgtcctattatgaagacttgctacacaattccccataataattgatttagaattggcatgttcaatttaattctgggtttgcagaaacttcaacacattaatgcagatggattttgttaattgccacggaattttcatgtgttcataaaagtagtgctggcaaccagggcctctgtttggaaaccctcttcagaaaaatgcctaagaaaggatttttttccccactgtctccacattgagcaagttagtgttgttctgagaagagagaaaagagttagttattgatgggggcattgatccaagtccttcttctcacttcaatattaaaagataaaagggctgattgtgctcatttatcatgctggtctctgttttaccttaaaccctgattttccacatttttctttacaaggcatccttttcatctcctacatcctgtcaaatttacaagttacctttgtgctgatctatacttaattaatttaagagacatctttgccaaaatgtactttaggaaatgcaaccgggttgagaatgatgccttagtttgtagaacttccaagtgaagtgtggctatgagtcagtgtgctgagggcagaggggcactgtacagaggagtgaaccacagagtgagactcacagaggcatcagaaatgcccagccctgccattattgctccctgacccatccttctgcctcctacctcctttcccttcactatatcctctgatcagcagcactgtgacctatctaatatactcactgtgtcaggtcataatcccctgcttaaaaatcctaggaggtttcccatcacctatagtaaggattggcaaacaatagccacaggccaaattgcctgtttttctcaataaagttttattggaacacagccatgcccatttgtttacatattgtctatggctgctcttggcctacaaaggcagagctgagaggttgagaagcagagactgtccaaaaatgtttaccttctggctcttaacagaaaatgtttactgacccccagcctgcatgattgggttcaaacccaaagcacagcacttcccaagatgcttccagcctgccctgcaggctgatctgtagccaactcctccactgcatcctccactctgaccccccgtagataactcattattcctatacagtgctgcacactccatgcctttacactcactgttcagaattctttcgatggcactgcctcaaccccaggggctctgaaccaccttcctttacactgatgcctcaccagcttcccctgtaggtgaattctgtcacagcctttcagcattgctcagggtacatccctacagtcattaggtgccttttccttatgtgtgcaaactgcctcttcagtgagagtggcagcctctgagtgttttgcatgctttcctcagagtccagtctagacctaaacacacagtacgtgctcaataagtaggtgtttaatggacagacaataagtaaggtggccatcctgcctataaactaaacaaaggacatgatggggtaaagcaaatgttgtcacattttcacattaatcgatgcattaatgttgctcattaagcaaactaatctactgtatatgttaacgtcaatggaaacagacagcactagaaacagaagctgcaagcagcaggcccagcagcagggaagtctgagcatggccttgcctgcctagagtgtgccagcagccagcatccaacctcctgggtgtcttgtagcagacctggagccaggcaagtgggaacaactgccagatatcataccagggcaagtgcaaatagatgcctgagtcccaggtctccatcataaagcaaatatctgtccttattccctctaggggaccacttgcccacaccccaggcaacaacaggaatagacatttgctttccgaatgtgcctgccccagaggccagcctctgttttaatatgtattcttggaagtacatgggataggtgagtttgctttgaagggcatattttgactctatgagggacaaatccttttgccaaaattttaacaactaactttaatttaccacgggagatgttggtaaaaattgtcaagacctctttaagttttcagcaaatgccaatagcagcttggacatgattgctgctaagatgcctttaatgagctgaatagtggaatgattgcctttgcttcttcctttgaaaacagacattccccagtagctgctgaacatccccaaggatgttctttgaggatattcctctttactttgtaaccatcacttgcccatccctactgcaaactcttggccctacctacggcaccctgtgtgacatagcaattgctttttctttggtcctctggagaactgttggtgggaccactgatagtcttatcagtgaattccctaagctgtaatagtctcaacaaaggatccattctgcagcattatataatgctgcacttttcgttgttctgctctcgtgtgaccctaaatgttgcttctgcaggaagttttatgcaggtggaggggctaacttaccacttacacacttccaaaatcactgccatcatcttctccctgcctaggcctcatgacatttctgctcaccaaaagcatacactactattccgttcaccttttcctccatgacattgttgaggaaggttgagtggaaataaagaagatggagattctaggaagatgaggttagatggataagatggggtaggagtcccagagttccaacatgaagagtagcccaaactgcttctcaaagaagctacttccagggcctctgtttacatgttgtctttaagaagtaatttaatccagaatgtaacagacatcttgatctgccctgagtttacaaagatcagtgaacataaaaaggaaacacaaagttggatcttgctgcctcaaggtggaagtgtctgggggttgattgggcctgtggatgcttttcttgactggcagccccgggcccagagtgctgtgtggtgtttggtgtcttgtggaaccactttttttccccactggaagctgtctctcttccaaaattcaagtccacaattctccaggaaggtcaagcccagcactggcccctcaccccagccagggcgtcagcctgtgtcctccatcttttttgtcagggtgagcctttatcatggagtaaaatgctctgaaatctgcagggtctgtgtgtgaggatcacacttcccgtgttcctccatatcttcctttatctccagcttgctcactgtcctgattttctagcatctcattgaagcagcttgatgtgacagacattttggaggttttgaattcagaaagaactgggttcaagtcccacctgtgcctcctaacgagctaggtgaccttgggcaagttaatcttcgagagtctcagtttatttcacctttgaaagggaaagttagtgatatttagctcataacatggctgtgaggaatgaaaactactttgacacatactgggactttagtaaatggaaggtataagttgcaggcatgtagaatttcactaatttcctcaatttaagacaataaatgatagaaatgaataaactttatatgtccttctccctattcatgactgtagagttgttatgtggcacttgttttatgaagcattctctctgacattgtaaaaaataatacatctaccacaaccatgtctaaatggctaaaagctatatgcacccacttaaaagcactttgagataagtactgttaagtggaaaatgcccagaatacagtgacaccagtaattcttacgttgttttcaatgttagttcatattcagattaaacaaataatttctgcctgcctaaaatatatcacggtctgttagatagagcctacagttaccctgttcaggtctcaataaatctgtgtggtttaagggaagttgggacagactttctaaatggagtccattagttcatgattcttgagagttgactgaatggcagacttccctggttttgtttagtagcttctgcctgtattacccccaagaattgggttatggacaggacacaatgggaatttcattttgtggaggttaagtgtacagaatatggcatcaaatcatgtaggttgcaatcctggctgctccatataccagctacgcagtttcctcatttttaagataggattactcttggtacttctgtcatagggcacaggtaagagcttagactatcgccaccatcagcactatcatcgtggaggccaggtgcctctatgatgtgtctatttgaatatttagcacttgtcctcaaacccactgaccaagagggcatgttaaaatggccacatcagaaaaaagaaatggtagagttagtgttctttgtgttgctcttctatatgaagtgtatgtgtatgtgtgtgtgtgtgtgtgtgtgtgtgtgtgtgtgtattagcttctatgtgaggagccacactaaatgctaggcactgtgctaagaactccacatctatatttttatttaacctcaagtaattctgtgagaattctggatacttgcaagagcttattttacaaccaaagaaactaaggctcattgaagaaagtaacttcccacagttgccagagttggaattctaaggttcatgcatttagtggatttgttagaagctatatgtaattggcctgcttatctctgcaactctaaggaatgaaaaatcagttcatgagcccaggataaagtgatatgtacaagaaggtttctttcgatcaaatgttgcatatctgaggctcatgaatgaagatgagaaaataaaaccctaagtatacattttagaaaaagtctactgtaatttgtattgtgttgaatgataaaagttcttttactgtatagcttttgttcaggatttaattacaggaatactttagcctctaactgtggatcattgtttggttaatgtctgatggattgacatttttccagtatgttggataaaacggaaacctcgagaattgcatagtcctttaggcaaaagaagacaggatgctagaggtttttgtgatacttatgaattaaaatatgcactgatggtggagtattcctccaagaaacccttaacaagtaacggtttcataattcaaatataacccaaaatacaaacatttcaaaggaaacaaaaatgttgggtctattcccaatgcatgtttctaagtctcttagcctgctctcggctttgagatagaagcacttcttcctcttccatggaaaccactacaaattggagtattaggctgggcgcagtggctcacgcctgtaatcccagcactttggcaggctgtagtgggtggatcacttgagcctagaagttcaaaaccagcctgagcaacatggtgaaaatcccgtctatacaaaaacaaacaaacaaacaaaaaaattatctggacatgatggcatgcacctgtgtagtcccagttacttgggaggctgaggcaggaagatcattgagcccaggaggtcaaggctgcagtgtaccatgatcacaccactgcactccagcctggtctgggcaacagagtgagaccctgcctcaaataaacaacaacaacaacaacagaattggagtattagtgactaagatatgcatgcatctgacaatctttgattgactctctaggcctggcttccttataaatttctttgtttcttttagttttctatggaaactggatcagatcaaatctctctcctgagatccaaaggggtctacagggtgtgtcagtgacagggtgacatttcaccagacttcttggtaatccagtagctgaataagttggattgaactagatatctatctgcctttgctgaaatataaatgaaggcaaggaaattcggagtttggtcttccgattcatacccctagcagctgatgtaatatttggacttggatctcaaattcatgaggatagaccctaagaataagattcttctagctgtgggaagaaacaaagagtgattagaggctgatgtgtccctgagagaggctccatgcccttcttgcacacaggctgaggattagggataggacaacaaggggatggcaggtagatttagaaagatgtgtgcctcgctctagggagaactcaggaagcagcgcaaccccagggaacaatgactgcagaatccgtcctgaaggtgagctgaggcagccccttagaactccctgtgtccataaattgcagcagaatagaatgatttttgtgcacctgagagtaggatagaggggaagaaaggtcccagataacctcaccaggttttctgtggccctactgataccaggaagagtacagtgatcacagatattagagaaagtggatgaagggagtcgcactgatacacggtggctaagaaaactaactttggagtcagacaatagatgctcaaaatcccactcctccacttactagctgtgtgatgtttggcaaataaacctgtctatgcttcagtttcttctttgtaaaataggtataaataatagtaaagcatttagaatagagcctgccataaaataaaagctttataagcatttgctattattgttactattacattttatgaaaaggagaaaaagtacatttctcatgcacctgtatttgaagatggagactagggatattggtctaaaattctctttttttgttgtgtctctgccaggctttggtatcaggatgatgctggcctcataaaatgagttagggaggattccctctttttctgttgattggaatagtttcagaaggaatggtaccagctcctccttgtacctctggtagagtttggctgtgagtccgtctggtcctggactttttttggttggtaagctattattatctcaatttcagagcctgttattggtctattcagagattcagctgcttcctggtttagtcttgggagggtgtatgtgtccaggagtttatccatttcttctagactttctagtttatttgcgtataggtgttgatagtattctctgatggtagtttgtatttttgtgggatcggtcgtgatatcccctttatcattttttattgtgtctatttgattcttctctcttttcttctttattagtcttgctagcggtctataaattttgctgatcttctcaaaaaaccagctcctggattcattgaagatggagactagtacttagagtctcctcattcccaaacttgtaggaaatacaaagctacagtgaatggaattgaagtattcagataaatttctgtagatttcaataccacctcccccttttttttccatgagcttttcatttactacttcacataattttttgatacatgaactatccttataaccttgcgcaggtgacttaatttctctagatctcccctagagaagaaaattcctcatctgtgaaatgaacaacatacccagctcgcagagttgttgtgaattccaaaacaaatgaatccattgaatatgagatgtacagtaaacgtagtgctcggcatgcaagcagcattcaacaaactataaatgtgtttgtgttattattgtttgtactcatcttaatttctattcaaccatttttacataactgtaatggaaagactaaatctagaataaagttgcccatgatcagtgagatgcactggtggcctccatacttattcatccactttggctccaaaatggctccagcctcccgtttgttggaaaatcaacagcctgtgacatgtcagtgttgagatgatttgaggagtgccacagtctgcttgttgattacgactgtatatttgccaattctttgtgtaattaaatccagccaaggcctcaggtatgttcttagccaggtctgatttatttagatgttttgttttaaaaagaatgccaaggtaaaatttgttttgtttcttttgcaccacaaatgccttaaaaatccaatcttggtatcagtgacggatattgatatactttgtcaaacaagaaatatctgcagctgctagaaataaaaattcaatgattttcagcagactttcctaagataataatgtaatttatctttcagagaatattaaaggcaaaccttgaaggtgagggcaaaaagccattttgtgcctcaaattagaaggataatttagaaagaaccacatttatattcatttgaatttaacaacctggaatggcaacgttcacattagtgattatttctacctaaataatcacaaaaaaaaagaaaagaaatgattatattttctgctttgaaaattagacatacttaatattgcatatggtgaaatggaggcagtaaaaccccaaagaaccaaaatgtgtgaggaatgatatattttggttaatagagctttccatttgttgtatttaagcaagtaatgtttttacagttgttggtaaaaacctttttaaatacttgcgtataacttccttgtcttagtttaataaaatctgcaaaggtcactgtgtgaatagtagctcagacctaatgtaagatctggggaaggattgaggctgctatgctaagagcgtttatatgggagttgtattttccttgtgaaggtggtagtagttgtcgaaattttgctttatttgtataaatgtaatattttgctttatttcaagaaatgctatgagtattgttgtacttgtagcttctaagattatggtttgcttttttcttaaacttgtgagtatagtaggcatgtataaaactgaactaatggaaatttccaactagattgaattcttgaagatgtgctttatattcagagacattgaaaagggaaagtaggactataaccaaacactatcttctggctcttcactctgtgaggatctggtgacatgtagaagtgtcctggctaaattgtaaaattgacaaaattttgctttcattacttctccccttcaaactcctctttctgggttctttgattctccccatctaccaagaaccatcaacaggtggctttcttgcaatttatttgaggggaagagcaggaaaaaaacgactcaaactcttgcataatgtcacagagtggttacttcctaacttctacttctgcagctttagacccacagaggtttgttcattttatctatgaaatctgctttttaaattaatcccctgctgacaagaagcgtacatgagcattgtggttaaactgtctttaaacctgctctggaactccaacaacttcctgcagcatggtatgcactgaagtcacttcactgctaattggcctgttctctctccctctccattttttgggctcccacgtgggcttcaaagtgagccacagctcttggcacatcttcagactttgtttggtctaaaaccaagaatggaaaccttgccaggagtttccaatttgttgccctcgggcatcttaagatctcatcaaagatgcagtatacagtcacatgaagaagtggagtaacaacaaaggtagtaaatgattaagtgacaaaatgacaaatgtttcaggaaactagaataggaaggcagtggcactgttaggggagggatgcttgagcaagagtctacagatcaggtagtgtggagtgaagagggagaagagatgagaagggtgttccagttactggggcagacagagcaaaggagggtctgagagtagaaatgctcaggaattggggagacagatgggcatggggagaataaaaagaagtggctctggggagccaagtaggcctggtgtgatgactctgccagtgccaagcttttacagcatgcaggactaagtaagcaaaagaggtttggttttgttggtttgttttgttttgttttttgttttgttttgttggttagttttggagacagcatctctctctgtcacccaggctggaatgcagtgacactatcacagctcactgcagcctcaacctcctagactgaaacgatactcccgccttatcctctctctggagtagctgagaccagaggtgtgcaccaccacacctagctattttggggtttttttacttgtgttttagagacaggggtcttactatgttgctcaggctggtcttgaactcctgggctcaaatgatcctctcaccttggcctcccaaatgctgggattataggcatgagccactgcatccagccaaaagagtttattatggtttaaaagcacctcatgttccttaaaactttgtcttcttgagccacagacccgtcctgggaacattcaataaatggccttagtactaaatgtggtaaaccacgagttgcgacatagtcaaataaaacttcctgaatttacctgctgtactttgtcgcttgtttcctcttttcccccagctcatagacattcttgtacaccctatcaccttcagagagtggctttttgaaagcgaccttgtggtgattgctggctgctatggatggctagctcaccttccagacagtcattggatccccaacatggtggcaagattacttaaggcaggcactgctaggttttcttctgtttcataggaaaaaaaaaaatttgaagtctaggggaaatggggaaaagaataaggatatcgctaaaatcagggaagaggaaattaatttttattttcagaaatgaaaaatagctttaatgaaaaatgcaaaaaaaaagcttttggtacattttctaaatatgtctttatttttatttggcactccgcatttgctcttgtgcttaacatctgctctttaataatttcatgcaatacctcttgatgctttcaggagatatcaccctgacttccgccctgatgttcctacccccaccatggcctcagagaaccaaggctgtaccaggaggtgcccagtaaattcaagccactgactgacaggagcctcctcattgattctggtattaatcctctgaaaacataattggagcagagggatgcaatcagtagtatccattgggcaccacaatatggggacagctgattctgtgcatgccattagctcattattacactaactactgcagttttagaagataaacctcagagccttaaatggcatctggaggctgagtcagttctccttggcaatgcaattatctcagcttgtttcagtctgctgagaggtaggaataatatttcactcagtgttccattgcattaaaatgttttgatacctgtttgaataacattgccttaatgttaataaatccataatggtcacacaggcaggggtggtgtgtgaatcaccctggaagggatgttcattaatcagttacttggggcttttttctttattcattccctcctagggtttgtacctgtgaggaagcagcctaccttctttgcagccatctagcatctatattctagaatcatttttccctatgatggtcaaatccagattatctacacagaagaataaaataacctgagtaatccaaagtgagtcataagtttttaaaagtctgggccaggcacagtgtctcatgcctgtaatcccagcattttaggaggcccaggagggaggatcacttgagcttaggagctcaagaccagcctgagcaacatagtgagaccccatttctaccaaaaatagttttaaaaatagccagacatggtggtgcatccctgtggtcccaggcagttggtggctgaggtgggaggatcctttgaacccaggaggttgaggttggagtgagctatgatggatcacaccactgcactccagcctgggcaaccgagtgaaaccctttctcaaaaatatgcattgtcctttggaatatgttctgtattcgaacatggatgtagctaatgtttgattttaattcaaaaaaaagtgatacaactattgggtggagactcaattttttcaagaagctacctatttttgctttatacttcccatgcccaaccctcttggaaacaattcaagatttctcttttgcaggcttattctggattggacatgagtagtaattttggaagtccaaaagactctgggccttgaagttaagtaggaggtgttgagatgtcagtgaaacacctaagatggtgggtgatgcaactgtgaattactgttatgtcttaataaaccttaaaatgttatttgactaagtcagaagcatatgctatattgctagtttattgatgtgtgagtaccacataaaatcatttttgcaaatgtgtcctttaaacataagacagagcatgttattagacacacggcataaacagcatcctagtgagtttgtcctctatgcaaattgctgcttgatatttggcctcctctctataaagaattgccttccgcactgactgagtgagaaaattcaacataattctgatttgagatccatgagaagtttattatacctgcctggtgttctgattatgaagcagaaaaaagaagatatgggttatcattgacagatcctcagctgtcttttgaaatgtcaaatcaaatggacatttttgttttcaaattgcttgacctttatcagaaagcagctctggacagaagatgatccttttttgagtcactgtagagcacttgagcacttatacaaaggagagattttattcacttagccagaattgagcccctttggaaaagccttgaggaaaactattgtgatcaactttcactattctttttacaaatacctgtgtggcactacaatgcagtgtggatcaggccctggaacgtggtgattacagacatgctgcagagaacttgtcacactggggagcgataggaaacctgctcagaaacatccaaggcaggctaagatggctgccatggggaagacactggccatataggctgcatgaactcagttgggggagagtcgtgatcagttggcttgctcagagatgactaagcagaaaaggtggtgtggaactgtgccctagcggatgggaaagaagggcagacatggtaggggccagagtaagaaccaggtcaaaatccgcccagcaaattttaccccctctcttcttcacctctcctttataacactgtccaattggtcaacaactcttcctttataagtctcttgaaaggcaccaaaacccccttttgggtgcatctctgctaacaccctggtctaagaccacactgcctcctaaacagaaagctgaaaaatcaatcctagttgtttttctagctgcactatttagtatggtgcctaataatcttcctcaaaacaccttttctactatgtttatttctagaaggaaggaaggaaggagaaaaaaagagagggagggagggaaggaaggaaaagaaaaggaaggaaaagaaaaaagaaaagaagaaaaagaaaaagaagggaaaggaaaggaaagaggaaagaggaaaaaggagaaaagagaaagaaaagtgaagccagaccaaaccaaacaaaccctgcaggatttttctgtttctgtggggtctggcataaactcttgaagctgacatgccctccagtgccccagcagtggttcactcctctttaatttcttatgctttcttgtcacagatttcttttcccccaactttgtgtgttctcaatttccctctctgcgtatacaactctttcatcctcactaaaacacagcaaagacttccagaagaatctacacagaagccactgcttctcagaactcttctcaagtttgctggactctcctcttctgtgcttataaatcggccactgttagtgtgacttcattttgtcttctaaaccgcgttgcacctccttggccatggagaattaaggcgaaccttaatccaatgactaattcatggctagaactaagttagccacctgcctggtagattatggtgtccaacatagagaactgagccaaagagatagtgctttcctgcttagaaagagaaggctgcttagaatagacagcagtgtgggtgataaatagttaaccgagacttttggtgaacactaaaatcctaattaaatatgatttaattctgcttatagtggcagaaaagggattcttacaggtcttttgtctgattacatcacttgctacattaagttcattaggaatattaggcaatgaataaaggccaaaggaaatgaaccatttttaatggatgaagaatagtatggaggccatttactagccaagatgaatagtagcaataaattgtggattcatttcgttgaaactatttaaatacatgtctgttgcctgttctattcagaagcatggatagtagggaatgagatttacagtgttatttgggactacttgttttttgaaatactgtggttcataatcagataattcttaaatgatagacaatgaataatgttttgagagctcagccttcttatctagttgggatgagaagaatgtttcatgcatctttctgtttcatttaaataatcaggtggtttcactcataaatggaagggtagctatttcaagccggctaccttttagaaacacacataaagccttcattatatggcagacttggagcctgtgtttcctgtagccaaaggcttttgcaaagatttgtggctatgaaagataaaccttcccaaactttaaaattatgcagtgttttcaaaaagatagccattgcacttttgtgggaattttaatttaatagagaaatgaaaggaaagcagtcatatcttttcatcattgcctaacccctttaaaagtatatattaaaattcatactatttcgatatttatgcctatggccttctaaactttttatttaatccactcccctccccaacccccaggagaaaccacagtgcagacagcaattacgagccttctggtttctttcacaaaatgggctttttaaaaactgcctttaaaacactctccatgtaaggagtcctggtccacgtcatttctgccttctccatagggtacatactcactaggacattagggattgaagacaatagaagtctactgttcctggatgtgttgtttctagctttcagctctaaaaagccaaattgtttctaattccatattaaaaaaaaaaaagacaaaaacatgaaggacatctgagccttggccttaggcctagttttagagattgagatctggtggtagaggctgtctctatcccagctcaccagctcccccataaacctcccttggaaatccctttcaaccttatttcttctccataccatcctggtgcagccctaaggtgtctttaccattgtcctgctgcaagccatctcactgcccatctgacatctgcaagccgccttcttcattccatctagccaccatagttgtttccttacaaagcaactggttatctctcctatactaaagcctcaaagttgagtatcccccactgcccacagtggcaggtgcaaattcaacatcttggaaacatgttccttccacagttgggccctgagcttctgtggctgagagataggcatggaatggtacaaggagtataacagagaaaataaagaaggagccccacatttcacaagcctagattctgtgcttgacgctcttctatacattattttatttatttaattctgtaaacaaacctgtgcagggggcattgttcatctactcagccttcctctgtccattcatccatccaaccattcatccatttttactcatttagtcattcaacaaatatttattgcatctcctatgagcccagtacagctcaaaatcaaagcccgtgctctgttatagcttatgttctagtaagagagatgggcattaagcagtattagcatctgcaatttctcatttaagtcttctataagcagagaagagccacaggacacttttagtcacttactgacgtgttcatggttgttttcaggaaattttaactcagcagaatgtatagacgagaaagagatgggaagagttaaggaaagaagacctgtggggaggaactgcagtaattcagagaagaactagtgtgggtctggagaaggccagggcagtgggaattatgagaaagggtgaatattagttatttacagatgaagaatccttgttttttggccactgatgggatgtggagagcaaagttaaaagaaactcaaaaacaactccctggttttaagtttaaagaattgggtgtccggagttccctttaagagcatgttttgccgagtggtagaaatggaaaaagatgatttctgtgctatcatattgacttaaaacatcacataattagagagacacgactataacattgcacactggtctatagcattgtttgaggcatgaaatgagtatttgcagtttctgacaatacaaagagaacctttgacgcaaaggtgaattaatttctgctgggggagtgggagatgatgaaaaacaaataaacaaacaaaacagccatcactgcagaaatctacagttagtagagctcacccttttaatatttagggacagcattttaaaaaactctttctctgcaatttctgatagcttttgccttgttttcatattggccttcactgccagccacttccctcaattaacatcctctccaaatcaatcattgatattatacttcctgcaagggggtaaagagatacaactttgcatgtttcccaaacccccgaggtcacatgtccatggagaagtagtgtacagtgatgatcttgaattctccaagcaaggaagaagttctctctctctgtgcatgtcctgagtcaagagggcttttgctgtgctgtgctgcattcctgcctagggatttagggcaaattgttgaaagagaacttaggctgaggttgaagagaaaaggccaacaagcggggaagggtgagtgagcaactgatttggatatctgcccattgagatttcagtatttgccccaaatggcctcattgggatgtgagcaggctgacctcctaggctcagggtagatgcttccagccagtatgggtacacccatttttggaagagacctaaatgaggatgctctagaaggctgtaagcaaaccactgcctttacttgtggcttgttccttgttttgatttgactgcttgatttccatttacacacaacttttttttgtatatttgtttatgtgtgtaaaatatttaaactatcagtaattaattggtggttccttcttccctggagtctgtgtcaccagtggaactctgcattagtttttcgtgcccatacaatcagttaaatgttcagtgaaggtgtccaaagtgaaatatttctctagggttatggccaaactcagaattgtttttctgtcttctcttccccttatatcatgatatccaggcttatcattctattattttcttttgaagttagctatgaattaactgtgtggccaatgattttgtacatttatctaagtgttagagttttaaaaagcattttaaaatctaacttgatctcaaaacaaacctttgaagtataatatgtgtgcatatatgtaccttcacaatttataggagaaatggaggctgaacatttaagaaatttttctcctggggattagtctaataattggcagagataagaataaaggccaggaatgtgtatgtttaaccaaggagtgtttgcaatctattgcaaagggagagagaagaactagctgagcaatttgcagactgaattctttgggatcctgatgttgaggaaggatgccttggagaaagaggaggcggccggacacagcctcctgtgcctcacccccactgctaccaggacagtgctgtcgtcatctgtcctacataaggtgactccctgtatgatttcatttggaaaacataaagtgtgctattctagctttttgaaaagtttaaaaaccatagcactgcgttttagaatactgttcattttttgcataccagagttctgagtatcagattctgctatattaaataactcagaatttactcatttgtgaacatacctctctgtacttccaagttatctcgttaccacacacagaaatgtaaaagctttaaacaatgtgttttttaagtgcttagtgacaaccctaaaatatttccaaaaggttctatggctcagacagactttgtgatgttattctttaagaaatgcaatggttgataatttgcatttatgatatttcctcataggttcactttcttagttaaggacacactatctcacaagagtgctctttaaagagcaactttttaatgcctaagcattgatttagagttggagctgggctggtaccacgtggaccgctcttactctaaaaggaaaattgagaccaccatgaaagtgttttgattttactaaagccatgtcctcaggcaagagggacttggctcagtcaggtctgagagaagtacatcaaaatgagtttgaccaagtggaaaatggatgctctaaatcgttgtctacagtatttccctgacatctagatcaaatatgtacattattacactttgtgaaatcctgggaggtaatttaacagaggtacttaattctgaacctgaggttgtgcaataaaaaggagagggagggggcagggaaaggaaggatgaaagaattctgtagactcggtgggctgtagtggagagaatcctacactaggaacagggaaacctaagttcttgcccagtgctgacaccaacaagctctactaaattcacttaatagcagctgtgctcctccaccccctgatcaatcaagtatatattcctgaccatcagactctgcagagctgtgccttccacgctcatcactgatatacttctgcctacaggataatgtcaggccctgtcaaaccaacatctaaatcacctgtttagcttcctttccctccctccctttatttccagccacacacgaactaaatgctcctcctgcctgtgtcattttatacacgctgggatgcttatccccatgtggcatgatttctctgggctcagatattttcacatctgtaagacattccctacccacttaggttaagtggtaaaacgtgttttaaaagccttacctggtgattagtgatgataggagtggtggtgcttctagcagcagcagcagcagcagcagcctgtgagatgggagaaccatcgtcaccactgctgttggacactgtgccaccaggacaggtttatattgaaaattctgttattgaggtttcctctaacctctcactgattgggtttttaggaggattcatctttaccattgtatgcatttcattttgccccaccttctcttaattgagttattacttctacctttcattgattctgttttttatattaatgctgagactaaactctgtcaggtgtcaaggccaaatagacttaactgccaacagtatccctggaaggtagaactgatgccactcttgcatacctcaatgcaaagccatagcaataatgcagcttcccctggcccataggtaccactgggcctacacaatgggcactgtgcctcagaaatccaggaccatattcgggacaccatttttactagcagagggaaaaatgaagccatgagttttttttcatctgtcctcacctcttagttgtccacaagtacgtggaagtggttagaattccatatgttaattgcacatttaatgaactctgcaaggcccagtaaaaggagcactgaatttggaatgggaagatttgcagctctgcccacgctggttggtcaagatgtggtcatcaaatcctggtcactctaaatcacagatttcttatgagtaaaacagagataataatattgatcctggcttctggggatcacatgagggaatctatattgattattttttaactccattcaatagatccctaggatgccaggaaagtcccaggagggcagctttaggagaacaagggaaggatgaggatgtaaggcttgggcatcaccctgtcatctcccagaatccaacagctccactggattcagcaatagggtagaaatttctatagtgtaaactgaggcacgtttgctctgtggactcttcataagtaagccaggcttctttactaaaactggtgagaaaatagaggctaaaatttttttttaatctctttgctgcaagacttttcagaacctttactatgctggaatgcttgtagatttccaagagaaacaatgtacagtctcctttatatttatttgggcgcaataactatttctgaggagcatttcataggagtaatattccttgcagactttgttgctaggaaataagagagcataattcaatgcttaatgtgtggtatgcatgctgtaagtgataagagtatggcctagagtaaggttagtggagaaagggactagtcctcaaaggacccagggaatttagaaaggtggagagcagaagagaagccatgaacaagtcagagatcgttgttacaaatgtaaataagtaaataatgacatcaggagcaacaaatacctgctgaacactcactatgggccaggcagatgggtcaatgctttacctgcattttctaattttatcttcttgacataggggctatcatcatctttatgttagagaggaagagaaaagaggttggataatctgttcagaataacgcagctactaaggagcagaggcagcatttattttattttattttacatttatttatttatttatttatttatttatttatttatccatccatccgagatggagtcttgctgtgttgcccaggctggagtgcagtggcacgatctcagctcactgcaacctctgcctcctgggttcaagcaattctcctgcttcagcctcccaagtagctgggactataggtgcacaccaccatacctggctaatttttgtatttttagtagagatggggtttcaccatgttggccaggctggtcttgagctccttgtaatctgctggccccggcctcccaaagtgctgggattacaggtgggagccaccgtgcccaaacagaggcaacatttaactttgattttctaacacaggaaactctgctctttattaaaaggtcttgcccagggagatagccaggtaccctaattgggaggctggaatggtactggttggaagtaacacaggaaagactgagaagtgctggattgcaggaaatcttgagaatctggcatagagcacagactcatcatgtttagggccctgcatgcagttgtgtgcatatagctgtgtacttttacaacgtagaagacattctgtggaggggcagataggggctacgttgatctagaaggggattcacatatttaaaattcacataaaaatgtcctaagggttaggagtggccctgctcatgttgagcaagaatgaggctttcaaatctcttgtttaccatctcctaccatgagttcctatcacaaaagtttatcatggtgagcttaacagagacaacttaaggggaaaaaaacttttagagcacttactggcaactaacattcgctgttcttcatttgtttcactcacctgctatggtagaaatcttggttttggcacttaatggtatagtaaccaccagcctgggtcggccaaggagtggcatttggaaagaaaatcctagaaagcctatcaccatagatcagctatggggaagggcagagttgttctacttatagattttttaattatattaataggtcagctgcatgctcaatttatttgatcatactatgcatttagaaataactcaaacaactcaagtttatcactatgtttatttgttttttttttttaaacaagcacagctaaagaatgaggacattttcatatcagtggttttcaagctaattcaggtggtggaacatctggagtgtaatacaatattgagatatttaattactttttatatttaacgccataaactagagctacacataatagcaaagctatgtttgctttgtatggagcaatataaaattatactcatgaacatttatatccactaaagaataagtttccataatccattgctatttagaagttgctctgttgtgtttctgtgacttaacagaaacctattttgtgaataaagtaggtttagacttgatatagtagcttcctaatatttaaggaaaaacttatggactaaattattttaacagtatttaattgtttgattttgaagagacaaatatgttttaacatggaacttgggtgtttcacctgtacacacttttagaatcatgattctagatatgcatatttgcagaaagtgtattaagtctatcagtcataataatatttaaaatgatacattttgcatatgtcatttcagaatcatcataacatccctatgagaagtgcagtaaaaaaaaaaaaaaagaaaaaacaaaaactgaagcacagagaggtcaaataacttgtctagaaccctacagctcatttgtaagagagttgtgcttcaagtcacaacctcggagaccacactcatacaaaaccatggcacttatggagaccaggtttctccatgttggtcaggctggtctcgaactcctgacctcagggaagaccacactcatacaaaaacatggcactattggattcaactccttctgcttcagcccgtgcaaatttccactgcgctaggtatctgatcccagaaatgaaacatctaacaggagagtttccaggatgggtgtggatgctgaggctgggttagtgttcttcttgtgggcactaccctatttactggaatgactaaaagtccagggcactttggtaagttgctttgaaatgtctgtttcccattaattgcgctacctccttgccttccttatattttcactctgttcttattggaatccccatgccaacctgcctcttagcatcacccaagagttgagaacttaccctccccttcacttgcctatgaaatcttaccgttcttgagtcctatttcatcagcatcatactgaatttttgacaatgcatttgtggctagtaatgtttcaatgttaccctttataaatctggtactttgtaattctctaaatgtggattttcacatctattaccatttgaaatagtggagctagagctatttggaagcctgaattcatatgtcagttccacatctcaattgagcttgttatttagctctctaagcctcagtttgcttctctgtgcagtggggatggttacatctagcttacaggattaccgagaagattgaaggatatgatatacatatagtctaacataatcaattttcaaaaccgagagactgtgttaattgtaaatgaactcaagtgtatccaagtttttccttttccaattccatcaaaactttattactactctaacttgaagatattataaatatctacatatttatccatgagaagaaacaggatatgagtttacatgctttactttaaatctgattagtagcaactactactaatttggtgtttttggagagactgactttcctgtactctcaaaaacatgccatgtagacatgtgttcagtcttgcctcctctgcctgtttggtgggtggtgctgagggagaggaaacaagacccctttccctgcccaagccattaggaagatgcctttgaaaattttctgagctaaagcaaccttctctttctattaaagtccttatatctgtatcagctttctttaacagttctcattagagatcagatttaggaggcttggggaatccttttattctatagccagaagtgagagaaggggtaaggggaggtgtattcactaatggagtcctagaaggtccagtgcaacaaccctttctcccaacattggaggaggtgaggacagtgagaggaccactactctgcaggtcaggccatgggttcaagttacacacgtgctgggagattcttgcacaattcctcaacctctcctcagtttcgtactctatgagagcctcagacccacttcattaacttgtaatgttcaaaagagggctgagagcagccacttgaaaatgctttatgaactgtaaaattctctagaactctaaggaatggttatgatcatggggctctatgacccagatctacagccttatgtaaagtccctgctcctcttcttgctgtcccaggaacagatggaaaatctgagtccttctgacttcttattttgacatactgtgtggtctggaaacaaagcttatgtacttttgcagttacctctttggaagaagtgtgaagcagactaggcagtttagaaagcacagttgttatttatgtttccttatcgctcccgcagtcaccccactgtgctcttaaggaggatttgggagggagaactgaacccctgtggtgaggagtaatgagtttccctagcttttgcatgaaccagctctttggaaagctaaccttctccccaggcactcactactaattaagaggaggggtggctgcattggtagatatctactgaagcagttctgcgattcttttcatcacttgcacatcaacttctcttcttcttcttaactctccgtgagtattcatgcatgggaggaaccgaggaaacagtggacccagattcaaggaaaggacagtgtagctgtaggactcagtttccctccatgtttaggtagagggtctacagtcagactgcctgggtttgtatcctagccctgccgctgtctgtgtgtttttgagcacgtcacttatgttctttaatactcagctttgccacctgtagaatggaaatggcactaccaccctcagtggggctgttttgggtaccagatgagataacttatgtaaacaacaagatgcttcgtgtgaaatcacctctcagtaactggcctctgtgggtattttaatcagtcccttatttagcacatgatactgactatcaacttttgtgcagaacaagatgttagcatggaggagctggcttacagaaaatattttagactttccgagacactgaaatgccagaggaagctggttctgtttaaaacaaaacaaagtgaaagacatacatacaaactatggcattggagaaggcatcttgggtgggatggaagttgtcttttactgtctgacatggtgttagaattcagaggacagaatgaaaggcagggaacatcccatgatccaaagcttacctgagtatatggtacttttataactgcatatccttgcaggatctgcagtaaatctgataaacagaaaaggagatcttgagcttctccccacacctccagctctgcatctgggccttcaatgtgattattttactctgagaactgcagccttctgtttttctctcccccaacatcattttaaagcatagctttccaaatgccatttctcttctgaagccaatatattttttacagttggagttagctgcaatgtctttcacagctcgcaagtcattgggaagatttgatgttcattctgctaaaatattgctgcctgaagactcaactgtgaaatgcagctgtctagtgtgtttgtacttcgcaatattcccaaaacacacaggcatgcacatgtgcacacatacatgaaaatatatgcacattcacacatatacgctttttaaatatatatttaaaagtttttaaatgaaagcctgtttattatgggaggagattctgcacaattaaaggtatcattcatcctgagcaattttgaggatactagaaaaaatgtagactatacaaagctggtgtgtgtctgtgtgtgtgtgtgtgtgtgtgtgtcagagagagagacagagagagacagagattaagacaatacactctcatctaagattatttacagtctaacttcttaagccatgatctctacgttggatagttggaaacattttataaaagagattatttatagaggacagacttgggaaacagaccgtcctaggttcagatgttggctttgttactttacaagttgcatgaacctgggcaaattgattagactcatcaaggtatactccttcactgataaaattgccacctacctccaataacttttcttagaattaaatgtgattaatgtgattatataaataaatgttctttgcacaatgtttgacaaacattgagaaataatagctccctaccccttctcatcttttatccgtgagcagagtaatgaaatatttctcacccttctcacatattccctcttacaaagccatggagttccctaatttgagtgtcacttgcacctcccaggacacaggttagaagactgagacagaactcaagattacctttcagcagtcctcattaactattctgtaggccaattgtgttaagtgattattattattattattttgagacagggtctcactctgttgcccaggctggagtacagtggtgtgatcatggttcactacagcctcaaataatccacccacttcagcctcctgagtagccgggactacaggcacgtgccaccatgcctggattttttttattatttgtaggaaaggggtcttcctctgttgccagggctggtcttgaactcctaggctaaagtgatccttgtgtcttggccttccaaagttctgggattgtaggtgtgagccatgtgcccaggaacattaagtgattttagcaagtgtaataattcctaaagattttgaaattgtcatagttgctctggatggtctagttaggttggtgcaaaagtaattgtggtttttgccattcactttttttttttccacaatcacttttgcaccaataaagcagttttagaatgaaaattctccacatttcattttcagcattgtcttttggaaaaatagtgggaatacatttttggaggaatacatttttgcaactttttccagaatctttgctcttgttcaaaattcatacaaaaattgaagatcttcgaaatctctgtaaaattgagggtctccatatatagattttcaagtgtggaatcaatggcatcattgaggtaaaggcttaagtggaatatcaccactataatccttgctatgaattagattgccagatgaaaaacatggaattcactgcctgtcacaagggacacctccccactccaaacagaagaaacacacctcttacagactcatttttacacccctcaagagcaaatagtccatgcttattattatttaaaaaacctagagtccttccaaaatgtaatgcattataaaagccttcacatcatggctaatattgagaaaagattatttatattttcaactcagaggcagagcttggtaaaatgctatagttgtaaaattttgtggctatgttattctttttcaagccgaatctcaggcagaatctacgtatatagaaatatgacagaaaataaagagttgctctagttgaagttggaggcttggcccataactgtttggcctttttcttgctgccttggcacatcctggctttatccacacccgagtcaccacctcagaaagtgagagtcacacagtacatagtagagaacctaccagtagagtagaaagagatctaacttcaaaaaaagaacatcaacattctagcgctagttctgccaggaactagggagatgagtgtccagtgagggagttagatgaatgatctccatggtcctctgttctgatgttttgttttttcttgttgttgtttgttttgttttaaattattggttttcatcaagtcatcatctttgttacctacatataagcaataaagttgttaagagttctttctctgtttttcccatatatgctttcaacaaatatggatttaggtgttacgatgttccagtatctatgttttgtgataacatgtttttttagaaacactcattggtttcattttaaagtagttgaaaatgtgatcagcattatctttacctgttttttgcaggtgtgccatgtttgaataagattaaccatgatgttggcagcagaggatgggggcacttcagtacaactgaagcagtcatacaccacttctgattactggggcgataacttgaacacttaagcaattgctagagcagatgtacgtttacaggcctctgctgttgtaaccactgctctggattccagtgatttgagaccagtctccctccctttgtaacctctctaaaggcaggcagtgtctcattggtcccagggctctcattgcctacgacggtgccaagcagagagaagatactttgtccatgtttgataaacacatgagggttcgatggctgtaatgagaggaaacccagcagttagagtttcctattcaaaagttccttccaattgccatatgtgttgtcttattgggaatgcattctgtcaagataatggtccatgagaggctgatgaagaaagagcatagcaattcttgaggcaaatcttataaagctgtcttgttgcctcttgagaaaaagggggctacatttcctaagattctgagtcaggctgtccaaaggtatctgcccaccaaagtacctttctatcccagggtcagcaaacattttctgtaaaggactagatacaaacattttaggctttctaagccatatggtctctgtcacaactactcaactctcctgtcatggcatgaatgcagccatagataatatgcaaatgaatgagcatagctatgtttaaataaaacattatttttgaagtcaaatggcaggctggatttggcccgtgggttttagtttttgtcgattcctcttctagcttatagtctagaagtttcacaaagttctcttaaactccaatttagtctttccttatctgccactcatgagaatagataaaataaatgatcacaggatatttcttggccttgtaagatcagatattcttcctgttccatgctcttctaaaatttaaaacattctcgacgaggcacagtggctcacgcctgtaatcccagcacactttgtgggaggctgggaggatcacttgggctctggagtttgagaccattctgggcaacataatgagactctgtctctacaaaaagtttttaaaacttagccaggaatggtgatgcacgtctgtaatcctagctactcaggagactgatgggagaggatcacctaagtccaggagactgaggctgcagtgagctatgatcatgccactgtactctagcctgggtgacagagcaagatcttgcctaaaaaagaaaaaaaagtccaaaacagtctcaaagaggcctgcaaacccctggtagtttacattctcaaggttatctctgtcctacacatttcgatccagatttgagttttcacccttttattatttccataaagggacagtcaaaagaactaaccattacatttattcaaaacaggaatataacactctttcctgagtattttaggggaggagaaaagaggagttatactgcaaaactgcagctatcttttaagtgaacattaagcattccactttttaaattgttcttcagctaccttaaaactagcaggcattcattgactatttcccctacatcacactgaacttacactaacctgctttatccatacttcttcctcatctacccaaatgtaaaaccaaaaccttttctgtgccttctgcagaacagttttggttgccttggctcttagcacatccatctaaccctgttgttctcttccacccacgtaatttacccagtcatttcaccaggaaaaatcagtctctccctaagtagaatctgcggggtgatgggtcaagcatgctctcccacattacgtgtacatgctattggccagacactgtcttccagcatcctacttacttatgaaagtcaaagtctaaagtgaacaggtattttactcctgaggattgcctctagaaacgaattctctctgctggctcctcctccagtagcatgtaattcatggctcacagcctaccaggtctaggagggcttctaggcacttgttgagtgcagtctctttatttgcaggaggaaaaaatctgaagttcagtaaggagaattagattgcttaaaactcagttaggatttacaatgtaggactaggacccaagtctaaaattttctaccatagaagacagcaatatttatcaagttatatatctacaaaattgctaagtagcattattattatttgtacatatagtttattgctcattgactggtactttcattgtatcactgtactcattatttttatcaaaatttaattcttttaataatcatttttataacagtttctgaaatgggatattaaatgtagtatgagcagaagctgcaggaggaagggagctagaaagatgcctttcttcctggtgtggtaaagggcatggttccggaggggtgacgacaatgaaaaaagacaagaagtttcatgaaaaagtgttttattctgtgatctcttctgtttttttttttttaaagttttcctaatcttttgagacatatattttctataataaagccttatgcttatgtaactcttgatgtttttcaaagtgctaccatatatcatatcatttgatcctcaccaaagtttttgaaccatagtgaatacaccaagctgtaagtcaccttaaaagactccatgccaacaaccaacctgctttcttcactgacacccagactatgccctgcacattctttcaaacttcagcaatacacagacacaaagacacaagctggtgctctttttctctctccctctctcacccttttcttctttcataaatatttgtcaacagtcatgaaacaaagaaatttgcagactttatctgacatcagaatgtgcttttctgaaaatagatgcactgaatgagataatgactttggaattaccctatatgaatcattaaattattcagccaatgtgtacattctttttatgctcagaatctctttcctttaatcacctcaagatggggaaggagtataatacttagaagaggaatctggagatgccatgatgtggggtggtcaaaattatctctaggttttcttagaatattccaccatcctcagccaaactggaccaaaaagttatttcaatcagtgattccgttatatgggggagtctatttaatttttagaagcagtagtgtaatggatggacagtaatgacatgctttctggctggtttataacaaagaatgcatttgttttctcatcctcacatcttttactgcttgaatttccttccctatgtgttctagatgaagctttatttggtgctgctctgataatcacataatatcccttttccccccttcttttggcctgcttgtgtacctgttctctctgtatttgaaattaaaccaacccaatgctataattgagagaaagagcttctgttttaattagtctcagtaatagatatgacaataagcagggctcgttcacagccattgcatcaagcaatggaaccatcagatcgctgatcctaacaccatgaaagctgtcaccctgaagcgctctctgatggggtacttactgtctccaattacagttgtttctccattatccatagttgagggggtgaagtagaggagaagatggtgcctccatagaatttggtgtgtgcagaaggatacgggacgtggaatggggagttgggatttgcttactagctctccccctccaccggctaggtgattttggatgtctttctcaatattcttatctataaatcagatatgataatccacgtgctgcctaaactagcagtttttgtaaacactcaagtactgcaggatttgaagattgttaggcgtctctactttgccattcaaattgcttcctttgctgagtggaaatatgtattcaatttgggttccatctaattttcatacccatttcctgatagcattcagtggtcaaaaggaaatgtaaggaggaaagagagatgtaaagggaaagtctaatctgcagacttgatgatcagtgtttacagaattcgtatttgcttcaaaggacagccgtgactttaagaaaatccaagatggcccccctcagcaatttagagtcatttcagcacttggaagtctctggaattgcaaccaaactagtaatttcctccacccttttaaatatgtatataaataaaaagaggctttattggttaaaaaagaacatctgagcatttagtgaccaagaaaattttctgcagtgtagaagtatattttgcattaaattttaaataaagcattcatttattcattattaccttttaagggcaacaagtaagtgctacacgctgggcttggccctgagataacagagctattttgttaagctatggagtctagttagagagtcagctttggaaggcagggcgacagtgctgagcgctgggtcaatacggagtgccaggctgctcagaaggaaggaggggtgagttgtgggcttcttggctatggagacgaggagaataggaacattctaagcaagcccagtcagccagtgagaaagtggaaccagggcaaagtgtcagagagtgaggcctctttaattaatgacactttaagaaatattaactatttcaggaaatcagtcctgaaaagagattttgcctcctgaccatgaggaataaatacagatttattatatttacaaagctgccttttcaagtggttgacttagaggatcagggaatctctgtctctttgtagaaattaacttcaaataataactaactccttttatgtatttaccaggaacatttttgtcttttggttggtttgttttttattgattggtgcttaatggaaggcccagtgagacatttgtagctaaatttgttaggagccacttccaattaaagttcatttgtaatgaagataaatgataatctgagttaataggaagacagtattcaacattaccttaaaaatgatttacacagaacaatttaggagcctttctagtgcataaattaaggtgaatatatgattaaacctcaaactatcaaagcctctcatttaatttgatatgcaaggtgaaatatcattataaggaacaggatcctgattctatttgaaagtaactttttctaaaagcctacaaggcaaaaacgttgggccaactgggagggagcccagggcttatgctgaagttttctgtattttgctgtgctcttcttccagcccccaaaatgcacaattcctttgcctagtgggtaagcccccttctagagtgtaaacttaactgggagtggggtgggatcctgcctctgaccatactgcagcctcagtatctaaaataatacctggcactattaggcactagtaggtgtgcaactaatattagttgtataaatgaaaggatggatgagtgtgtgaatataataaaagagtaaaaaaacaaatggtagttcttcctgtatatatatatccttgttgatttacattgatgtgtacatatagacatatatactgatttacattgagatatatatacgtgtgtatatatatgtatatatgtgtatatatgtgtgtatatatatgtatatatgtgtatatatatgtatatatgtaaatttaccaatgtaaatcaacaagggtagctttaaaaagtactgatgcctatgtcccgcccccagataatcttatttaattgatctcggatttggcccaagggttgggatttataagtcttcccagggttctaatgtgcaggtctaggtggagtcaatgtggtatccttgtctcggaaggcctggggcctctatttctgttcaatttcattcatagacattgacctaccaatatttgtgatcttgataagaaatagcgcttctggtttaactttttattcctccctgtcacagtaagccacgaagtcatttcacctacattgtaaaatagtgctacctactaggagatcttccacaagtcacttaacttacttgaacctcagaatttagaaaatggatataatctcttccttgcctacactactatgtttttgggaagttcaattaagataatagatgcaaaaagttttaaaacattataaaatgtaatattataaaatttaagcaattgttagtgtttaggaaagcataaatatgttcatgattaatttgtaattttaaggagatggaatttgaaaatacctgagaatgttatggaatgttacagaattcggcttcataaattaagaaagatgtcctagctctgttagcttctattcataatggatataactacttaaactctttgaacttcaatttcaaagatacctcctgtctcaaaaagctgtgagaattggacacatttcagaagagtgctatgtgagctctaaagcattatattaaaaaagcctgttactttgtttttgttgttgttataatatttttatcccactcatcgtttgctggaaacggctccctttagatcaggaaggttgattttgtgcctttcaccactcgtaattcagtgacttgaaactggccatggcgggagtatttacacaaaggaagtcagtaaatattataaatcaggaccttggccgggcaccgtggctcatgcctataatcccagcactttgggaggccgaggcgggcagatcacgaggttgggaaatcaagaccatcctggctaacacagtgaaaccctgtctctactaaacagaaaatacaaaaaattagccgggcgtggtggcacgtgcctgtagtcccagctactcgggaggctgaggcaggagaatcgtttgaacccgggagacagaggttgcagtgagctaagatcgtgccactgcactccagcctgggcgacagggcgagactctgtgtaaaaaaaaaaaaaaaaaaaaattgggaccttttgttttttggagatccagtttacctatataccatagccaatatctaaaggtatctatcattctgaaagcgaaagagtaggtacaattgtccctcattatctgtgggtttcacatcatggattcaatcaaccacagattgaaaatgttcaaatgaaaaaataaggatggttgtatctgtgctgaacatggacagacttattatcttgtcattatttcctaaacaatacagtataaccactatttgcatagcatttaccttgtattaggtattataagtgacctagaaattatttaaagtatatgggagaatacgtgtaggttatatgaaaagactatgctattttacataagggactttttaccatctgtggattttggtatctgagtgggggtcctggaaccaataccccatggatactgagggactgactgtactcagtaatactgggtgatttgaataatttaagttgaggcatggttgaaaccaataacacagcaatggttgagatttagcttgcaatggttgaaatatagtttgcaattccaagtattagtttattaaggagaaattgtatctacttcacccagacaaaagcaaacaatgggccaaaaccttcatctttttctcctacgtactcaagaaaccaggaaagcatacagcatttgctagccctaaaatagaggatcacctgactagtcagtttactgaagctaaccagtcaatttgaatttttcaagccaaaatgtgatttattttctttttaaagaaaatctcttctgccctaaggaagcttttattttcttgtcaggccatttacttttatttgtgactgacggattgccatctttgtcaaccatcaccctgatgacagttggacatctcttgcccctcagaaacagctcccaaattcctaaagtagcatccttgtcatcaacacagtgggaatggcttatctgatgaagccccactgaatcgaagactgtttcatacttctgttctctctctcttgttctgatctaactaagtgatatatctaattggatttaaacacagggattttatggagtaactatagtctctgtacgagcagacatttagacccctgtagttccctacgtttttatcctctaaggcactccttatttcctgtaaatttagttgttgcaagtagatcattaggtcatgggtcacgcactgttacaaaaggaagttaaaaaaagatagaggcactgctctccatgctagaaattagccaggtgcaccattatgtaaagagcttcaactagagagcacagtaattaaaataacaatgaaacaatagcttatgcaacactttgcaaatatgatattttcatttgcggtattgtacaaaccaagcacatcaagcagcaatgttaagtaatttgcaaaagaccaaggggaagtgaatgaggacactggaatggagtctgtttcatgctatgccaatcaaaggcctattgtatacaagggggtgttgctgtctgtggaggtatctggatgacttgtatctcccaggatgttataggttagcaaaataaacagtgtatgatctagaaagggaaaggagaggtagaaaaatctgctcattggcatggagtgttgaagataaagttctcattttgcaagtcccaaaatgatgctttttttcagtgcacccagaaatgatcagatgtgaaggaccagatcatgattatcaagctcacaggagatttatttttaagtgactgacaatataatatttaagtagttgacaataaagtcatgtacaccattctagttattagactattcttctatactatgcagagaaccccttttcaggtattaagataaaaataatcaatttctaaataaagggtttcttgtgttctcgtcttttggtttctttgtatcagcttgctcatttctactctgaatttggcatatcccaccaattactgcatgcacaattaatctactggcaaaaaaaaattggagaagaaagaatttggaaagcatgaacacaaagttttccttagtctatgaactttgttttgacttgctatttgacctggtatgctgtggaccagccaaagtgagatgacctcctcagtgccacccaagcaagtctcactaaaatcctcttctctttggttgaaatttttggaatgaccaatcatcttttttttttttttttttttttttttgagacaagttctggctctgtcgcccaggctggagtgcggtggcgtgatcttggctcactgcatgatcgtggctcactgcaacctccacctccaggactcaagtgatcctcccacctcagcctcctgagcagctgggactacaggcacatgccaccatgcctggctaatttttgtattttttgtagagacaaggtttcatcatgtcacccaggatggtcttaaactcttgagctcaagcaatcctcccgcctcagcctcccaaagtgctgggattacaggtgtgagccaccacgcccggactaatcctttatttttatctgtgaatgtatattcatgatacaggagcttatatggtgggactggaatcatttgttcaattatccctgactgcattacctgctgatgattggtaggattgtaagtggtgtgcagaagaatgcagtcttgggactcatcaaagaccaccttaacaaagaccacctcaaagaccctcctcaaagaccaccacattccacactctaggagctgcaaatggaaatgacagtttatggttacatggcctaatagtattattttatttttttaactgacaaaagttgtatgtatttatgatatacatcatgatattttgatagatgtgtacattatggaatgactacagctaatgaacatatgcattgcctcacacacttatcatttttttttgtggtgagaacatttaaaatctacactcagcaattttcaagtatacaatacataggccaccgtgttatataatacatctcctgaacttactcctcctaatgaaaattttgtattctttgaatggtcacatggcctaaataactgaattatatgtgccatatatccacaaaaattatttactttacattaatgaattacttattagaatttgaggccattatactacagtttacaatagtgaacaaaatattccccacctttattcccagtagaagacaaacagtctgcaattctttcctttagatctgcctccaatatcctagatcttgtgacattaaagctaatcaaatggcttgataaaatgggaattttcaaagcataagtgtaaagaaacctgcagctatagtgctgacagcaccggtcattgaaaattaatcttgtgggtttatatgacagcactgatactgataggtatctattcttttgcttagtcatcgtttatttattgagcacctactaatggctgacatggaggtgggccctggaggtaaaaggctgagtaaaacagatatgattctttcctcagggattttattgtcaggtgagggaagtagccattattcaaataaccccacatatacatttctaattctagcaagtattgtgaaggaaattaaagggtgattatttaaacacaaacaagggtgggaaagcgtttgatctgagagctgaagggcaaatgagaatgaactattcaggggccaggtgtggtggttcacccttataatcctggtactttgggaggctgaggcaggaggattgctgggggcaggagtttagaccagcttgggcaacatagtgagaccttatctttacaaaaataaagttaaaaaataagaaggatgaactaacggaagagacatgggggaaggagtggaaggaaaaaatcctaggtaaggaaacaacatgacaatgttgtctttctcatgacaggctttctcagaaacaaaagaacagtgcaactggaatacagtctgtgaggaggaaggcctttcatgtggaggcaagagagattagtcaaagtccagagatcactcgtatggcaggccttttgaaagattttgctctttttcctaatgacaaagccttgaaggatttagagggccatcattcagatctggggtccgttgggagctttaccaagcctaagatctccctccaatggaaagacaactatgttgtcttgctaatgacccagcaaccatcagattccatctgctggtagctgtcaaaggcaatgacagcttgtccatgctccaaataactatattatagaaaatatggtaagcgtgggcatctttgggcagatgtcatccaaaactttcactggattctcaaaagtggtccatgactcagaaaaaattaccctaaactggtactttcccaaatgtaatctagtttagcatttttatctctaacttgtttttcttcttgtttttatgttaaaaagtcactgtttctaatattctgagtgagcattagtgcgagctaatggctttttaaagaaaattggtggtggttgttactaaagttgatggatttattgagcacctaaaatgttctttttctgttctacaaagtgtgtgtatatgtgactattatttctgcaattagttcctgattgaagtttctactgaccaaggggccagtgattatttccttggactgtggattcaggctctgttttttttcagggattcctacagcaggcaatccctttctgttctatgagctacgaaagacagaatgattaaagtggttctatttccaaagtacgtaggactttgtggggaatttgtttttgcatgtaaaatacttcctaataacatataatcagctacacagtaactctttatggtatggcaacatttttgtgcaaattactatactaggaaatccagggcccacaatccacttccttagaaatgtgtattgatctcctactatgtgtgctacattggggatacaaaattataaattatagttgctgcccccagaggttttaaagtctattaaggtttggccggacgtggtggctcatgcctgtaatcccagcactttgggaggccgaggcgggcggatcacgaggtcaggagatcgagaccatcctggctaacacggtgaaaccccgtctctactaaaaatacaaaaaattagccgggcgtggtggtgggcgcctgtagtcccagctactcaggaggccgaggcgggagaacggcgtaaacccgggaggcggagcttgcagtgagccaagatggcgccactgcacttcagcctgggcgacagagcgagactccgtctcagaaaaaaaaaaaaaaaaaaaagtctattaaggtttgatgaaatatattttacaaataatgaaaatcagatgtgttgattgctttcatagacatatataatttatctcatttaatatgtagtgattgtgatagagaatagaacaatatgtaagagggaatgctgcctctatgagttttacacacataaataagacttttcaataaaatgtgacgagtgcttggatacaggactgcatgtagaaggcagcctcactgagagtagaggattagaacaggcttattgggaaagattacactgcattgagtcttgaggaggacaagctagctaggtagagaaggagtaagggggtgtcaggcagagggcacagcatgagcaaaggcatgaaggtgagatgggatagttcccttgacccatctgcaggattcctgaaggctcatttgcttagcctgcagctctgaacccctcatgggaggggaagcacgcaggtgagcgggtgcaggtgccggggcagatgaacactggaactggctggtcactccgctctggtgggagcaggctctgtgtgggccccgcagcagtgtccaactgtgttgcaatgctcttttagctctgccatctgggaaagagtgtctgcgacccctggagccccagagggtgtatgttacaatcagtgctcctttagcattcgatgtccatggacagctaagtgttgaccagttcagtggaagatcagagtgacagccttttattttacactctgtcacttggtacctgagttcttgtctggtgtccaggaagaattaggtcatgcaaatgaattgaaagatggtgtatgaggaagattttgttgagcagtggaagtgggtctcagagggaaggggagctggaaggggcaaggcagtgggaagataatcttcccctcgagttcgaccatccccggccaagctcttctctgaagtcctgccatcaagccgttcctctgaagtcaagctgcttctctccgacatccagctggttattttcttctcttctcctctgccactccactttgcccttctgccagtggagcttggggtttttatgggtacagggtgggtagcgggatgggccagggtggttttggaaatggcaacatttgggtgggaaaacagaaatgtgaagttctcagttagggccatgggtccaggcttgagggtggaaccctcgccagggacccaccctcttctacccagcattcccctgcctcctgtcggtatcagagggatgagagcacctgctagatgtaaggaagcataggaaggaacatagaggaaggaacagctatctcctcttccactaacgcaagtttaataaaggtggcttttagagctgtcatcattaatgagatgcgagaagacatctcaggaaaagggagcagctcatgcaaagtcatgaactagaggaaaacaaggtgtatttagggaaataagttgtttcctactgtatggtgtgtgctcagggaacatgacaggaactgttgggagtctatggaggtgggtcaggagggcctgagtccaaaatgaccattctcaaacacttaaaattaagtctgttggcaaagatttcaatatgggcttaaggtaatggaatataaggaagtagtgacagcttgtgctctcagttgttgcaacatgtatggagaggtatagctaccaggaatcacaaagcagcacgtacttgtcctccattcagtagctattgcaccatctcctcctatatgctgtgctatgagctgtgagtttctgctcaaggtgctcgagaaacagcaacaaggaaaacaaaaacctagttttcctggagcttacatgcaagtaggggcaaaaagacacaagcaacataagtaagcatgtgtgcagtgtgttatgtgataagtattacataacagggatgtgtgtcacagcggggaagggggaagagggtgagctgggatatgtttgtaattcagatgaggttcttggggaagatctcactaaggagatgacattgaggaaagacctgaaggaggtgaggcagcaagccatgaggaagaacattctaggcagaaggaagaaagcaagtgcaaagacttcacctcgagggaggagcgtttgaatgattttgcagaaaaacagagaggccggtatgactggacagtctgagtaaagagaagaatgagatgggatggattcagttgcaagtgattgaaatgaataacaagcattcatcgatccaaggattcaatgaccctaagtattcttaggtagaaagcagggtgacaggcagggtgaaataaaatcttcctctattctgtagagctgtgacttaacctttcagtcttgtgaaaatatgtatttattggtactgctggacagttttcctgctggctgtggagagagtcttggtgaacagagaggcctgcagcaaaagagttaagagatactttctactctagatgaatcagacagaaatgagtcattttttaaattacagaggtggacaccactttacttagcaactgtccttttgaaaattagctttaattttttttatttcagtcataatcacggaactataattactggaaaggaccttgtttgtcatctaacccagctctcattttatagtttcttaagaaactaaggtatgaagtgtagctgaaatactattacaaataaatctattcactatttaaaacagtattctcataaggaatcttttgaaaaatatatataatcccttaaatttatagtttcaaaaatgttttaaaatatttatgaagtccctactatgtatttgacactattctggcatctgggaattcagccacaattaataaggtagatttcatccctactcagtcagcatttacattgtgctgtgaggtgggagtagggctagggagagctgggagtagtatgtatagatgacaaaccagtatgttaatatatggacaaaataatttcagagaaagataagtgatataaagacaatcaaagcacagtgatgaatcagaagaattagaaagtaccagagctgtggccatgcagtgccgctctgagaaggtgaactttgagcagagaacagatccaccttcaggagttagtggtatgggaatggcatggggaggggaccaggttttccagtcagagggtacagccagcacaaaggcccgagcttgctgtgttcaaagaacagacaaaaaaaccgcatggttgaaatgtaatggaggtgtgatatgtaagatgggtgtggagaggtgcaaggtggccagcccacatggggcctcttaaagactgtggttagacaggtctacgaaaatgtcagaaagctttcaacagggaaatgttgacatcaggcttcatttttcagaagatctggcttctgtgtggagaatggactatgttgggacaaaagacgaagtgaggagattagatagatgccaattttaccagctccggcaagagaggttgaggcttatgcttggttagcactggaagtgaagaagtaggagcagactggattcttttctatcagatttggagtaccattagccgtataaatcattgtggggcggggaatgcctggtgccgtggctcgtgcctgtaatcccagcactttgggaggccaaggttgggagcattgcatgaggccaggagttccaaactagtctgggcaacacagcaagaccctgtttctacaaaaaaataaaattaaaaattaggtagacgtggtcacatgcaccagtagtcccagctactgggaaggctaaggctggaggatcttttgagcccaggattttgaagctgcactgagccgtgatctcaccacggcactccagcctgtgcaacacagtgagaccctgtctcaaaaaaaaaaaaaaaaaaaaaaaaaaaaagtaaaagaaataaaagaaatacagatttatttagtaacttcatgtaagagaatatgaggctcagaagatgaagtgtggctttttcgaaacacaagataaaactatttactgaaaagcctagacttccaaattggttgctgaaaggatcctgggatggaatggctcccactgatgagagcttaagcatggctttctgctttccctccagctctgggaagttagtctttttttcctccctcttccatatgacttgttgccaagttgtttgattatctccatgggttgctttcgcagcaaaactagatgccaggtggaacgcagtctcctccagctccctgattccttgtggccctcaaatataaaccatgaggatttttatttttgagatcatcactgggaaaaatcacaacacaaacttcaaacatggagagcttttagagcactgaattttttctaagttttcatactctggattctttatgagtatgtcttattttctttggattctttgtcagatgcagttctggctaggagaggccgaataatggcccctcaaatatgcccacatcttaacaggtgacacctgtaatatattaaatggcaagggtgaattaaggttgcaaatggaattatggtcactaatcagctgaccttaaaataagaagactatgctgcattattggtgtgtgcccaatgtaatcacaattgttctttaaatgtggaagagggaagcagaaaaacagagttagagagaggtgtgaagagctggcttcaaagacagaggaagtgggccaagggccagggaatgcagatggcctctagaagtgcaaaagataaggaaatagatttctttgtaaagtttccaaaagagaagtagctctatcaacacctggattttagcttacctagacctgttttggaattctgacctctggaactataaaataataaatttgttttgttgtaagctaccaaattttaggtaatttgtcatagccacaataggagatgaatacatttgcattctgccattattctctgagaagggacctttgaactgagtccaaacaattgttgttaatggaaagggcttatctagccttcccaatttatcttttttgaggtctattataatggatactatgactactactgctactacgattactactactgcatttgagcatttactatgtgtttgcactgttttagacacttaactgcccttgtcatccttattttacaaaataggaaactaggactctggcccaaggagtgtgacaccagcttttcaatgaagaccttacttcttcctctgtgagagtttcacttgctagcaccttgcaggtgaaagggagggtggaaaggacaacttgaactgtatgttttcaagagttcactcacctcaattataaatttacatctctggagacctcacactgactcccatctcagaggtctcctagcttcacgacagaaagagaaccttaggtcatttcctgagagttaaggaaagttaattaacatttaggaccaagggaccagtttaggtgcacatttcttgatgaagggcttactgagttgtaaaagttaataggaggtagaaagataggaagagagaacttaggacagcctgggattttttttttttttttttttttaacaattcacaaactaagatttgttaagattctactaagaatctactttggctacatctgcattatgtggtagaggaggtgagatgccaagtttataagtgcatcatcatctatctctgctgtgtttatagaatagtaacacatgtaccgaacataaaaacacactaaagcacacaacaagtgtttaaatacagagtattgcccatttagcaaaaatatccagacacaaagttgagcaggcatcgagctggataatgcttccatgatgcaagcacccacattagtgtgggccttggacaatgggaggggcataaaaaaggaagcaatttggctaagaccccaaggggtgcttggagaaatcacccagtttgggggaaataaaattggaaaacacaagctgaaaacagcaagctcatgcaaacaatagagaaaggcatctaagtggaaaacagagactgaaggaaaattagaattaatttaaatgtaatttgtttaagatcttcagttaatcatctgcatgctgtttttcatccaaacacagacacatttttgagatgagaattattgttaaaaaaaaaaaaaaagatgttaaaagaaaaaaactgctaagtgtctcttagactgtcccagcactagctcctcttcctccaattcttaatgatgaaactgaaagtttgtggttagcataatgtctgtatgcagtctttcatcagcaaaggagaactcaaatttcttgattatcctgacttgattttccttgacactgagtagcagtgtcaagcacctcgacaagattttcagtaacaacaagagcttccaggtaaccagtgctttctcaccttgggaattcagggcattagggttttgtttcgttgtcctgagtcttcagagctaaggagacaaagcaggatgtagagactttttaccaagtgtagttatatttggtccccataattaaacaataaacaaaatcaacaaagaaatcaaaaaaatgaagatggcgatctttgattttataaaaataacttccagtatcataaatttaaggtagaaaactgagtaatggactgggaagaatcatttataggatatgtaacagacaagtgattaatctccagtgcacataaagagcttctataaatcaataaaaatctgaaaaatggacacacaaatgtaaaaggaaatccagagaagaaatataaatggtcaatagacataaaaaagtggtcaacttcaataataatggaggaaatacaagctaaaaatgaaaataacaaaaattaaacaaatttattctatccagtgatggaaatgatgtagaaaaacagctaatttcatgataggatcattaattattacagctttcctggaaggcaatagataatatgcatagatattttttaatgtgcatatcttttgacccaataatcccatttccaggcataaatcccagagatatacagaggtgcacaatgatgtatatataactatatttattggatctcatttctgccaaaaaaaagtatatatgatgtacatgtgtatatatcagtgtagaaaagtagaacctcaaaaagtatataacacgttaacattgttgaccctagagaggagagtgtgtattagtccattttcatgctgctaataaagacatacctgaaacttggtcatttatacaggaaaaaaggtttaatggacttaacagttccacgtggctggggaggcctcccaaacatggtggaaggcaaggagcagcaagtcacgtcttacattgatggcagcaggcaaaaagagagagcttgtgcagggaaactcacccttgtaaaagaatcaaatcttgtgagacttatttactatcgtgagaacagcaggaaaaatctgtacccatgattcagttacctcccagtggctccctctcacaacatgtggaaattcaagatgagattttgttggggacacggccaaactatatcagggtgaatatgacagataaggaaagaagggaaattttcaccttttattttataaatttctatgttgtttaactattttacagtgaaaacatatacatgaattcctatataattcaacatgcatagccatggacatacattttaaaatctgtttaggaaaattgtttaaataattctaattgattttggttacatctgtctacagatagtgactaagcattctagaatagaagggattagataaatatgcagacaacaacgattccacatgtaattgtgataatggaatgtaaaaaaagacgaaatttgttttaaatgtcgaaaataattcttgagaaatctgttttgaaggtgactgtgtacaacagcatttttcttcttctcctcttagaaattatacaaacacaagaaggagaaagaaattaatgttaaacccttttccttgatactccatgaagtttatagctttcataagaatgtataaggagaccaaggctaagatggagcagaagctgcctgggaggaagagcggaggacatgaggagcgttttgaaaggatccagtggcagcaggtgtcagagagcatcagcaaaaatacacgttcttcagggaagtctttccctgatgtgccaacctgttggccataataaaaggttttacttgtggataatactgacaatatcctgcatgaaatatgactaaacagaaagcagctggcagttaagggaataatactgttgatgaggtgggatttattggagcaatacaaaggaattattgataaaattcatcatactaataatgtacaaaggtaaaatttctatgatcaatcatcatcacagacactgaagtgaaaatttggcaaaattaaataattattcttgattaaacacacacacacactcaaaataagtatgcatggatacactactaatatgacaaaatatttcaagcttggccccaaagttaatacttaaacaattagtgcaaagatcactgagtgaagtagcagtatatgattaatatgcaaaaatcaattgcttctataaaatagctggttagaagatttaatgatagaaaaacatcaatttaaaatagcagtccacagaaattgaaatacttaaaactttttgttttatgtatggcctgtatgaagaaacattccaccattcctgtaaaccaaaaaggaagtctatcatggaaagacataccaccatgtgcttggacaagataacgaccgggcgcagtggctcatgcctgtaatcctatcactttgggaggctgagacaggcggatcacgaggtcaagaggtcgagaccatcctggccagcatggtgaaaccccatctctaccaaaaatacaaaaattaactgggcatggtggtgggcgcctgtagtcccagatactcaggaggctgtggcaggagaattgcttgaacctgggaggcagaggttgcagtgagctgagatcgcaccattgcactccagcctggtgacagagcggactccatctcaaaaaaaaaaaaaaaaaacaaacacacaaaaaccccccaaaaaaacaacaacacaaaaacacattagcaaaaacatgacagattcataagtcaatttctatatgtaaaatggtgtcagttaaaataccaccatactgggcatggtggttcatacctgtaatcccagcactttgggagaccatgatggggtttgaggaaggtgtctctcaagcctaggaattcaagaccagcttgggcaacatggtggactctgtctccacaaaaaaaattagaaattagccaggcttggtggcatgcacctgtaggcccagctactcaggaggctgtgaggtgggaggatcaatgaagcccaggaggttgaggctgcagtgagtgacccgtgatcaggccactgcacaccagcctggatgacagagtgagactctgaaaaacaaaaacaaaaacaaaaaacactcaccaaattcgtagaatcagacacattagttctgaagtttatatgcaaaaatcagcaaattagacaatgaatgaacaaataccgtataagaagattaatgaagtatctatggttagaaattgagaatacactgcaagcttctatgaatacatgaagagatctctggaaaataatggacattctggacagttgatctaaatgcatatggaaattcagtgtatgaaaatgtatcatcttaaagcagtgaggaaaatatagatcattcagtaaaaattgtagcagtctgcaacaaaaacataaaattactgttggattgttatcttgagccacacaccagcatagattacaaacaaatcaaagcttataatgtaaaaaaaaaaaaaaaaaaaagcactgaaagaaaacatggacaaattcctttatgaacttgaagtagagaggcggcttttaaatatgactgaaaatccattaatcattaaaggaaaggataaatccaaccatatgaaaataaaaaccttctctacgggggaacatgtcaaaagaccactgattgactgggagaagcttctgcaattcatataacaggcctaattttccgtaaaacatccctataaaaagagattttggaaatcatgaagaaaaaagattttctactcaatagaactgaaaaagaatataaacaaataatcactgacagggaagtacaaacagttcttaaccatatgaaaaatgctgaatttcatttttttttctttttttttttttttttgatacggagtctcgctctgtcacccaagctggactgcagtggcatgatctcgactcactgcaacttccacctcccaggttcaagcgattctcctgcctcagcctcccaagtagctgggactacaggcaaccaccaccactcctggctaatttttgtatttttattggagttagggtttcaccattttggccaggctgatctcaaactcctgacctcaggtgatccgcccgcttctgcctcccacagtgctgggattacaggtgtgagccaccacgcccaccctcaacttcattcttaataaaataaatgcaaatttaaaatacattgagatactgttagtttggtttttctttttcacttgtcaaattggctgaaatccacaatttgataaaacattctgttggtgagagcgtgaggaaatggacattctcatagaatgcagtgggggaggaagggagcataaatctgcacaactcctgtagaagaagtctgtttagaaacaactacaaaaattacaaaatttcaaattcatataccgctctgagaatacagagaaatgctgtccttggaacttatccttcatattatgtgaaataatacgtaaaatttcattatggcattcttttaaaaatagcaaaaggttagggaaaaatccagtgtccatcattaggggactggttaaatgaagtatggtccatccatacaaatgaacattatgtaattgagaaaaagaatgtggcccctccctatgtgttattttgggtaaatctcccagggatacggttcagaaacaattcaacataaagaggagtgtgtgtagcaggttgacttttgtgttacaaagggaaaatagtaacatatgttcatacttgcaggtttctaatcctgtctccaccgcttacatctgggtaaatttgggcaagttacatgttgtgtctgggcttcaatggtatcacctagaaacgaagataatcactaccacctaaaaaaaattgggaagattaaatgagaaaaatatttacaaagcacttagcaaggtatttggttcacaattgttgtaaaaaggacagttactactctaaggggctctgccttctctatataaacttataaactttagaaactaatctgacagcctagcacctactaatatttatttgctatagttcacccagtgtatttgtacatttaaaaatatatatctcatgaagtcccagagtgcctgaggattgaaaggggacagcatcacagctctaatgctaagagatacagaccattaaggctccatctgaaatcaagtatctttaaaaaataaaaaaaagaaggaagtaaaattcaatttgtatgaaatttgatttgcacaagttctcagagaaacaggaactggataaagtgaatttcacctgtatcgaatcatcagtcaccttcagtacctaggaagacaccaaaacaacatctggcaatcaattttccatctttcagtgcagcctgaggaactgggtagcaaccagcatggtattgtaaagagaaaactgtgtgggccaattcaatttcctcctatgacagaatgacaggtcacagagataggagaaaagcaatagatgtaatctacatgagccacagcaagtcttttgattcagtcccacatgacggtctcatcagggctttctgaggattgggtctaaatcagggtttgaggaactggggcccctcctacccccaccagcgtcacccaaccctagcagagtgctggatagaagcagtgcgataatctactagagactggagcatgtcagggacgacagagaagatagaagggatagagggaggtgaaattaatgcagacccagagacagagtaagaaagagagagtcagagacagagagaatgtgtggaaagtttctaggattaggagactgtaagtataggttaagacactcagacaggtgcagttgctcacacctgttatcccagcaatttgggaggccaaggtgggaagattgcttgaggccaggagttccagaccatccctgcaacatagcaataccccatctctacagaagaagtaaataagtaaataaaaattagcctggtgtggtgggatgtgcctgtagtcccagctacttgggaagctgaggtgggaagattgcttgagcccagaaattctaggttgcagtgagctatgatagcaccactgtactttagcctgggcaacagagtgagaccctgtcttagtgaaaaaaataggaacaaaagtaaataaaaatagaaacactcaaggagataaacatgagctgggagactatgttgacagcagggagcttctcatgggaagggaagatcctggtgggtggggaagccaagcacctccatgtcactgaggatgtaaagaaaaatggacaaaagagaataccattcacagtcactcactcattcattgtgtgtgtgtgtttgtgtgtgtgtgtgtgtgtgtgtgtgagagagagagagagagagagagagagagaagaggaaggaggtgaaatctcaattaggagttttgtgagaaactattgggttatgaaggtgggaagagcggagctcacactgggaactctgcttcaggatcatatagatattggaaagtttcgttgtagatattggtgaaacttgtccattgaattactgtagaactggaaaaggaggaatgaatgttactgttgagtcaaagatacgaatatgaggacctaagctggatggaccagtttctcttttgctagctgtcctagctcagattctggacttgttgtaagaagatgaaggggtgagggaatatgggtcacaaatagctttgacttcagtccaaagagccctctaatgtaaagaagacttggtattttctcatcccagggaaatcatggccttatttttaacacaataaggtaaattttctcattagaaagttcttaatttgtcatgtcagtaaccatgtccttctaattgtggtgctgtcagttcactactgcaaaaaaaatgatcctctgttctcaactcggtctcagttactgcatcatcgtaatagtttgataattttattactactcgaaggcaagtgatccttcttttgttgactactgaggaggaaattgttaatgacattaatagcttgataatgtgacacagaactctgggtaatgcctagtctgtgactgtgtggtttgtctggagaattgagtaagaatgctgggaagaaacaagagcatcatgactttatgggatgacttgatgcccacctccaaggttgctgtgacgattaaatgagatagtgtatatacaaaaatgggcaatagcaatggttcaataaatgttagctttttatgaaaatctaagttaaacttggcttattctcttctttattgtcattcattctgtaactaaaaaaaattagttttcttatcaaacactgggcaggaaggatgaacttgaccacttcattcttgatacccatgaagtcagaatcgggtaatgaaaatcattcattatatctgatgccataaaataggcttagaatgatgtgtgaaatatagtaaatgttcattaaatatatgttgtcattattattagaaagggtggagagacctaattgggggtgatgacatgaataaacttgtcctatgacattgacttttaatttatacaagttggttttgaaaattgaaaaaaaaaactgactcctgattctctcatggacttaaaaatttcattttgcactccagtacgatctggcatggaggagatggactctgcctagtactgtcagcagcttttggagaaggtcgggatcctgctaagatgagcacagcatgtaatgtttgtcctttggaagcaaacactttgccttcattgcagtcttcttgtcagaaggaagatagaaatgggagatggggagaagtttttataattaaagaaaaaaaaacttgtttcattcttagcctggggcttcctggggctctgaggattccagtattattggagtatctggagaatcacagttctctctagctgatcaaaagtaaaattaaatgtgaggccgggcgcggtgactcacgcctgtaatcccagcactttgggaggcagagtcgggcagatcacctgaggtcaggggtttgagactagcctgggcaacatggtgaaacctggtctctactgaaaatacaaaaattagccaggcacggtggcgggcacctgtaatcccagcactttggggaggggatcacttgaggtcaggagttcgagaccagcctgaccaacatggtgaaaccccgtctctactaaaagtacaaaagttagccaggcttggtggagggtgcctttaatcccagctactggggaggctgaggcacaagaattgcttgaacccaggaagtggtggaggttgcagtgagctgagattgtgccactgcactccagcctgggtgacacagtgagactctgtctcaaaaaataaaataataaaataaaataagataaaatgtgaattctgtatcactttatcaacacatggaccccaaagtctctgtactgtaaagagatggcctcagggctgggaggaaagactcaggtagctgagacaggaaggcagtcaggttctagggctggagaagcatcagcaataatggataatgcagggagtggaggtgggaaaaggagtacaagatgctttcttgggcattttttgaggatagaattcaagggcatgttttatatgtgtgtttcttttaaaattcttgatgcaaattaccaaccagaaagcccagggtagatggagggtagggaggatggaaggtaatccattgctcagtaagtgagataggtagagtgcccctgcccccaccaccactgtgccactatttttctggaagcataagagatacccagagccctgggtgactggagcagccacaaggctggacacaggctaggctagaatgattttactttggctaaaaccagaatgtccggggaaatgtggagcccacgggcagttactaccattttctttttatcagtccgtcttctcatgtggtttcttgggaatatgttctcactcagaagaaaagtgaaattccagtaatgccctctcctgacttctacactgagcaagacatgggggtaaaggctttgcctaaaagagcagggacccaggagggatggctgacctaccgcccatcttccgtctgactccagtgggggtggttctaagatattggtcctaaacgctgagactgctgctttgacatttactggagtctcccaacccatctcttaatcttccctttgatttttatttctgtgttcattggcttctgttgcttctctgccaggaagatacagtttcctatgcattatgatttgaactcaaaaaacagaaggctatcagaaagacagaagtttctttttatctgaattcagaaaaacatgttggcttggtcttagctagatgtggtcagaaaaaaaggtgaataattgtttggtaatttcatgggatttatcgcaaacttaaaataaaaagtgagattctctttaacttctggttaaatgctgaatcttaaagtactatatgttgaaaactagatatgaacaatcaaattaaaaaataaaacgtaaaaattatctagatatggaaagcttgttgatctttctacatgtcaaagcttttcaatttatttgaaaattggaccaaactctggcagtttgtaccattttgttggatctttttgccaaattctaggcttctaacacatcagtagattccagactgtcacacattatatcattttatactttatttatctgctgagtttaattttgtattatttataagcaatatcacctctccagaataatgactcttaaatattattcaaagaaggtttgtattttcctgaagtattttttctgttttttaatctccctctgaaaaatactgtgggcagacttgattgatatttgacaaatgagtcaactaaggcacagagaggttcagtgactttctgagggtcacacagcatgtttatggcagagacagagctctcagatctaattggtttttcttggtcatgctgtcatttggcgatgcagtttttaaaggggctgttcctgtacactgcattttcaccttcaccattattcaaatcaactcagttatttacattgttgggcccgggttggtacttcatctgttaaaataaaaaacaaaaataaaaatataaactgatggcataatactgcatcccaaagccagcagtaccattccccacaggccagcagagggtcaggaataattcactcccaggcctctgtgaatggctctgtgcttttccctaggctacgaagattttactgtctcaatgattttgtgttggacgattcaattaaaggtcttaaaatttaacgtgtatacttttgacctaacagtttgatgtttaggaatttaccttaaggaaataatgcaaataatgagtaaaagatatatgtgtcaaaaaatacattaacaagtatgttgatgataataaataattagaaattactaatggcacaaggaattggtagagtgaattacagtcaatccacacaatggaatatggtataattctttgaaattgtaatgtagattttggtttatccacagctaaagatctccacaatattttataaaatgaaaaaatatatatgtcattaacaatataatatatttatggtataccaatatatatttatgatacgtactgtggctgagaaaatcatgagtgatttaaattttcttccaaataaagttttgaacattttatttttgtaatgtactttcatttttttataatcatagaggaaggtaggaaaggaggcagagtaatttttatttttttttttttacttatcggctacatggaatatttccaagttaaaagtttttataatggaagtggtatgacaaagaatatttgctattcttaacgtgtttaagaaataggctatttaatggatgctgtatacacaagaatctatttgctttgtgctgttcgttagactgggatggggggtacagaggttgaatagaaagcacccaatataactgctgcattatgataatgcagctgcttgtatataaagacactacctagcaaaattttgaaatgacttttccccctgacatgactaatgctattgctgttaattaagtgacttgtttggaggaaaagaataattgtgaaatatttttcagtacattcctgtcttcgaagaggaatgagttcccatagtcatagtatgtatttatagaatggataatacataaaacaaattagagggtaaaacgctatactcaaagcacgattttcatctgtaataagacagtgtcaaccccctggaagatatttataactgaagcattgcttctagacatgcggatttaagagattagcatcaaggtggtccctgggacagatcacaggtagcacataggcttagagaaagccatttataggttctctcatgggttcaaaataacagcagttgataatctagtagctagtgttttttctgtgtttttttgttggttttgttttgttttttgaaacagagccttgctctattgcccaggctggagtgaaatggcatgatctcggctcactgcaaccttcacctcccaggttcaagcagttctcctgcctcagcttcccaagtagctaggattataggcttgcgccaccatgcctggctaatttttgtatttttagtggagacagcgtttcaccatgttgaccaggctggtcttgaactcttgacctcaagggatccacctgccttggcctcccaaagtgctgggattacaggcgtgagccactgcgtttgacctagttgttttttgttttgttttgttctgtttttgtttgtttatttgttttttaaccattcttaatgatctggtgcggaatggagaatggcgtcaaggcttaaactagctaaatgaatgctgttgagaatcgggtttaataatatttatatacttatttttattgacaaaggaaattaacttatcctaaagaaacatcgaaggtgagagagaattgcactgagccaagccttcctggcatcttttatctggcacctcttttacctagagcatggatggcaaatcttcatctaaagggttaactctaatcaatcaaacaatgtgtcgagaaggatcttgaggcactgtcctgtctctgtgggaaaatggaccatggccgattcatgatacctgtcatagttaggtgtgagaagagcaacaatactcatgtggtacattcaccaactcagagcaaaggaaactcatttggaggggttagagggatttgtgatatgctattatgacttttcgattgttacagacttaagctgttggctttgttgacctaatttctctgactcaaaaccttgtttataaaatcatagggaatgtgaaatgccttacagccttgggtaaattagggtcagtttgagactggggttgagactttggagcctgtagtttcttctgtggaagcccaagagactcactctgcattcatgttttctttctttccttcccttcctttcctttccttcctttccttcctttctttccctttctttctttctttctttccttctttctttctttctttctttctttctttctttctttctttctttctttctttctctctctctctctctctttctttctccttccttccttccttccttccttccttccttccttccttccttccttccttccttccttcctttctttctttctttctctctctctttttttttttttcagagtcttgctctgtcacccaggctggagtgcagtcacgcgatcttggctcactgcaacctccacctcctgggttcaagcgattctcatgcctcagcctcctgagtagctgggactacaggcacatgccaccgcgcccagctgatttttgtatttttagtagagacagcatttcaccatgttggccagacttttctcgaactcctgacctcaagtgatccacctgtctcggcctcccaaagtgctgggattacaggcgtgagccactgcgccctgcccctgcattcatgttttcataaggtgtccctcagatgggctctgaatatagatcaaacctacagtccttgcgggttgaatgcagagctctcacaggcaatggagttgatttctcatatttcttcacaatacccttagaaggttcagatggactccccatcttattgatagagaaatggaagcctagagaattgaatatgatgtcatacagtctgttaatcatacaactcagatataagcccatgcctttttcccacctcatgtgctaacactggtggaagagaaggtcaaacaagtcttcgcaatgtatccagagaagtgaggctttattttattatgcgtctgtcaaagtcaaagcacttttattaagtgctgggaagaattttatatactaattagaatggtgtatgtgagtgtgtgtgtgtttgtgcatgtatgcacactcatgttgtgcatgtatacacacccatgtttgaatgaaaaggggtgagaggaaacatgtagcaaattgttagagctattcccttggtggtaaaaatacttcaaatgttcatgcattagatatatcctcataggccttttcacaaagtaacaggatttctgactcaatttaaaatctgtccagaggatatttattattggtaatttataaaatggatagtagaagacaggctgatatattagtatacaatttacaacattttagggaaaactatggtattttctatagtatagaaagataacatagccgcacacctttcaaacactaggtgctcaaaaaagtgttttgtttttgttacttgaactataggtttttgctgtatgatgcaaagggtatcactttgcaaaaatatttgcatttatgaggatgcaaatgccacatttgtaaaaaaaaattaaatgctaaatgcatccaggatactgactcatatattaccatggttttataaagcaaacagtcatctaaaatacatgccattatgaaaaaaatacagatgttaaaaacctctatattgtctcctgagtaccaaatgcagctggtatgggcttgagaaccacaattagcaagctctgggtctttctctccctctcctggggtgcattccccaacttccctacagattgatgtacccccactctggactctccttcagcttggcacatccttcattatggaacttacagcactggataagaacattctcttactgccccataagactcagctctttgcatgcactatgtcttggtcatatttttttttctttggctccagaaagacaaacatataaaaaatttattctacatatgtcatcagtatttgtcacatgtatgaatgagatcagtgatctttactctatttcagggccccaggaggctatgtcataaactgatctaacctccaatggagggtttctgactgggagatatggggtatggatgctaactgcagtacactcaagttattggaaatgttgagctgggcacccaagatggcttactcggttgcatgagggtttatttggcggctgaacgctcaaccaggatgttgaataatgggcctatggcctctccagagtaatggtctcagggcagctggacttcagaaatggtggatggctttccctagaatgtcccaagggggccaggcaaagtttcatggccttttatgacctagccttggaagtcatactgtgccccttctgtatctatctgtgatctgtccattaaagcagtcctaattgtacccaagaggaggagacagacacctcatctatcactaggaggactctttttaaaaagtgagccatgttttaaaactaccattgtctcatcttctcaaaatcagttatttctactatctttttaaattttagttgtaatagtttatcactattttgttggtttcccattttttaagcttccccaaagtaccacaaggggtaactcttttaatattttccttgacagatgcgtattaagtgtccactacatatcaccaggattttgcaagaattttgtcacactaaataaataattacagtgaaccgcaagttaccattaaatcattatcagtaatcactatctaaatcaagagtacatttccctactcccacatcataaattcttgagtctcctattattttcttctcttgaactcctgatgccattttttttctgaatttgtccagaatagggtcatgctttataatagcagcataagaagcaccattcatatttgactttgtgttgtaccatcaggatcgagggcttagaaatatatctgagtgaaatttcatgaaaacaggccattgaaaaaaaatgtgcattgtcaatctttgggaaacaatagaatagaaataaagatggcatattttttcagtttaatcaacctcgacagtcactattgtggctgccgaagcgggtttgattgccagttgttaaatgagcctgcatcccgaaaagtgagagtagatcactcagcagagcatcagacagatgatatttgctttaaagagagattaaaccagttccgcaaaggccagtgtcccactgcttccccaaggcagcaagtagaatctgccctttcctctgcattcttatttccaagacttttgcagaataaaacaagttccatcatcagtcccttgtccacaaatgtaaagacagtgataacacaaggaagatttgagagcaattgaggaagttgctgagaagtgtgccatgcctctcctgaactgggttgaccttgatgccatcaattgtttctggaaaattctctggtcaccagcccaagagaggttaaatgcccaaaaatgcctttattaactcactcagactctggaggtatatatgtctccatccacaggaaaaataagtgacgaagactctatttataggctctcagtagatgagacctactatctagtataattgaaaagaggacaaaggtaagtatccccccaaatagctctcttcctcctgcctggatccagtttttcacattagaattactgatggctgagagctgtggtgttcaaactttttttacagaactctatgttcaaacaatatcttaattggaaacccattataaaaagcagctacttgttctagcagaagatggaggaaccattcagaaccactcacctccaggcgatcaggagtgcctcagcaaccaaggactaggatttgtccaccaaaggactcgaagaagatgctctcattgttttgtcagttgagcaattcagtaatagctgcactttacaggatgtacattttctgccagaaactttgcctaatttttagttctcataaccaacatgtactctaggtattattaacaccattttataaggaagctgtagctcaagaaagattaataatttgcccaggttaagaggtatagcacggattcaaatctagatcagctggataattatttttgtggaatgttatcctatgcatgtaggatgtttagcagcttccctgacctctaccctctagatgccagtggcactgctacccccagttgcgatacctgaaaacatctccagacattgccagatgtcccctggggtaaaatcagccctggttgaaaatctctggcctagaccttgtccagagctgtagggattcattacctctcctaaataaagtaacttcagttcctttaggcaatttaattctgcaggcttacactgtccaatccagtagtctctagccacatgtaattatttaaatttaaatcaattaaaactacacaaaattaaaatattagtccatcagtcacacttaccacatatcaatctgttgtccgtagtccagaacctagaggctaccgtatgggacagagcagaatagaatatttccattatgacactaagtactataggagagcactgatgtaggcaaaactctgctaacacacaagtgaatatctggtatttggaagtgggagattcatcccttatgattccttagggggttagggaagaagacagtccctgaagaacttgctgtgctgactctgctgacaatcagcaagcctcccctccttggatattctccagtgtatgcaggaagagagcagcctacatgggctcagtgtctgcccatgaccttcatgaatgcagaaaaattgcagagacccttttgaagggaaactacagacctgttaatttcttcataaaggtcaaagataagcagatttgctacccacaggggaaggattcagggtaaggaatcctgggtctgactagaattggggaaaattagcaagtaagagagcttgaaaagtggttgaaaagaatataagaacacacatagaagacaatttcccaggtcaaatttgaaacgtgagggacaacaaccagatgcaggagcgtgagcaatcatgtagtcctcacaatttgttacagatatgtgcctttcatcttatcctacaaataatagggggtcactgaaaattcatgtttgtgtgttttattgcccctatggcacaaagacatttcattaacagtagagccctatgttataaccaaagaggaggccgctatgggtcacttgatgaaaataatggtttaaagacagttgtaaagaaaataggatcaccagatttaacaaattaaacaacaacaacaacaacaacagagtatccagttaaattttgaatgtcatataaacaacaaatgatttttagtataagtagattccatgcaatgtttggaatctacttatactaaaatatttgctgtttatctgaaaattaaatttaattgagagacatgtatattatttggcggccttaagagaaagtggaagacttgcagaggaaatgtacatcttcaggcagtgagaagggaggggcagtgatgatagaaaggaaagtgcatttaatttaatgaatataaagtctttaattgggataagggaagtctgaagacacaagagaaacgtgatttttgcttatttcctatcagagctgagaaaatgagagtcagcataattctcaggtacacttggttataaccaaagccaggaagttcagttcaatgaatgtattgagtgactcttgtatagcaaatatatgatgccatacactggagaactgaaattgtgaaggcaaaatcactgccccagagtaacttgctatcttgtgaaggaatcacacaatgcaaattgacattggggataaactggcgtataagtgaatctaaagctatgcacaataaatatgcaggagggaaccattagttctgctaggggtcagtagaactaatgggaagttctactgtgtaggtgaaggaaaggaagactgtgtaggtgaagtgatgctgaagctagactttcaggaatgcaggcaagagtgcacagcaagacttgtgaaggaacaggtgtgatcaggaacctggccagtggtcagtgatggtaggaatctggggtgcagacaggtgggcaggaagattgaaatatggttaaaagacaggctggggctggaaccaagtcattaggggctacagtctaggggcaaagaggaggcattcgagcagggaagtagcaagatctaatctgtaatttaaaatagtaacaatagaacattaaatggcagtatatttaaaatattttgaaattgtaggatgaaactttgtagttaaatatcttcttaatatctctttaaaatcatttcatttttggccagtttatgtgtcattcatgaggggagcaacagagaataacagttaagaccatgtgcattgggtcagttgatgctggaattgaatcttggctctgcgaccctgaagtcatcagtttaacatttgacatcaaccgtcatctgaaagacggcagaacaacagtccccataccccatagggatgtgtgagttttaaataatataacaaacacataaaatgcctgacacagtgctcaacaagtaaaaattatcatacattttgatagaaataatgaattcatttatttcacatttttacctggagctcatgcacctagctggctaatttaggacctccaacccccttgaacattgtgaactcagctgttcataggaacccaggaacctcttcacacatgttcacatccagttcactcatggccggtgctgcctttgccaggcaccaggttttgtggcaccatttcttctggcatcagaatgtctgctgctccactgggcatgggaggctccctggcttctgctgagggcacttctgtattcatggccccccaggactcctgaagctgtactattgtctttgctagtagttttgtttctagtgtgttccagagtttaatgaaattgctctttttgaattttttttccaattctgctctttatataacccagacatgtgtctgttaggagcttggcagaaaaagaaccaagctgtctccagaattgcccctcccctctaaagaccaacctgctgaggggttttggcttgcggcctataggactctcagtcacctgctaccaggagcgatgtctctcctgccgtgccctctccttcctcttcccaccaccccaacacactaagatagagtagggatcatggatccagtatgacttccctttataagctgatgctgcccattcgagttacctattgacaagccatttgtccctaaatagctacatcagagtattaccacacagggtgtatggtgatgtggggaggccgagtcacatttttaaaacctagttgcacacctctctaccaccctcctaaactatggagccacaacatattcattacagggtgaggctgcactaagtccaagtatgagcagggctgccctgtatttgtttcacttactgagtcagcgtgttccttcctttttcttagagactcaacagactcggggtctgtggcttccagctgaccggtaaatcacagacatatgtggctaatcattttccccttgcagtgtatttacaaagtcagcgtgccacatgtcccttgcattgtgctcccagctaccaggctatctgtgccatctgttgagatagcgggcccttgcttcacagtgctgggtgtatgagaagtcagtacagattggccagcaacctgagcaagagtaaacagacccctgcggggagaggccaacaggtttccaaatcatagtgaccctgatgagtacaagccatagacccaaaccctaactgaagagaacattgttatttgtttatttatttatttatttttgaggtggggtctcaccctgtcacccaggctgcagtgcagtggtacaatcacggctcactgcagcgtcaacttccagggatcaagcaatcctcctgcctcagcttcatcctctcacctcaggcctttagctgggattacaggcatgtaccaccaaagcaaactaatttttttattttttgtttttcgtagcgatggagtctcactatgttgcccaggctgttctagaactcttgggctcaagcgattctcctgcctcctcagcttccccaagtgctaagattacaggcgtgagccatgacacctagccgagacttctgtatagagaatgtgacccattagtagttttttatgagggcggtataatgttaccatgaaatactattcacaattgttctagaaacaaagggattttgtaaagagtgccaactagcaatgtttgggaatcttatgagaatatttaggatctcataggattgtcactggtaattattcctctagtcatgagaacgtctctattttgaggttaaatgtgttgtttcgcagttgttggatggaactcttacgtcattcacataatggtgcatccaattcttcttttctgaattctgttgtattgtgtatcatttcaaaggaaaaataatggttggaacatgtttcctatggtttctaaacacatgtagattcaagcaaataatagcaatatggacttaggtaaatcttactctgccagatagatcatactttaagtgtgaaagcatattgtttatcctttagaaaagtgaataataatttttgctgcaaagtggtataccagcacatttgtctataaatttacattcttggatattagcaaaattgcaagggaataacaggctggatcccaaaatcaatttgaaaaacagcaacaatgaaaaatcagggctagtttagataatgaagcagtgaagggagttgataggaagaaaaggaactctttttcccccccacagaggccattgctcatgccattttcttgccctgaagaattcctgaggaaaatgaaaagacaatggctgcatttcaagcgaagcccaggcctgggtgtgctgctcctcaagaataagatgtgcagaaaagtgccctttccatgggagcaatgccatgtctctgatgtcccccagcacaaagatgcaaaagtactctcgtcattttctttttggtttattgaaaatttcattttgttgcagtgcccgtttcccctaaacaaaactgtgttcaactaattctatttctaagacaagtgggtgttttaagtagttgatgtagcttcttgattttaaggacaacacggatacatcaagggtagagaaaggtattcaattagaatgtgacctttaacagcatagactcacaaagtgtttgacttgtttgggactttaaatatgatctgaaatactaacattttcaaaaaaagaaactatgttgagagagttgtggacatttatcccaaactcattaccttgtgtatgaaacaacagtaataaactagataatagatacagctacatacatttagccatgtgtccttctgtatatctcaagtaattaatgatgatgacagctttcttcattagaacacatggcttgcccagccacatgcacatatacaaaagtgtgtatgatacaggtattatgcatcttagatgtcatatagctactaattcaagccatattgcattcctatatcaaataaggcaacccacatttcactctgtgatttgttgctgctgatttatcaatttagtagatatgagttcatttgccagttgaaattgcagattgcaatgcatgcatttgaaaactttctataaaatgaaattggtatagtgtgttggtgaagctcttcttacttcaaatagagtaaaacttaagtgtatatttttaaacaattttcttaaaaccaggtacatttagtaactgaagtagtgtaactatgaattatcatccgtagaagtctttgttgacctaactcctcaggtggagaggatttgaaacagatagaagcagtttgcataaaagaaatgaacagtttgctctgaccatttgagacaaacgtcctttcataagaatccaaactcaaggaagcagcttcggaggtgtccttataagtacagatgggagagaggatctatatagcttttgggtgtgcacacctaatagagctgaactaaataatgtcgggtagattttgactttatatctttttcttttttgtcatcatttccattttttcctgcttcatttgttccttatgtctttggtgatgcatgagtagtattttaggattatgcctatcaaagattttttaaagttttaatttcagtattttctttactttgacatacattcaatttgttaccacagacttcagcggaagttaggacttgtctttatggcctatctttatactcggaagcaaattattcatcacgtacacttattctagcttttcctgtttgtgtaagtgtccatttgtccttagttccagccaacatttccaggggagtttcaaggtgacttcttccagttagatatgttcaaaaagtggccccaagatggttgtgtacatgcatgaaaatgccggtaaataatggcaacacaactttatagttgagcaatcctcagtagtttactaagtaaatatctctatcatatgagatctgttatcattcccgttttacaaatgaggaaaactgagacgtcaagtaattttgttacgtggtgtaattaggacttaaggccatttgtcctttctccagactaagtgacatggactatggactaatgacgcctttcgttatcattgttctgcctctttcaaactgtcaacagtgcaaaggtgtcacttccaaaccttgttaaaatgcagtttctgattctgtctcaggtctgggattatgcacttctagcaaactcctagcccttgatgcctgaaattccacacttacaacctccctgaatgctggtccactgaacacacattgaatcataaggcttttaacaatcttctgttcacacagtgaggtagcatagcacattctctggaatttcattacattttccagtctttattttttcagtgtggttaactgtcatttcttagcaaatttgtatgtagatatgaaagcatgcatcttcatacgtacgttttaaatcttaagaaatatttgaattgtaatcagtatcaataaacagaaatcattttgtttacaagtattcattttacagagtagcacaacagggataagtttagttaagtgaaccatacagtgggcaaacagtgctctgcaaagctttgccccccttgtggctgcaaactagaggcataaagaaaataaaaagtacctattcactctttacgttgtatgccactgctcagtttatgaaatcagatgggggtttgattgattctgagggcccgaccttgctggctatgtcctaagtggttgggcgttaagctttaagcctctagggagccatttacttaattgaaataaaaacaactccagcgggtttgtgttagcatttgctttagtcacaattctgagagaccctaaactaggaggtcaaaactatgtaggagtgattctgagagcagcttaagctcaaggaggttgttacagagtgaattgtacagagagtgaaaattccagaaacactgtgactccttaaccctgcagccatgccgcaatttgcctgttgtacactcatgcctttggcattatttcttggcctggaggaacaggatggcaaggttaattgcaaaggtggagtgttgggtgccaggcaggggtaggatgaatatgtggtttctggagcacagccaagtctactggtcccacctctccaccccttaggcataaggactagtgggcaggtttaattaatatcgcaaggagatgtgggaaccagagaacttgctgccctaggaagggagaaaagggactttgcaaaagtggaggacctgaggctctgacccttagtcttctgttgccagggttgaggtatactggtagcagaagagattacctgttatctggcaatagtggctttttactgaagtacctgaggtgaggtaggtggggtactgtaaatctctcctaaacatggctcacctgaaatatcttagtttttagtttcccatcttaatagggtgaagagagtggagggggtgagtgggaagaatggtgctatttttataatatctaaaattaaattaaactgtacttttataatttatgaccctgatttttggtacttttgacatttcttttgttgttatttttcgagacaaggtctcactctgtggtccaggctggagtgcagtgatgggatcctagttcgaactgcaacctcgaactctggactcaagggatccttctgccccacctctcaaatagctgcgactacaggcgcacaccaccatgctcagctcacttcttttcatttttttaagagatggggtctcactatgttgtccaggctggcctcgagctcctagccccaaaggatcatcccaactttgcctccctaagtactgggattacaggcacttttgacatgtctgttccatctctaacagcttaaattctgtctacatggtaatgactttgcttgtgttgggagcatgtacatttcaactcttcagtttctaatcccttgccctccccagcaatcatactagaagttgagagtagctagccagtgggccgaatcttgactgaaaccacatattattggacccacgaagttgattattattattattttagttgctaaaatttaaaaattgagcactttcatataataatccagatttccaatgactcttaaaaacttggagactcctctttctggggcctgccttgctgtgtagctgcccatagctgggactgcagagctgcactcgtctttaggctgagagtacactctccagtttgccagtcttaaccactcatcagcttggtcctctgctctcacctgcatttgagtttgtgacccctaatgcagaatagcttttgcaaaagcttgagatcatataagtgttctggcatgccttcagtgcagctgactaagctcaagagagctaagtgcgtcccaaactggccaaacccaggatacgtgcaaaaccatgtttctgacttctgacttcagccatctaagccagagagtacaggtgcagatttaagttatctggaagggtttagtacagagattgtgtttagctgtggatggctgaaaatctaaaataatagtcatttaaacaactgggcaatgcatgttcaactgtcatagaagtctggatgcatgggtcacagctgctatgagtccacaaccatcagaaatccacatttctgatgaggattgtacagcttcaagatggagcttctcttctgtgagttgagatgaatgcttcgtctctagccttctcttgctggcggaaagagaaaaagcatgagagaggcatgccttctccttctaaggaaaccctgtagacattgcatgcatccctttctgcctacatctcattggccagaacttagtcacatggtgattacacaatttccttcacaccaacctaatatttagctgcaaggaaggctagaaaagagtctttattctgggtgaccttgtttccaactaaagataagcaaggagacaatgaatattagggtgctactggcagtctttgcatggactgtgtcttgtggctgtaagatttcccagacgttgcccatagtgggcattaggtaaatatggtaggggtaaaggaaagatagggatcaagcctcagcgatccttacactcaactcctggttaccataccataaaccatatatactgtcctcattcctttacatacatctttcatttcattctttattcctgtacattttgctttgctttatcgcccaatgcaagtgtttcatctgtaattagccaagtgtttaaatgctatgcaaggtactatgaaagtatcaagagacaggggctccttcccacatggaaaggcaagtgtctcatcagaactcccacccaccatgaagtgcagtttcccaagctgatgtgcatggttgatcctggaacttcaccaactctggcaatatctctgttaatcttcatcataaactcagtctccacagtatattaggaatcagtgctctcagcctaatggtcttctcctggccaatgagcatagaaaaggttcctcttgtggttagttgtatgagaatttgaatttacatatcttcacttttggaacgggtgaagttaactcatttaaaaaattaattcattctttatatttttgtcaaagaatatgtgtaaggcctcattctgtttaaatattaatcaatttacaaaggtttacataaagctttttaaaagtaaatccatgggataagaagtatataagttgtttttttttttttttaaggaagactgagacataactctgtagattcaagattagacctccccctgccatacccaaatagatactctattcaaactattgggaatataactgattgtttcccaactgggacaagataatgaaatcacttgttgttcaataagaatagcatataatttgtccggaactaaccttctgaaatacaccattccgatggaacatgtatgcttttggttcttcaaataatatttttaggccctaaatgttaattaaaagagaaagtctcaaaccttcttgggagcaggtatctgagggtggtcttgggtctgcagagcatccagctctgatgatgacccttgccctttgcatctgggcccagtacttccatctctccttttctctctggctcccactcacaggcagtcctcggatgctgtattagggaacacaagaatttaagggggacaggaggcagcctacgttctgagcccagcctttcttttgtcccttgatcatttcagtctttttgcatatccccatgagcaggacaaaggaaaggaccaagacttcaaactggacttgaactcctgagaaagctacatctctaacaaaaacatttggatttcttttgtgtattttggagagggccatgatactttcatgcaacaagccacaaaatggaaacatacggtatgaggatcttgctatcctagcagatacgcagatacccctcttgcttttaaagaaataaaaggaaacaatacctttcatactaaaaatgagaacaaaaaaacaacctagctaggaaaaaaattaaaactccatagtagctcctagagagacatttattcacacatttatttttaaagaagaaaagaataagtatgtatagtgagtggcctccagaagcagctgtttaactttctccctgtttccctgcatctgcaagcataaccttgttgtattcaacatctgctctgcagtttctcttgagagctgtaataggatactgggtcttcttgtcattctgtaagatgagttattttgagggaagaatacttagggaattccatataaaatactggtcttgcaatacccatatagctttttatttttagtttacagagtttaaagatcatacgtagttttcattaatcccattttgcagagagaaaactgagggatagaaagttctgtcaactgatcacatggtagataaggacaggactcctcctttttgatcaagggccttttataaacgttctgctatattgttttgatatttccagttattttctgagagtttgccacaaacagtgacgtgagaaggagaaacttttaaaatgatttttgttctgaaggagtccataggcctgccaacccagcaaaatgtgttacttataggcgtaaaagcaatcctaccttttaactacacactaaggaccacccagctgcttggccagagaagtaggatcttgggaggtgtttgggtagatgttattttaagtgccatagaaccttagactattacagctggaagtgaagatcttccaactcaactctttcattgcgcaaatgcaaccgcaaccacagaggtacaatgaatcccccagaccccctgctaagcactacacaaagcccagtcatggggttcctcctgatgcttcctcaggcattttctcctgcattaaaaaaacactgataaatgtgccaaccaggaaatgcgtgtcagccaagttttctgattttcctgatttacatgatatctgcaaaggatttttagttatccactaagcagctccctaattgacataataccagtcttccttcttttcttctgctttttgctcttattctttaaaatgtatcaaattattgttaataacacattttaaaaatatctgctgagaatcacaatgacactgcatttgtgtagttataaggtagactcttggatttagggatacattcctgttagcccagcacatatacacccgagggctcatggtttttgacccacaccatatttcatggcatgtagttcagttgccccggctgggttctcctatcacaaattgcaagactctcatacagggcagactcagtgagcttacctgtcttacctggcatgacaggtgaaaagagatgcttacaacaccctgggcctagaacagtgtctgatacttgtagcccaatagagtacatatttgtgaatgaataaatgcacattgaaactctgcctttgcaaggaatttgagtcaacagcatcttagcctccttgactaagccactagtattttgcttccttcacaactgacagctttactggagtctcccggattcttcaagcatgtcaaggaatattttagtcgcttggatactagcacactgttaggatagtgggtccagatcactgattccataatgattctgagagattcaaagccatttctccccatcagcgtgtgagcctatcactaaataaacttcctggagtcaagacagtggcggcacccacacaccttgcttctcttcttgtaaccatggcaacacacttgctctcttgcccgccccactctgctctccatcaccacagagctgctggcttaataaagcctgacaaacttaaacaatggggatttctggccttaaggccaagatctttattaattcatagcagccgtaaccattgagctggccttgcttggcattcaggaacaaattccccaccatgattgattcctaccacctagtatcagctcagcccttccctttccaaaaatcaatcagtcaatcaattgattcatctattaggggaaaagattaaactatttaggtactgaataaaatttgctattttgtctctctagaccaggatttctcgatctcactgagtccaagaatgagcatgggagagtcatgccaaggatgcttggcttccagtcagagcacagtatatatttgcttctgtctggtagcctcttgcccttgacttcactgcatagtcccctcccataggttcactgaactgctatacctctgcagaaaccacccttgtaagacatctggatgagagctgagtcaaggcctggaggctgtctgcattaaactgggctctcaccatagatggctaaaggcggacacagctggagaggctcctgcaaattgtggctgaggtggcagcggttctggcggcaactttgccatctctaagcctcccagcccagaaccaaaagataatggcatgccttggagcagaagcagctgatctcattacccttctggtgcaaacagggcaaaaccattcaatatctcctatttcttaccatataaaccccaagaccccatgacctggctcctcgcgtgcctacctctccccagcatctcttatcactgtgtgattgtaatcttctccctctgctatgaagagttgtatattgttttctctctttttctctttttatgtgcctggaccttgttcttacagttctattgacctggaatgctctttcttctttccttccttttcatccttcaaaacacaccctaaatgtccaacaagaagacagtggatacatgaattactgtggtttgccatccatttctccctgtcagggccaaggcactcacccaccagctgtcaggagtgttgaccactgactgttcacagctgaggccctctgctcttagagccttgggttgaaggaagctgctttgcccagggttatatgaacccacatccagtggccagttcgtgcaagggtacagaggcttgcacagctccaaagggccaccccagctgagaactaccccctggaatggcctgaagcctccatttcaactgcaccacatcctaagctctccctctgcccaaccctgcctgtcttgcttccttacaggcagcaatcaaagcgtcctccccagcatgtaaacctctatttcagagtatgtttcccaggtaacctaaagacaaggcaaatctaggaaaaaataatatgtaatcattaaaatttttaatttatgtgttaagaatatttcatgacatagaaaaatgctcaagttaatgaagtaaatacaaaaacaagaggcaaaactgtgcatgcgttatgttcctgattatataagaatataatgacaaaaagaatgagacaaaaaaggaaaaaactgtatcttttcaggaagaactactcctaaaatagaacacagattgtgtatctctttagaattttgtttccgttttctgtttgttttaaacattctacaatgagcaactaacattataagatttaattaagtcatttaaaagtaaaagggcataatattactaaacgaacccccacaacacaaaatacataaacaaaagtctaactaactcaccatcaggggacaaatgaaaaacttcagcttccatggtcattctctgtgctatgttccaatcatatctgcccctgtccaagtccataaagttgaatacttccttttttgttcaaatatatatatatgcatctatcattacattttaccaaatggtactgcaaatatttaaatttgtcgcttataatacactgagagttctatgaggatagaaaatcatgttttccatgccttggatgtggcctccactctgtaaacactcaatgtattttatagatgagtgaatgagggaatgcatgaataaatgaatgaatcaataaagtaacatttagaggctaaaagcataaagaatttgatgggcatgggggcaaactactgaaagtaaagcaaaaaaatgtagaaagaagccttgaaatcccaattaacatttcctgattgcttcagaatagaatgctgtaaaatgagaggctttcagcctgtctgcatttcagttctgtgcagcttacaaaggaacctgggaaaaagctgacattgccactgtagctttgaggctttcaagataagcatcagtttgggttcagaagaaatgaacagtgatgaatattgtcttcagcttcacaatggtccttttaattcctgtcattctcaaaaagaaaaaaatgccagtgtttcttctggaatattttcaaatttctccaattttaattttggaaaattgcatttgaaactttcttgaagtagtcttattctctgccctttccatcctcatctataattactaataagtagtctctttcttttattaaggtaaaattcatttgtgatataattcaccactttagccattttaaaatgtacaacttagtgttgcctttttgccctgtgtttggcttcttgaagtgacaatttagccagtctttttgcaaaggcattaacaggttctattgagctgacattgcaataatgctcctgggtaatacatttacattttaataagagcattgataccttaactcaaagaactaacttaattcttttattctctctatcattttgaggatatgggatcaaatttgttagcaatatacataagaatctttgtagactggcccttgctttcaccatttcctcttctatgaagcactgcactgtgatctttttttttttttttttttttgagatggagtctcactctgtcgcccaggctggagtgcagtggcactatctcagctcactgcaagctccacctgccatgttcacgccattctcctgccttagcctcccgagtagctgggactacaggcgcccgccaccacacctggctaattttttgtatttttagcagagatggggtttcaccgtgttagctaggatggtctcgatctcctgacctcgtgatccacctgcctcggcctcccaaagtgctgggattacaggcgtgagccaccgcgcccggccaaagcactgtggcccggccaaagcactgtgatcttaaggtatgctcaaatacttaaacttcttcaagtaagctgcattctctcttgcctttgtatttttttctttttctgattggaagatgcctacacatccttccttaaaacaaagtccaggcattatgcctgtgaaatcttctcctcttctcccttttgctcccctcctgccctttcctcccttccccttttcttcctcctttctctctctctttctctcattctctaggcaacttcacatgccaccagttcaatgttttccatattgccttgtagttatcaatcccattgttttctaataagattgtaaatgctttgagcataaggactgttttcctatcttcactgttcaatggtcttgaaatgcaatagattctcaaaaacatttatgaaatgtaaaaaataaaagaaaaaaagaagaagaagaatctcacaatgtttagaaatccctggcagactggtaaaggagaatttgttttttgtatcgtagtacctgtttaagcacccttcacgtaactgtctacagttaggactatacctgattaacagtatttgcctggaaggcatcagaggagtagaaagctggaatgcatacacccttgaaacttttctgatactccttagagaacatgcaaactattaattagatacatatcatgacaatgtgtatcttacagcattgataaacctgaacattcattccagcctgttttattcttgtttctcttgagcttcaacactgaatttatatttgtaacacctgctgtttccatcccaggataatagactatttagcattttatcatttccaaagtataagaattcacactctacccacccctagttatttgatatggatcttttctgatggccccctggggatcattctgtggtctaggctacactaccaaggctgcaggctgtcacaccagtatataaactgaaaataaaataaagagaaagatgttcagattattgaaaacaaaaagcaataatgaaaagtatgggactagatgagggaaaaagaggagagggagagggagaagaaaacaaaacaaaacaaaattatagttgtcttagtactcaaatctttgttgcccagtcttccatgcagccttcctcattctaagctgacatgctcactgaagccttcagtagaatgtgagggctgggttatccaatattcatgtgcagaatagtcatgtggtaacttgttcaaaatgatggattcctagccatgatgctgatttctgacttaatttctctgaggagtatctcgggaatttacctctttgacaaggccccagatgattctgttagaggtggtctgatcagtgaaccacactttgagaaacactacaggaccatcttttagcctgactgcattaattagtactttatgctcaaacaacaggcatatattagctcatgttttattgtgggttggcaattggaactgcattcagctgaatggtcctttcactggtattgcctgagcttgctcttgaagctccaagtagctggtggctcagctggggctggatggttaaagttggcctagtcgcatgactggtaggtacccagctgttggtcaatggcacgtcatttctcctccatgtggtttccacaccagggtagcctggacttctttataggatggtctcaatatttccaacaggaagaaaaggcatgccccaatgtgcaggcactttccaagcctctgtttgtattatgttttctaatgtccaattgaccaaacaagtcatgtggctaagtatagaattgaggagaagagaaatgaactgtacctcttaatggaaagcatggtaaagtcacattgagaggaatagcaggattacagggccatctttgccaacaatcttccacatctattagatcagtaaactattgtgtctgataatggttgaagaaccagattttatgaagaatttatactttaatatataaattagtgcaaatgcaagtttatcctccaagtaaaaacccttttgctgacttgtaaatttcactcaaaaagaattttttttgagtaagaggtcagtggacttatggccagtatgatgggaattgtgcatagtattgaatagacccatggaaaactatagccctgttaatgttatctgccttgaattacttgtcagaaaaaaaaattaagtactgtggctctggggacctggggggagattaagtaagggggacagatgaggatcttctggttcactgcttttggcagaagtcgatatacctagtggtaaaggccattgtatctgcctgtttaggttccattcttggacttctccattctattttttttttttttgagatggagtcttgctctgtcaccaggctggagtgcagtggcatgatctcggctcactacaatctctgcctcacgggttcattctcctgcctcagcctccctagtagctgggattacaggtgcgtgccacaacacctagctaatttctgtattttcagtagagacagggtttcaccatgttggccaggatggtcttgatctcctgaccttgtgatctgcccgcctcggcctcccaaagtgctgggattacaagcatgagccaccgcacctggccccacttttccattctttaactgtttgccttcgttccataaattacctcatttctccataccttacagtgttgttgtagatttaaataaaattatgcacattgtaaaagctcacaaagcatcagctatcatcatcttcattatcatcattctagaaaaaagtattgctagcataccatagctctctttacccaccttaggagtggatagctacctaaagaatgtacactcagagaagtccttgctttcctctttccaattcctgaaataacttaaagattgaccaacactttttatttcatgagaataggagagaatgactttacccaaacttgttcctgttatctacaggaacttggtgactagtactcccactacagtttaagggaaaagctactgtggtagccagtgttcaggatgggtaccaatgatccctgccttatggcatccagacttttgtttaaaattaccctcacattgagtagagttgacttgtgtaactcaaaaagatattacagaaatgaagtgtacagaagcattttagtgtgatgtaacctcatttgtctggttttgcttttgttgtctgtacttttggcacagcaaacgaaacaagcaacagattgaagagacaacctatgaaatgcgaggaaatattttcaaaccttaacctcttacatttgacaagaggttaatacctaaaatataaaagaaattcaaacaatagcaaaaaaaaaaatcaatagcacaaaaacaaataacccaattacaaagtaggcaaaggacttgaatagacatttctgaaaagaaaacacacaaatggccaacaggtttatgaaaaaatgttcaacatctttaatcatcagggaaatgcaaataaaaatcataatgagctatcacctcacactttttagaatggctgttaataaaaaatgaaaaataagtgttgatgaggatttggagaaaagggaaccctttaacactgttggtgggaatgaaattagtgcagccattatgcaaagtagtatggagatatgtcaaaaaattaaaaatcaaactaccatatgatccaacaatgccactactagctgtatatccaaagtaaatgaaatcagtatgttgaaaagatatatgcacttccatgttcattgcagcgttattcacaatagccaaaatattgaatcaacctcagtgttcatcagtgaatggatggataaagaaaacgtggtgtatatatacacaatagaacctattcagcctttaaaaacaaggaaattctttcatttgcaaaaatatagatgaatctggagaacagtatgttaagtgaaataagccaggcatagaaagaaaatattgcacgatctcacttatatgtgaaatctaaaaaaatagaactcatagaagcagagaatagaatgatgatgaccagggactagggcagtggggattgggaaagtattggtcaaaggatgcaaaatttcagttatataggaggaataagttcaagagatctagcatacaacatggtgactatagttaatgtattcttgaaaattgctaagaaagtagattttaagtgttcgcatcacaaaaaaatgaaaagtatgtgatataatgcatatgtaaattagcttaatttagccattccacaatgtatacatatttcaaaacatcatgttttatatatatttcaaaacatcatgttttatatatatatatttcaaaacatcatgttttgaatataaacatgttttatatataaacatatataattttatttgtcaactgaaaataataacaccaaaaatcatatctggaaattattctggtgtgatttgttttatctttcttaaagtacgtatacagaatttcaaatgtggattgccgtaatgttgtttaaggaaaattatttttatctgcttatttccaacacaattcctgatggatttcttcctcactgctatctttaactacacaaataaatgtcaagatattcaaaattttacacaaaatgtatagaaaaggagaataaaagaagggaagtgtgactttggaggctaggtcataaaagacatcgcggctttctccctactcttctggatccctcactctggggacagccagatgccatgtttgaaggctactcaagcaaagctgtgcagacttccatgtgtctagatcctaaggcctcttgtcaacagcaagtacaaaccagccaaccatgtgagtgagccgtcttggaagtggatgctccagctccagtcaagcctcgaggtgacttcaactgtcaccgacatcttgaccgcaacctgatgagggaccccaggccacaactagtcagctgctccctgacttctgatccacagaaactatgagagatagtaaacatttgttgtttcttcaagcctctaaatcgcagggtaatttgacatgcagtgataaataacgaatatgcttgttttgatatggggaagaggagaaagcatagatgcgctggcagatggaaggagagaggcaggaaaaggacccagcaggcagaggctgaggatgccaaagagcaacctcacaacctcacactgttgcttataagcacagtactggaggccagtgtttttggaagaggaccagcagaatggagtgcactaagtgctttgaagtacctagagagcctgcagggagtggcactaggtaacagggaggtcatgcttctcctgtttatcatcttggccattaactagagcaaagctctttgtgggaaacatgcaaattgctgaaaatggagttgaatttccttcatctctctttaactggaaatataattgcaactccttgcacattgcatgaatttttttaaatcctgtcacgctttgttggctcactgcttttcatcttaatgtttattaaaacagcccaagttccctttgatgctgaaagcccaagtatgtgattggagaccattgccaaattacaatgtattttttacttgatactgagttttttgactgttcatttttaacttttctcttaataacttgagagttggagagtgagggtaggaaaaaggaaaaaagtcagaaacagtgactggccagtttgaaaccctttcctggactcaggaacctgatagttatttccaaaacaccaccacagacatctcacatgttttcgtatgagactctgttcttatacccctgactagtggcagatggaatgagccatgatgcgtggtccatggatggatgaaaagatatgttacattttcctaatggaatgatcaaggacctaacacaggcactgcattagtcaggattctccagagaaacaaccaataggatatgaatagatatagaagaggagatttattatgactaactattatataggaggccaaaatgtcccctgataggcttaagaactaggaacacaggggaagcctaaggctgggggcaactgaaaagcattagctccaatgtccaagggcagagaagatagatgtcccagcttgagaagagagagagaattcaccctttttccacctttatgttctgtatggaccctcagcatattggaagctgccctaatgcttgtgcacactggtaaaggtagttcttctttactcagactaccgattcaaatgctaatctattccggaacaccgtcacagagacaagtaggaataacattttgccagctacctaggcatcccttaactcagttaagttgccatataaaattaaccatcacaaatctaccgcttgtcagcatggtactcacaaacacttctttttaaatcatactttatctctaaataaaaataatagaaatttataattccatctaacatgatacaaccatccgccatacgattgaaaatgtactaattccttccccaaaaaagaaggtgaaatctttgtctgatcttttctcttgatacaccataacttcaatattatgatgtgaaattaacaatgcttaaatatttatataaagtcaaaacatattatgtgataagggaataagagaggaaataaattgaagagatttgcttaatatatgtacgtgtgtgtgtgtgtgtataaattcataactaataagaaagaaatactcatgtcagtgacagtcctcctttctgtaaatggccatggctggtatttatagctaccttcttctactatgcattctgttccctttgccttcagcaagcaccttaacctgtcatgcatttttatgtggtaggttgacccaaatctttatgcctgaagggtctgggctattcgtacttctgtctggaatgtgttgtagtcttcaattcactttaatcacagggcatggtaatactaaactaagagatcttctatattccagacatattctttcttaccctgactgtggatgagtgctacaatttgccctggttagtctggatcaatcagcccagccaacactgtaactcccttctcagtctattcactcataggcacatttaaccctttagagtagtgggtgagatgattctaatttgatctaactaactttgcaataaagcagagatgggtgctccagttttcctgaaaaggtagttttgcatttgagtctaatttacaataagcgggatgatgcccaggaagaaatactacctggatggtttccaaaaatgttctatatgaggggattgtgagtgagaagtgtattagtttcctgtggctgctgtaacacattatcacaaacttggttgcataaagcaacagaaatttgttttttcacagttttagcatccagaagttcaaattgggcctcacacctgtaatcccagcactttgggagctgaggcgggaggatgtcttgagcccaggagtttaacaccagcctgagaaacacagtgagactttgtctctacaaaaaaataaaaaataaaacaaaattagctgggtgtggtggtgtgtacttgtagtccaaactacttgggaggctcaggagggaggatcgcttgagcctgggaggtcgaggctgcagtgagccatgatcacaccactgcactgcagcctcggcaaacagagtgagaccctgtctcaaaaaaaaaaaaaagtctgaaatcagttccattgggccaaaatcaaggtgtgagcagactcatactccccctgaaggctctaggggggaatctcatctcctttcttcttccagctgctggtggctacctacattccttggccatataactccagtctctgcccatggtcacattgccttcgctgtggtctctttgtgtcaactgtttctctgctctcctcttataaagatacatgtgtttatatttagggccctaccaaataatgcagaataatcttcctatctcaagatccttaacttacttgtgtctgcacagactctttttaaaaatcaggtaacacttacaggctccagggattaagaactgatagatttgagggccattattcagcctattacaaaaagtttcacatcacttcattccaaagcctaagccttgctctactgcacttcaatattttcctcattggtgctgtattctagttgttattatatcatagaaagaaaaaaagtttttgaaaaattagaggacaaactcattaaatggaagaattgtaacaagaaagaaaggagagatagtaacaaagttttgctgaaatatacctcctccctattccgtgccgtcaattgtagcatcccgctctgttgaatgtcttcctttgaaagcttctctaagtttttactttgaaatgtagatttggttacccattcagaaattgccatctcacatgtttaatcaagaccttgtctgtcattgttgcccactacaaagttttatttaaccctggagtgaatttactgttctactcctgctgtgggccccgtgaggtggtgtgtggacctgagatgaaaaccacttgatgtgtggttggagggtaatagacttctctcacccagactgataagtcattacaggcccttacatccaataaatctgagctgattcccagcttgcacttagtgtggcggaggggagagaggactgagggaggacagagtcttttctaaaatgctgttcaacgttgtacagagtacttggtaacagatgagctcatcggcaggggttggagaatggttgttgaagtggtggcacatttggtggcaaaggtggtaccacatgtaatgtctgctgcagacataacagaggaattctcggatttggggaaaacttgcaaatgaaaatagtaaagtttatctcctgcagagttattggaagagaacaagagggaggcactaagactcagattaagaggagaaaatgttccaaatgctttggcaaggggatcttacatattggcagattttgacccttttcagagtcatgcaatgcttcttaagctggagtctatagatagacactgagagctccacaaattctcaattagagaaacactggctttaaaaatagtgtcaactcttagcctgatatctcaatgtctcccaaatctagctccatctgcccctcttagtctacttttctcgcctccagttttccaatttgggctactcagcattccacaagacatctcatatttggtactttgcacagatcatattcctgctttaaaatgtcacctaccttttctcctcttttccctcccccacccccagtatgtccgctgccaaaagttccaagccctgctctggttctgccagtttcttggtgctcaactctctctcctgatttctgtagcacttaagcttggaaaagggccttctggggtaccccactgctccgtatcacttttattttctatttgtttaatgtttaagattttgtctctgtttctcctgtcacatatttctcaaaaactgcatgcttactgtaaatacatagagtaacttcatttccatttttggaagttgaaaagccctgccactaagacagggctctggggagcttgccctccacccatccactattccaataccattcaaggtgcagtgctggtcctgtcccacctattccaactaaaaccacatgtcatcagtgaattattgtgggcaatgcaaaaagggaaggtggagcagagcagcgatggtgaagagagagaatctgtaagaaaatagggagggtcaagggccactgagaaacctgtgatggtaggtaacagagaaagacttccaagcaggaaaacgaggggaaaacgagggatgttccatttgatattattgtttacattgttgcaagtagaacatcccccaactcagagtcaaaccttctgttaagtcagtatcacacatgtgatgtatgagtctattttcgtgcagaaattaaaggaaaaaactggttttcatatttgaatcaatcaaagtgaagcaattatcgtgagtagaagccagaagctttctacaaaagtaaagatgaaatagtaagcactgaaaatatttggagaaatgtgggtttgtggcataaggttgcagccagtcttctctacatctcatggggaaaggagatgccgggtggcattttaaggagttcaaaggatttggggactaatcaaagaaaaaaatatgaccacaaggtggcagtggtacacacaggctgtgttaggcactttgacaggtttgcaggcagagaggttccttgctgtggaagtctgtcctgagggtaagcgcagaggtcccagttcagaaaggaaaaagggcagagatcatcagagattgtgtatctaggtgatgtcactgggcagcacagcaggggatctctgtgtctgagtgctcagaagggtagcagcagcttgagatctttacacccagagcttatgttatctgtggctacaggtgttgggcacagatttgtgaagtgtgcaaagcaagcaaactccaattcactgaaaatctgcttatttgggcaatatttaagataattagatgtgtaaaaatttgagattgatgccagcaggcttttgggctaatgggtctcagcctatggtgaagaaacacagaacccaagtgccagtgtgcaggcgctctctggtttgttcataaaacaaacctctctctctctctgtcacacacacacacacacacacacacacacacacacacacacttataggattggggtcatatcacatatgttgttttataacatttgcaataatatcttaatcatttttcaatgtcattacagattcttctgaaacattcttttttaatggctgcatattgttccatcatgagcttctctcatgattaactaatcctctatttctgatattttctaacagatagtccagtatttctaatattgacctacgggtatgtagtgatggagtctggggctttttgcttccaaacctgttttggattcttggctttactaagcaactgtttagctggggaatcaccaaatgatttttgaaaataatgttaggaaaaagacatttcattcaaattctaaaatatttaattatggcttgatttatttagtatttatttatttagcaacatgatgtatggcctaagcttatagattggttttagtcaaaaaacaactgtgctcatcaaataagcccattatgcaaagcacactccatcatattgggtccctgaagaatcctagttttgaggtaaagaacagacccccatctggctacatgttacccatctgcaacaaatcaccgtgacacaaaacatttaaagaggcagtagttgtattaggaatggcatttccccattttgaaagatgtaagtaaaaacactgtttaacatctgaagttcatttgcaagaagagtagatgagctagagaaggtggcagaatgacagtgtgactcccactttcttcattgtgtgtctgtatgcgtgtgtggggtgaaatagagggcttatacatggcaagatatgctgcaggaacaacacctgatcaaacaacctgagtcctgtactctcaatgcagttgcagtggtgattctcagagctcttccccctcagtgaccatttgtgtattagacgctgcttaaacctaaggggaaataaggagcaagagaacaagatgaggttcaaatggtctatgccagacaacttacaaaacacatttctctacataattcagtggaatcaccccaaataatactgcaaattgtatgtctccaatgttcagattagattaggttactaagccttacaaatatcttagtgactttctcaagatcctggctgaaccctatttgaacttagatctgaaacttcaaaatctgtgctacttctaaaagattatacagacaatttgtcaattagggaagtccgttaaaactactgtgtacatgaacatttgaccttgattcgtttctattaggtctgtccatatcccttcccttactgttttttttctttttgttgttgttcttgtttctcctttggtgtttgcacttctatccctgtgtgatgggaagccccttcattctgccttttgtctgtcctgggaaggtcatcagataggtattggaacttgaaatatttcagctttttcttctatcatccatatcaagatacctgtatcccatattcctaagccatccatcctgtaccatctaagatgttagggcaaagtggcttttgatatacactctatctcagcacagaacacagtggtcaagaggagttagctgtacctgaattctactctgggctctccaacttactagccatttcactcttggcagttcaattctctcttagtgtctcattttcctccattgcaaaataaggtgataatagcgtctacctcctagggctgtgtaagggttaaatgatgcactgtgtataacttgcttaggaaaatgcatagcacatagtcatcaaaaaataactgttataaaaataatatttatacatgtataaatattataaaataatatttatacatgtataaatataaatatttatacatgtataaatataaatatttatacatgtataaatattataaaaataatatttatacatgtataaatattataaaaataatatttatacttgtataaatattataaaaataatatttatacttgtataaatattataaaaataatatttatacttgtataaatattataaaataatatttatacatgtataaatattataaaaataatatttataaattaattatttttattatatgctgaaaccacctgtgtcttaggccatcactctaatagacttcattgactatgaaatgcttactcatcactagttacaagcatgtgtaccgaatggctggagacaatgaggaaaggagtgctaggtagtttaaggactttaccttctgccagctaaggacctactttggaaccataagaaataaatacaactttttttgctgttttcttactgtatctggctccctgataagaacttatcaagccctcttttcaaaaagcctcaatgccacaaagtcctccccaccttctcaaaaaggaaatctacaagtattcattgaaggcctcttcggtgtttagccttgtgccgggtctagggaatggaggtgggcttctaagatggcataggttttgggtttctcaacttacctacagactttttgcatcattttttccttttttttttttcttttttagataggatctcactctgttgctaaggctggagtacagtggtgcaatcacggttcactgtagtcttgattgcctgggctcaagtgatcctccctgctcagcctccctagtagctgggaccacagatatgtgccaccatgcctggctagtttttctttctttattttgtaaaacagagatctcactatgttgcccaggctggtctcgcattcctgggctcaagcgatcctcctgccttggcgtcccaaatttctgggattacaggcatgagccactgcacttggctttttttttttccttaatcatgctctttgtggagttgtcccttgcatatcactttgcccctctcactcattacttctgacttgggtcctgttcatactgcatcttgctaaataattttataagccttataaccaagtagacattctctccctaatgcaaatatatagcccctctatgttctagaactcacaacaagaaaacagagttgctaaaagataaataggagatgctttaaaaagttagagacccaccaggagattgagaccattctggctaacacagtgaaaccccgtctctactaaaaaatacaaaaaaaaaaattagcgtggtggtgggcacctgtagtcccagctacttgggaggctgaggtaggagaatggtgtgaacccaggaggtgaagcttgcagtgagccaagatcacgccactgtactccagtctgagcgacagagtgagactctgtctcaaaacaaacaaacaaacaaaagttagagactcactaacatgactaaagttaaaaagcttgataatgccaagtactggagaggatatggaacaactgtaactctcatatatttttggcagaaatataaagtgatacaaccttcttggaaaacagtttggcaatttctttgttaaacatacatttaccgtagtacccaacaataacacttttaagaaagtaaataacactttaagaaagtaaaataaaaactatatatttagaatgaattatacattaattgttgtggcacctttattcataatagctccaaactggaaacaacccatgtaacttcaacaagtatgaatggataaataaattatagtgtattcacaagatgaagtattagtcaacaatttttagaaaaacaacaacaactagcggttaggcgtggtgtcccacacctttaatcccagcactttgggaggccaaggcaggaagactgcttgagcccaggagtttgagaccagcatgggcaacaaagtgagaccctgtctctattaaaaaaaaaaaaaaacataaacaaaacaaagcaaaacaaaacctacggatacacataattaaacagatgaagctcaacattttgctaagctaaacaagccagtctcaaaagaatatatactgtattattttacttatataattttttaaaaatatccagactagtctgtagtgacagaaggtagattagtactcactggcagctggaagcgagaggagcactcgtgagagagggcacagggagcttcttggaaagatggatgtgttctatatcctggttgcaggtgtggttataaaggcatgtagacttttcaaaacttaactgaatgggtacataaaataagtacattatataacttgctaaacatagtaaatttttatgtagtatatatgaaatatattaaaacaagactagcaattcagaaaataaaaggtagggaaagattccacttgtcctacagtaaagatatccagaaacatgtgaatctatccggtgtttatttgacgcatttagttttgctcttagtcattttttcaaccatttattaaactgactagatgctaagtccagtgttaggtgcataacatacagagatcaaaggtgactttgtaaccacagaacgtttgcagttttggcaagctgacgagcttgaaaatggttgcagaaccattttctgttgaaaacgcagaacttcaacaggaagtgcaggggaccatgggtgtgcgggagaggggcatttaactgggaggaccagtgaaggttcctggaggaggtgaagtttgatttgagtactagatagagaaggggatgtggatgctccaggaagaggaaatagctcctgcaaagccatggtgggtgtggtgaccagcgaggagcagaaaagtggacatgggtcatgtgattaagcatttcaagaggatggtatgtatccattcagctttagaacagccccgcgggcatctgtatggtgtatgggttgcagatgtcgctatgatcagaggctgggtagcaaaccactaacgtaatctagtagtggtggtaagaatgaaaaaataggacatttgaggcctggcctcttctggctctttgtgaaatctaacaaacatcttccagctccatctggtgctgcttttttgttttgttttgttttgctttgctttgtgtgtatttgtttgtttcattttgccaggggcatttggtgctcagcccttaccccctatgttttgtgaagcatatcttattctccaggcatgtcttattctccctcccttttatcttgtcctgaacacaggctagggggatgacatggtttccttttaggttttagaagaaacaggagtcttatttgattcctcctttgaaagaactgctgccatgggtgatttcctcattgatgcaaagaaactatgctttgccctacctttgagagcatttacaatagaaagtctacttactcttccagtgaactgatatatacttagtctctgccctgtgtctgggacgctgtgagatgctggtgaatttgctagctggcgtgatggattgtccccttacttctctgctttcactccccaacagatgattattgttctcctgtgcaaaggactgtgaggacactttgaaataaaaaggtagtttctgccctcacctgacatataatattaaagggaagacaatatggctgcctgataaagcaaaatgggaaaagcaatataaaagaggtagaaggaggtaggtggagtgttacaagtgaagaagaaagctcacccaggcagtagtgaccacattggcctggctgcccctgcagagaaaagatttcataaataccatgggagctcctactaagcactgtaatttctgttatgtgctgggaataccaagaagaaagagagatagccctgcctctaggagctccaggacacagattagtcttatcaaatgagtccggctgggcgcagtggctcacgcccgcagtcccagtactttggaggctgaggcgggcagatcacaaggtcaggaaatggagcccatcctggctaacacggtgaaaccccgtgtctactaaaaatacaaaaaaattagccgggcgtggtggcgggcgcctgtagtcacagctactcgggaggctgaggcaggagaatggcgtgaacccgggaggcggagcttgcagtgagccgggattgcgccactgcactccagcctggcgacagagggagactccgtctcaaaaataaaataaaataaataaaataaaataaaataaaataaaataaaataaaataaaataaaataaaataataaaataaaataaataaaataaaataaaatagaggccagcctctttaatttcagttattattgctttattgcctaaagtttaagatgatccatctgcgttgtagaatcaggatttgattaaaataatgatttgagccttgcacgtcaatgggcctttagaagttcactgctccaggttggtctgaaggttcaagtgtggcggagactggttcccccagtgtcctccaggctgcctctttgaagtgtgggggcatggcagcattgtaaagtgtggctggtacaaaccaaataaaccttaagtttaatttggagtgggaagaacagaatcattaaaacaatcttgaaaaaggaagacaaagttggatacttaccctacctgactttaagacttacagtgaagctgccatactcaagacactgtggtactggcgaaaggagacacaaatggatcaatggaaaaaaatggaaagccaagaaatagacccacacatacatggtcaaatgatttcgacaaggacacctcgacaattcgatagggaaacagccttgacctgtactttactaaatgtacaaaaatcaattcacggtagattgtagagctaagtgtaacagccagagctacaaagctagtaaaagaaacatgggagaatagctttgtgacattgggataggcaaagatttcttagggataatccagaaagtatgatccataaagtgtggttgagacttccctgtttagagagaactgtgttgcgagcctgtgtacacatattttatttggagacctgattcattgattcatcctggatctttcctatttgtagcacatcaaattcatatgcacagtccccagtgacctttgttttaaaagcttttaaaagcaagaactaaatttcaacactgaagacaagtcagacacaaacctccatgtattttaaagtctagtctctagtatatatcaagctgtattataattaaaatctccaaaatcaggacacagcagtctagttgtgaaataaactgtcagaaagaaaccactcacaggcgcacacattctcccacttaaaaaaaaaaaaaaaaaaaaaaaagaaatgcttgccgtgttgcagatacatgggacatactttatacgtgtggaaccagttatagaaatgccgtttgaggagggaagcaaggaagcaataaaaacagtacattaatattttaaatgttggttaaaaaaaaaaaaagcgtggtcgggtgaggagcaaatgcttaaagaacttccccttaataaaaacaacattcttggttatgtgacccacagcaaatcggcttcagctgcgtttttatttagcaatttgtgtttggtgttttcgcttagagatgctcccctattccattttatagcaggctttacataaatttcgaggaggattggggtataaaactgtcaattcccagcagctcataaactaatgaatttaaattttaaatgggggattttaaaacatgggggggctgttttcgttatctgatggtatgtatctccaacaataagtggcaatctataaacgctggggtggctcccttcagaaacatgtgataagaaaagtctctgtctctctctccctccctccctccctccctccctttctgtctctcactttgttcttttcctgtaaaatctcaaactccaatgaacttcagctttgcaaaagacatgatataagttgctttaaaaaattgatttggcctggagaaactttattttccctcataaagctctttcttgcttacctttattgtttaatttcactttctttttttctctattttccatccaagttactactccgctaagacaatctctctctctctctctcttgctctctttctctatttctgtgtgtgtctgtgtttctctctctctctatctcctctctcatctttgaaaaccaacaacatagccaagtatcctgtatagaagcacttttattagctgaggaaataattaataccaaatccatatttgaagattgattattctagattttgggacactaaaggattgcagctagatgcaggagacaaagtatatgaaatttctatttagccttaagtctggttttctttgagtgctgggtgattatattaatattgtggtgttggaggacctaagtgtaggaattaaagggtgtctctccagagggttccaatatctggttgctctgaacgtttggtgaaatttccatttcaaaccaaatggaaatgctttttgagtcatattttgtcatctgatgctattttttctagttcaataactttagagaattaatgggatttctttttgtttcaaatagttcactatttttggtggtttcgtttattttggtttcttgttttccattcttttaaaaagtattctaaacagactgaggagggtcagtattggcttctctgatttggtatccccagtacctagcagaatgggagcataacttatggtatgtacctcataatgttttgttgaatgaacaaatacatgaaacagtacatttcaccaaggaatttacaatctaagaagaaaattcaaaagttttgccaaaaagattttttggcatctatttgcctgaagtccagtgctttttacttacaggttcttgggtaaactccaggcaggtgcatttggtcggtgggtgacttctggataaatgagatggtaatctatttggattaagtttgggagagttttaaaattcaaaataagtggatgtattttattaaaaactatttctatctccaaacaggaagaaaaaattgagcattaaagttatctttattagatgaccagaatatgatgtctctgtgagggtcaagttgttttctttacttctttatatgctatagctttaaatcacttttaagcaatggagtttccactgtgtcacctgggagacaattgggtgttgtaaccagtatcttaattagatcatttacagcacatttgcattacagggctgtaatagactgtgccctgtgatttcttgcactcaaaaggtaacctcccatgctccatattgaattgtattacaattattattaggttgtccctatcttataaaaaagcaggggtatagcttcttgtttcaggaggtgttttgatttttccatcactgaaaaaatataaggttttcagttacctccctccttctgttctcatgtgggaaatacccctggaacctggacattcaagacatggtttgccttgattctctggactccattatcatgaatagactggggctgtgaagtcattggcagaatgacattcaaagtttcaatctgtatcaaactgtctcatcttgcaaatagccactgggaattttaaaactagtttcctcagtactagttttgaaattcccaagccagaatggatctagactgaaacattttgttacgggaacattgttttaatctactaggttctattaactgcttcagtaggctgcttggttgccacagtagcaagctgagaagagatcttcaagactctgggtcacagaagagagttagaaccattaaagtttctgtgtttgcctgcaggggttaggaccatgcagaagatgggcatgggtattctacgcatctccagtcaaattgaacatattggcttaatgtctagggaataaggcaatgtcagagaaacatgaaagaaggaagcattcctgtattctcttcattttcaatgaggatgttcttgaagagtcatttttgagaactttgtcagagtcaccagccttgctggaatattcttacttcaatatgtgtataattccatgtggtattatttgagtaaggaaccttgctatttcttacttcctatattataccaggcttctttaccaaagtctacactgtattttttcattgtgggttaaaggcaatacatttatgaatttttaatattcctgtcaagatcttacaagaagaaattactttgtgaggtatgtagggatgctaacagtaggttgggaagtggatcataatctcaaaatagtaaatgctagctcggtggctttcccacagagaggtaatgtatcttgatgagacaagagcatttgtagaggagggtttatttgcagctcttcacccactgccttcctctgcaccaacccaatctcctgggctcccctggaatcacgttctctaagtacctccttaggtagacctgcattaccaaggacaagttaaaagtctctttctttgcccttaatctgttgtttgtaatgggatttaggagcaactcagaaaggagtgacaggaactattgagaagttgacacagggaaatagaaatgaaatcacagaacaagaaagcaggaaggcactctagtaatcatctggtagaaataccacccagtgctggaactgtttctgtgacatttctgatagatgtcctctgttggacattttcattgactcagagcacacacaatgcttcttacaggcactgcattcttttgttgtggagttctaatttttaacaaagtcctttttatttttatctttaattgactccaaatctctcttttaggatgtccaacccattgcccttggctcattatatatgacagtactcttctaagtccgggaacacacaatcagctcgtattgaatttgtcaaagaaaacttcgggaattataataagtagttattatattgcttactgacttgattaatgaaagcaaatttctggagaaatcatgctttctacacacctccaggatggtataagacaatcttgcatgaatacattaattaactacttagggaattttctaactgattatggtttattttacttactctctggttggcagttcctgaggcacttatgtaaataagcaaaggaaatggtcaggggaattacttatattttgcctccgcctgtgatgttctgtgatgttttaggtacaggaatgaagatgaaaaaaaattgtgaaggctagtttggctcccaagacatagcactgaactatgacgaacaaaaggaacattacaaggtggagttttgataaaagtgggattcctagaagaagcagatagtagtatgtgactgttgtgaaaaacgtttgaggggtaagttgaggtaaaattgatagaagaccttaaatggtagaagaggaactcagatatctttttatgagcatggaaaacacattctagatgtgtcagtgagaataggccaagttaaggtgaaccaaaatctttcaaatttcaaagttttgatgcagcagatgccttcttaattcattttccatgaccaatattggttggtaagggctctgctcatcacagttgctcagtgtagtcttatgtcctcaactcatgttcctgcaatcagtgggagaaggaaatatggcccataatgcacttgtcccccagagcttcctccagaaagtgtcaaacatttcctctgttcacattgtgttagccaaagcaggtcacattgccatgccgaagttaaaagggcacaaggacatcaaatcttaaccatggtgcaaaaagagaacacaaacatttccgaatagttctagtaactttcacttcagagcacaagagataaattatggggaaaaaaataaggccaatggtggtgcacagttatgtatgcacacctgtattcctgaggcatgtataatggttgaattctaaaggctgagtgattttgaaaaggcatagtttgtttaaaattttagagggatttactaaagccattatttcatcctattttctgcatgttgtctgtctctggatctttttttcaagttctctggcttcccctatattgatgagttatgttggagtgatatggagaaggggctttaatgaccacttttaaggttccctctttgtgtcagttgtgctcaatatttgtattaatgacttgtattaagtagagaaaagagagaagggtgaggggaggtctgatgctgactaaatctatgtaacgcaaaagactggctcagagagttaatacagcacaaaattcaaattgatcttgatgggacatgtatgcctacggttaaacttagcaagaaagtatagctctgtatttagatgttttgtaaatcacctatatgtgcagatatttgggaatatctgacttgaaatcagtgattctaaatcctcctcagagccatcatgttgttacaagtaatagaagacaataaggtgatttggcaatctaaaaaaacaatactttcttgattaatgaatttgacccaaatgttgcagattctggcattagtgggtactcaaaaacatgtatcaaacaaatgaataaatgaattaaaacaaggacaagtatttcctaggtttccaaacgtaacacactcatgtttaagggcagttaaagttccttccttctataggaggaactcagttttgttctaaataaccaaaggccacacagacaacatatttctatttgtgctgatttaaagtgttgaaaaaagtgaaatgcaccaagataacaagcaaactaatgagatggtaaactggggtcattataagacccaattaatttgatccagaaattcttggtcagagacttgattgtttggacacctccttgtgatatgtggaatcaaaatttgggaagcagcaacacagtgggcaaaagggctctgacttaggaatcatggaattgggcctaggctttatcatttactcaccttaggaccccgggcaaggcatctactccctgtaactgaagttactaaattagccctagctaacttaggttattaagtttatctataggcaaaggcttgaaatgtgtagattggggtgaagcctgccctgccaacctcacagagcagtggtgggagctaagtgagataatgtacaggaaagcactgggtaaattgcaaagccttttacaaagataggaagcattatgaagacattttccaaatggcctcaagaaactgatttggttgtgcaacataaacataccactgggaggccgcagttaccagagtctctatcagagacttttcaaaataaatgcagtgactcaaatgtgtttccagatgatgctttgaggattactaacagagcagctattacaaagcagtcagacccaccggctcatgcatgccctaatcctattataagacagaccagataccacttattttgctatgtcaaccttcctttgactgatagtaacaattgttaggcctgttataaaaggcaggctgaacagtgggaaggcatttcacagtgagtcagcaattatagccttgcaaattctaattgtctacaccttcagggtgtagacagttgtgtcactttctatgtatatcctgaaatgagtgaaataaaactgaaaacctaagtgatataggaatacacaggtacagaacatcactggacaactcccatcaagttgaatattatatactgagaaaacaggtaggaaggtgatgtgtgcaatatatgtctgtttccattaagaaactgaggtccaagctagttacaaggaaacgggtcaaaccagaaagtgtaacagcttaatccataagcaggtatgcaggtctgtgtaaatacgggatggatttttcttgtgaagtgggtctgaggatttttatgtttccctctatttcaaagtagccttctgggtatagggaagttctctagcctgtgtgggctgctctctggagtgagcaggtttggcaaccctgaggaaaatgaaagttctctaaggtagcacttctcaaatattaatgtgcatatacatcacctgggcatcttattaaaatgcagattttattcagtacgtctgggctggggcctgatatctgcatttgtaacaagctccaaggtgatgcccatatggctggtttacagccccctcttggagtagcaagggagctgtcataattccagttctagcacagaggtgtaaggcagacttggtttattcctctctctctctctctttttctctccctagtctcactttatcactctatctttgatacaactgaaaatagtcctgaagtcttaacaagaaggaatatgaatgggctgaatcacgtattaatcacttcagcccttgccgaccacccagttctcaggggcaaggaactaccagttctgagacccttcttgttcatggaaaggtgactgtgctattccagcagcacaagaaacattgaacctcagaaagtgcccctaagttcagaaaaactcactatttaagatgtaatcatcctaatatcactgttttggaggagaaataaaattcctggttaagctagagttgataagtataaccaataataataatacttgttgtttattcagggctcattctctgctatgtgttttactgaaatcatcttattaaacccatatatgattcctacaaggcagacaccatgtagttatctacattttatgagtgagacgtctgagcctggaattaaagcccagcctccgaacctcactgctacccttcctgttgacatgaccaggccaccttttagcctaaggctgtcttgtcccttattggttatttgcatgactaaatactatgggtttagcatatgtttgtggaattagtgggagtagacatatttattcaacaagtctataatgtatctttaaatataagctattatattgggaataaatataatatactttctgttgtttgtttcttctttaaaaaaatatttgcctcaaataggtactgtggttattattttggttttgttttaaatcaagaaggattatatgcacatagatgctcaattggtatttgttcacttatgggagaaaaagaaagaaagaaggattgaaaggtgaagttgttcagcaaagcaagagttgtcacttgggacactttatctttagaagaagaagaacactcaacatgtttgaaagaccctgagactttggcttaaatcgctgttaactgagacctacagctcttctgttagtgtttctttcctgtcagacagaggtttctgtgcatatgacgttcctactcctgcttggaaatttataatagacaacagcaaattggagagtgtgatcagtggaggggaaaataaacccatttcactgtgtttagctcagtgtttcccatcctgattacaccagacaaacattcatgcgtggaagacctattatcctctccaggaggcccatgaaaagttctttggcgtgtaccactttagaggaactacttccccctccttagctggtttttctgaacctaattttcctggtgggggcttcctgtaaattctggatctcacagtgtgtgccagtttttaaaatggaatcttctagaattgtgggagcaaaagtgggaaggttgttggaaaatgtagagctagacgctaaagacaatctatattctcactttcattgagggcttctctggaagccaaagaaaggagtccctaataaagcaaagacataagtcaaaggaaaaccagggtcttagaatctcggtttcttctttagtgccctccccttacaacctgcgctcccttttgcattttgggggttctctggcctgtatgctaaacttgaccttgaaagctctctcttccttccaaccaattacgctcatagatacttttttttttattttaacggtttcacttctttcaccatagtgaaataaaagaaacaacaaaatgcaaaaaaaattagtaaaattagattaagaaatttatctagcggtgagcttgacctgtagtttctgactcagttttgcagtgaaagcatcatttggcctcacccactgccttcactatgagtattgtcagcaacttaccaccccattctgctttctcatcagaccttgctttagggaagatccaagggactcttttcccagtgtcctcatcttgccagccagcagctacaaactttaccaaatgaacaaagaaattattttgtgtcaagtgagaaatgtggctctctagggccctccaagctggaggactttcatttccccagctctccccagttctctgcctttgccaagaatgatgccttcaggtgttttctgtcacccagtcagggtgttaaaatgttgggtctctataaaacattgttgatctgccaggatgtgggatgttcattcagggtgtcctcaagagaggtctgtcaaattataacttagaagttaaagtatagagatggtggtgaccatagtagagaaagaaaggaagtttcactctctctctctctgtgtgtgtgtgtgtgtgtgtgtgtgtgtgtgtgtgtgtgtgtttgtgtgtatgcatgtgtgtgtctgtgtgtgcatgcctacatgtgagttttgcttgtggaacacacagtctgtgtgcttgtatgtatgtgtttgcatatgctcaatgagtgcttgtgcaggcccctgtggtcaagaagacatgactgaactaaataactaaagaatagacagacagtctgcttcctgctactacaagcaccatcaaaggaatacagtacagtgaacacagggctgtcctggactgaaaagtctgggaaacactccctttgggtgcctctggtaagaatttgaaagttagctgttgttcatttcttcttagcttcagagcatgaggacgcttgtgaaatacgtagcaagtggctcatggggctctttccaaattgagttaggatgtgtgttcagttcttgaacctcatcttatgcagtgtgcacttgtgtgtgaatatgagctcaaaatttccataaaagaagtttatattagaaaaggtggaagccttttcagggatatgcaaagatggaattgacaacaccatgaggctgaaaatagtcatgtctaggttggatgattccctgcatgagtatagtagaggtaatccaaacatcacataatgaattgagcctgtaagtccttttccaaagctaagattctagtttttatatgtagctctatctttaagatgctctttctcattttttttacattggattttctggagaagatgaagagaatgtcagtaatggtcacgagaagaattatcagcagagaatgttttaaaattgaaagtactatattgctttgtttaaaatgtttggtctatttcatgtcttcacagagatttggaattgtattaacatatgagtgtcagagaggtatagtctcatctaaatttcagcattagactccaagtagttttaaagtttgattaaacatgcttataataattagattcaaagcttttggaattccagcagttttttgaaggattcagcatctaatgaagtaaaataaattgcagggctcttggtcagtgaataagcacttttgcagctaagagctacaatttatcaataggactcattactattcgacttgttttctagccttctttgaaggtttaagggccattgtccactcacacatcaggtttagtcacaggctgttatgaaaagacataattagttttccaaggtctgcaggaccagattcagttttggaaaatgagctgatatgatggtttgtgccctgtcttatcagtcaaaaatgctaagatgtgtaggacagagaaaggttgtaaaaacgattagagaattctgatgatagctgtggggatttgggctagagccagcaggatactctccgcctgcagtctggtataaatcaggacaaaactgaacacctaggctagagttaggacagagtcccggggaccaagtcagactgaaggggtattatgccaatgacatcagaaggaaatgccagaagagcaaggtgagcctccctagcctcatttcagctgtgaggtgatgggataccaggaacattagaaaaaatggagcacgaaatagtttcaggtttgagcttcaagacaatattggacctatgaagccaaatcaatcagttgatttcaagaagaaggactggacaagacaggagcatttcctaatcaatttatgcaaaacctctgtgaaacaggatcctctggccatccaaactgttgttttaagttaaatttttgttttaattttgatgctcttagacataccccatgtttgttacctttgttttctctttttattagccaaaaagctttcttgtgctcaggaaatgtatcttatttacttttgtgtctctagcaatcacgacaaatgatcattattaatagatgtgtgtgtaaattatggctcaccttgcatttgaactgcctccacgtttgctgggattcccttttagtggagttcctctaagcctttctctcttgggtttctcctctggagacaattagacagtggcctcctagaacaaggcagttcagccgttgtaactctgcacaggtgcaaataagtagttgtatagcaaatatttgtcacaagaataaacttgcattcctcatcagtaggagtcaaagagatagctccctttgtagtgaatagcaagtaaaaacaatgttctaaattcagtagaaaaaaacaggcatacacccgtcacctcagtcctctccttccctgtatcttgaagctttcccatgttctcaagctttcccttgagaatgcggtttaagaatctgggtggattttctttagagtgatgaaaggtttagggtaagaaactggcaaggtgtgttgacaattcctgttcagtgacatgagaaaagaactgttaagagcattgcttcatttcaacatatcctttttcaacatagaagactgcccatcccaccctgctaacctttccaggaagacaagatcattgccatggttacaaactgcttaatcaatagtctgggaaacagtagcagccactgcttactggcctagctgctgccaaggtctctcattgaggagaatgcatcttcttcttcagctcccattgccatgacagcttctattccatccagaggttcccttggatgggataaaataaacttagatgatttgaaaaacaagcattaagggttagatagcttattgtaaaactcaaatcttcatttaattatacatgcatattttataaacaatttaaaatgctaacatgaagataaggatagaggcatttgttttaagttattcttgaaagaattgtttcaattctttttttttaaattttattattatactttaagttttagggtacatgtacacaacatgcaggtttgttacatatgaatacatgtgccatgttggtgtgccgcacccattaactcatcatttagcattaggtatatctcctagtgctatcccccctgctcccccaaccccacaacagtccctggtgtgtgatgttccccttcctgtgtccatgtgttctcattgttcaattcccacctgtgagtgagaacatgaggtgtttggttttttgtccttgcgatagtttgctgagaatgatggtttccagcttcatccatgtccctacaaaggacatgaactcatcattttttatggctgcatagtattccatggtgtacatgtgccacattttgttaatccagtctatcattgttggacatttgggttggttccaagtctttgctattgtgaatagtgccgcaataaacatacgtgtgtatgtgtctttatagcagtatgatttataatcctttgggtatatatccagtaatgggatggctgggtcaaatggtatttctagttctagatccctgaggaatcaccacactgacttccacaatagttgaactagtttacagtcccaccaacagagtaaaagtgttcctatttctccacatcctctccagcacctgttttttcctgactttttaatgatcgccattctaactggtgtgagatggtatctcattgtggttttgatttgtatttccctgatggccagtgatgatgagcattttttcatgtgttttttggctgcataaatgtcttcttttgagaagtgtctgttgatatccttcacccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttttcaattttggcttttgttgccattgcttttggtgttttagacatgaagtccttgcccatgcctatgttctgaatggtattgcctaggttttcttgtagggtttttatggttttaagtctaacatgtaagtctttaatccatcttgaattaatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattggtctatctctctgttttggtaccagtaccatgctgttttggttaccgtggccttatagtatagtttaaagtcaggtagcatgatgcctccagctttgttcctttggcttaggattgacttggcaatgcgggctcttttttggttccatatgaactttaaagtagttttttctaattctgtgaagcaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtaattctccttgaagaggtccttcacatcccttgtaagttggattcctaggtattttattctctttgaagcaattgtgaatgggagttcactcatgatttggctctctgtttgtctgtttttggtgtataagaatgcttgtgatttttgcacattgattttgtatcctgagactgctgaagttgcttatcaacttaaggagattttgggtgagacaatggggttttctagatatacaatcatgtcatctgcaaacagggaccatttgacttcctcttttcctaattgagtgccctttatttccttctcctgcctgattgccctggccagaacttccaacactatgttgaataggagtggtgagagagggcttccctgtcttgtgccagttttcaaagggaatgcttccagttattgtccattcagtatgatattggctgtgggtttgtcatagatagctcttattattttgagatatgtcccatcaatacctaatttattgagagtttttggcgtgaaggttgttgaattttgtcaaaggccttttctgcatctattgagataatcatgtggtttttgtcattggttctgtttatatgctggattacgtttattgatttgcatatgttgaaccagccttgcatcccagggatgaagcccacttgatcatggtggataagctttttgatgtgctgctggattcagtttgccagtattttattgaggatttttgcgtcaatgttcatcaaggatattggtctaaaattctctttttttgttgtgtctctgccaggctttggtatcaggatgatgctggcctcatcaaatgagttagggaggattccctctttttctattgattggaatagtttcagaaggaatggtaccagctcttccttgtacctctagtagaatttggctgtgaatccgtctggtcctggactttttttggttggtaagctattaattgttgcttcaatttcagagcctgttactggtctattcagagattcaacttcttcctggtttagtcttgggagggtgtatgtgtcgaggaatttatccatttcttctagattttctagtttatttgcatagaggtgtttatagtattctctgatggtagtttgtatttctgtgggatcggtggtgatatcccctttatcattttttattgcgtcaatttgattcttctctcttttcttctttattagtcttgctagcgatctattaattttgttgatcttttcaaaaaaccagctcctggatacattgattttttgaagggttttttgtgtctctatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatgtgtcccagagattctggtatgttgtgtctttgttctcattggtttcaaagaacatctttatttctgccttcattttgttacatactcagtagtcgttcaggagcaggttgttcagtttccatgtagttgagcggttttgactgagtttcttaatcctgagttctagtttgattgcactgtggtctgagagagagttttttataatttctgttcttttacatttgctgaggagtgctttacttccaactatgtggtcaattttggaataggtgcggtgtggtgctgaaaagaatatatattctgttgatttgaagtggagagttctgtagatgtctgtattaggtccacttggtgcagagctgagttcaattcctggatatccttgttaactttctgtcttgttgatctgtctaatgttgacagtggggtgttaaagtctcccattattattgtgtgggagtctaagtctctttgtaggtcactaaggacttgctttatgaatctgggtgctcttgtattgggtgcatatatatttaggatagtgagctcttcttgtttaattgatccctttaccattatgtaatggccttctttgtctcttttgatgtttgttggtttaaagtctgttttatcagagactaggattgcaacccctgcctttttttcttttccatttgcttggttgattttcgtccatccctttattttgagcctatgtgtgtctctgcatgtgagatgggtctcctgaatacagcacactgatgggtcttgactccttatccaatttgccagtctgtgtcttttaattggagcatttagcccatttacatttaaggttaatattgttatgtgtgaatttgatcctgtcattatgatgtcagcaggttattttgctcgttagttgatgcagtttcttcctagccttgatggtctttacaatttggcatgtttttgaagtggctggtaccggttgttcctttccatgtttagtgcttccttcatgagctcttttatggcaggcctggtggtgacaaaatctctcagcatttgcttgtctgtgaagtattttatttctccttcacttatgaagcttagtttgctggatgtgaaattctgggttgaaaattcttttctttaagaatgttgaatgttggcccccattcttttctcgcttgtagagtttctgccgagagatcagctgttagtctgatgggcttccctttgtgggtaacccgacctttctctctggctgcccttaatattttttccttcatttcaactttggtgaatctgacaattatgtgtcttggagttgctcttctcgaggagtatctttgtggcgttctctgtatttcctgaatttgaatgttggcctgccttcctagattggagaagttctcctggataatatcccgcagagtgttttccaacttggttccattctgtccgtcactttcaggtacaccaatcagatgtagatttggtcttttcacagagtcccatatttcttggagtctttgttcatttctttttattgttttttctctaaacttctcttctcacttcatttcattcatttcgtcttccatcgctgataccctttcttccagttgatcgcattgcctactgaggcttatgcattcgtcacgtagttctcgtgccatggttttcagctccatcaggtcctttaagtacttctctgcattggttattctagttagccatgcacctaattttttttcaaggtttttaacttctttgccattggttcgaacttcctcctttagctcggagtagttcgatcttctgaaaccttcttctctcaacctgtcaaagttagtctccatccagctttgttccattgctggtgaggagctgcattcctttggaggaggagaggcactctgatttttagagtttccagtttttctgctctgttttttcctcatctttgtggttttatctacctttggtctttgatgatggtgacgtacaaatgggtttttggtgtggatgtcctttctgtttgttagttttccttctaacagtcaggaccctcagctgcaggtctgttggagtttgctggaggtccactccagaccctgtttgcctgggtatcagcagcggtggctgcagaacagcggatattggtgaaccgcaaatgctgctgcctgatcgttcctctggaagttttgtctcagaggagtacccggccatgtgaggtgtcagtccgcccccacgggggggttgcctcccagttaggctactcggggatcagggacccacttgagaggcagtatccccgttctcggatctcaagctgcgtgttgggagaaccactactctcttcaaagctgtcagacagggacatttaagtctgcagaggttactgctgccttttgtttgtctgtgccctgccctcagaggtggagcctacagaggcaggcaggcctccccgagctgtggtggggtccacccagttcgagcttcctagccgctttgtttacctactcaagcctcggaaatggcaggcgcccctcccccagcctcgctgctgccttgcagtttgatctcagactgctgtgctagcaatgagggaggcttcgtgggcataggaccctctgagccaggtgcgggttataacctcctggtgtgccgtttgttaagcctgttggaaaagcgcagtattcgggtggaagtaacccgattttccagatgccatctgtcacccctttctttgactaggaaagggaattccctgaccccttgcacttcccaggtgaggcaattcctcaccctgcttcagctcacgcacggtgcattgcacccactgtcctgcacccactgtccggcactccccagtgagatgaacccggtacctcagttggaaatgcagaaatcacccgtcttctgcgtggctcatgctgggagctgtagcctggagctgttcgtattcggccatcttgactccaccccccgaattgtttcaattcttatggtggttaaaaaacacagattcattaagaataagtcctgactaatttagttagttttctttttctaccagttttaccatttactagctgagtttttagtagcttagttttctggaccccagaaaaagctaatgagatcttgggttgcattaataagtacaaagtgggcagaccaagggaggagatagtcctgtatctgcttagttacaaccctgcatgttggaatacattgataaactggcagatataggaagaaagtgagcaaagttgtgtagtggtcagaaatcctctcttgcgagaaacaattgaagcaaccaatttcattcatcctggagatgaatttacttgggagaaccatgttaaatacctttggagttttaaatgactggtatgtaggcaaggggctgagtattaatgtaatgtcagaaggctgaagaagttccaatgtggtgtgtggtcaccaaaatgcagattgcagatcagtttagagaattttcagcaggttcatctaaacttcgtatttctggtgcctccattataggaacaattgccaagtttgcttatgtttttactctttccttcaaaaaaaaaaaaaaacatttatcaaactgtgatctggagacaacctgctacagattcacggggtggagagatggaagatggaagaaccaagagagacagtaaaaaatcatattactgggcccgaccctagaactatagtatcagagtctttgggtctgtggccattgaatctttattttttttgttgttgttgagatgaagtcttgctctgtcgcccaggctggagtgccatggtgcaatctcagctcactgcaacctccacctcccagattcaagcaattctcctgccccagcctcccaagtagctgggattacaggtgcctgcccctatgcccagctacattttttttgtatttttagtagagatggggtttcaccatgttggtcaggctggtctcgaactcctgacctcaggtgatccacccgccttagcctcccaaagtgctgggattacagatgtgagccactgctcccaaccatgcatctgaattttaaacaggctttactgatgcttactaaagtttgcagacactataggtaatacatcctgaattctgacaagcagatcgttcttcaaatactgctttcgttcctggttcaacaatttacttgttagctttctaaggtttaaattcctcaccagtagttttagtagccttgataatcttgtctgtctcactttttaaggttctctccagccaccatcttgcctgtccttcaagtcttggtatcttcacagaacgtcttcaagcattttctatttactatatttgttttttttcacacattctgaaatcctcctagtcaatgtcatgagactactcttgaactttgtgagttccactatcacttggggcatgcaggtcttctctctccaacaggtaagaggggtctttgaaacacccggcatagtgcccagctcaaggtattccaggtgtttggtgcttaaagccacattttaggctgtttatggcaactcttcgtctgaggcttgaatctcttgtatcaagtggttaatcaaagttcagcactctcatcaacattggtggaaaccttcaaccttctgagcatacatcttccacctccagctttggagaagttggacctgagacattttttcattttgagcaaagatcatttttccctctaacttccagttgtcagtctaggagtctgctaagtcttcatagaacatatttcataaatacctgctataaaaacatccctttgtttctcataagcctcattaaacttactcttctgatgtgtttatgggacttctggctgttgtaagtctgattagaaaggagaggattgtttgatatgaaataaagtatccaagtgaaatgttgtctttttacttttttgagaaatatctagtggatatttcagaggatttaaaatagctcttatgtttccctacccttagcatattaactaccacaacaaaaagatttggaaaatgtccattttgatgcatttccatttgataatacattcacagtgaacattctaaaatgctttgtgattgccagatgacaggcccacactgtcaacctaagttctgtaagagccaaattgataacattgaaacagttgacactgtacattatgattttaatctgccaaaccatctcacactgactcctaaaattaaaaataaatatcacacctatggcaattttcacttgagctgattcttttttattatttttatcttcttctgaaactttcattcagaaacctgaagtgaatacatttgtttaatcaagtctatgcgtgatagcctaatcccaattctcctcctaatagcgaaaggaagaatcattgaaacaaaatggtttgggcagtaattcaggtgccatccttcatgtacagaaatgtgttatcagcgggatgcttgctttacatctgtcctctgcagcagaggcggatcatggcaaggcagcatggcagcatatctcctctctggctcctcctgtgatcagtgtgtatttaagggacagttaattgattagagatacaccagacaatggaatcttctttgttcttgagtttcaagtacatagattcccaagggtgtagaaatatgttggttcacttcctcttcaccaggttggcaagggagggagtctcaccctagggttctaggggtgactgaacgtcctagactagggaagtctgctcttgtagattcttataggaccatgcaatgtttctgcatgtgatgtctcatagctgttaattttaatttttttgtggttattttattcatttctggctcccctatcagcaaactgggcacaggcaccatgtgtgtgtggctttgctccctcttgagttgcagtctctctgacagtacctagtgcccgatataaggttagtaggcaatgagtatttgttgaatcattgaaggcatccactcagtattacaactaatgtttcattccaatctttctcatatcttcctcttcccagaattgctgtctgattcaccctctgagtgtgtcttgactcatgttgacagtagcctccagaaggagaatccttccaccttggccttgtcccatatgctgctgccagactcatcttctccaaactgttttgatcatattgctctccaggacaatctggccaatgcttcacccctacaggtccctggtgcttccctcgttctttgattcctcctgtaggcaaggcctgccctatttctcagcaatccaacctgcaatccactaaatttgtttatttatttatttatgtatttatttagagacagagtcttcttgctctattacccaggctggagttcagtggcatgatctcagctcactgcaacctctgcctcctgggttcaagtgattttcctgcctcagcctcctgagtagttgggactacaggcatgcaccacacacccagctaatttttgtatttttagtagagacggggtttcaccatgttgctcaggctggtcttgaactcctgacttcaagtgatccgccagcctcagcctcccaatgtgctgggatttcagatgtgagccactgcaccctgccctagtccactaaataaatgtaaaaagcaactatgtgtcagggacgatgggataaaagggtgatcgtgacgtaggcccttccacagactggatcatagttcaggacagtggggggcagacctagagcaaatactgcaatgtgacgtgagttctattccagaagcactaccagtgctgcaagagtcccagtgagtgaggtcggagagcagcttcagtagctcctgctcatatgtgggggccatctctgcactgtcccaccctggcattgacctacagtcacatatactgagtttcctgtccttgatttttagtacctctttattagtccactccagccaccataacaaagtgctgcagacttgggggcttaaagaataaaactattttctcacagttctggaggctgaaaagtcccagattggggtgtcagaaaatctggtttctggtgacagctttcttctggcctttcaaacagccattttcttgctatgtcctcatatggactttactttctgcatgagttcacagaaatagaattctggtgtctcttaatcgtcttagaaggacacgagtcctactaagttaaggccccaccctaattacctcattttgcccgtattacctttttataagccctgtccctaaatgcaggcatattggaggttagggcttcaacatatgaattccaagaggggtataatttagtctataacaatccaagtgtaaggcacctgctatatgaatcagctctgactgcctgcaagttagtatccccatctaaccagatgagcagtccttggcttctgtgtgtctactaccaattcataggtgttattttcatggtgtgtgcacacacctgagtgagttctacacagtcccagtgttgtctgtaaccctaggcagcttaaataatgttttgttttgttttgtttttgattttttgagacagagtctcactctgttacccaggctggagtgcagtggcgtgatcttggctcactgcaatctctgcctcccgggttcaagtgattctctcgcctcagtctcctgagtagctgggattacaggcgcctgccaccatggcggctaacttttgtatttttagtagagattgggtttcgccatgttggccaggctggtctgaaactcctgacctcaggtgatccaccctccttggcctcccaaagtgctgggattataggcatgatctctcataactgttaattataacagctatgtgaagcactgtgcctggcctgaataatgtttttaagcctcacttttctcacagtaatactagattgccaatctctcaggcatgttggggggattgccttcaataacatatgcaaagcgctagaatgtgttcaaacatgtacttagctccgctcaagagttggttctccactcgaatcctgcccttgctactcttatttatcagctaagcttttggaggacaatacttatgctttctcctatccctctatctttctaataaagactcctgtcccaaaggcagatagatggaatgcctgactgaaggcaaagtgggatgagagaggagagagaacaaatccaaacagcaaaaaggagcagcctacagggaagcccctattgtccagaaaatgctacagagagtctctgtttggtctttgcagccaagaacgctaaaaaaacttctaaccgacaataaaccattcccactggcagaatacaattttgtttgttgttacactagtcattcatgaggaatatctttgctttgttctgggtcatttaccttgagttggaaagatgcgaaatgaattagcccagaggccaggagtggggagatatgatttgtattaatattttttgagatatgatgttggtatgcaaccataataagcagcacattgaaaagttaattcagcagcagtaattctgagaagtaatgcaacttatttgtcactaaggaggactgcatagccaagtgatttctttatgcattttaaagtgtttttaaacccttgggtagctatagtcaatttttaaacatgtttcctcattaattttgaatttgtaaatgtacattgtacaggagtgttttaatcatctggggaggctgcttcacagatggctcttgtgtgacctaaaatttcaatgattgtaatgaatcagaatggatgatggtaaacttgcttggagatttgctgattgtcaacagttttacagttttgctactgttcttgaaagtttcgtgcttcttcaaaatgaaaggaaagcaattgtaatgggaccgtcaggaccaggagttgcctaaatgaaataatttcagtcagttccttactattctctgtggaattcttttcagtaaaatacaccaacagaatgattgatcatgttgaatctaacacatgtgtagagagtgagtcatcggctctccaggcctacacgtgacaggccatttcatgcctctctgtgatactatatgcagtcctaattaaaatatgagaaaatctaacaagaaatgctctagtgaattacttatgccaatgttctccttctgtggcaccagaagttgagaattgcctaggcaaagggtttatcaggtacataaagctttacctatcactgttaaagacttaacttggctgagtgcagtagctcacacgtataatctcaacactttgagaggctgtggcagaaggattgcttgagaccaggagttcgagaccagcctgggcaacatagtgagaccccatctctacaaagaataacaacaacagcaacaaaaatagccaggcatggttggcgcatggctgtggtcccagctatttgggaggctgaggatctcttgagcctaggaggtggaggctgcagtgagccatgatcgatcatgccactgcactccaccttgggcaacagagggagatcttgtctcaaaaaaaaaaaagattgaacttaaaatgcatctagaaaccagaattataatagacaaatccatttatgagacccctagttctgtttgtttgtgctagaatcatgtgtgtgtttcaccccaggctttaccgtgcaatctgcctgcagcacagtgcaggcaaaagaagatggtctgggacattagagtcacacatgttctcacttactagtgttacccacacaacaggtgggttcaatcgcttggcaggtaacagtccaatgacaatgaaggaggatttaacaagggggttttattacttgccacaggtaaggaggataccggggataggtcccaaagcaatgcctcccctaacaaaggtgaacacagggcttttattgggctggttaactgagtcgttgtatgtagaggtggcatataggcagcacaggcacagccactgatcgtgcctctacacacgtcaaatgtataggaaatggcaagtaggcttctccctgggtttggaggttagtatggtaatgagtggagtttgccaaagttcatctccaactcaggcatctctggatcccatcagtttggtttttcctgggctgagcttcttcctagagcttttttgaaacaagaactcaaggtgcaacgttacaagtggatacattttcacaataatgcatctccaaaacccagcaaccctgggttacactatctatgtgtatctgtgcataaattagcctttctgaattttggttttttggaacagaggatggttaactctgccaagtggagaggctgtggtggtgaagtagcacgtttaatcctggcacagaacacactccacaagtagtagctctttcctagtctcttactatcctcgttctctgtaagaggtggcccccagactgcacatttcaaggcctcgtgcattccaagaacctccacctttaatctctatgttctccgattaacaattcttaggaaattctggagcctgccattcgctggcaggtgcttgaaactccagattcctaatgctgctgaggctctccaggagggaactccaggagaggcgcctggcgtaagatgaggccaggatattcactgtcaggttatcccaggcattctagtaggagtctcagtactgaagtgggacacacaacgcttgtcctttgggggccctggcagggaaaagttacttctcattccctatttgagcaggtactggtgtaaaagctgtgctgagcatgacattgagcaccagcctagaagactcatcttcacctaaattatgggtcattactgttcatcttttctgaccattcatcactcccaacagtgccctgttgatagagacagaaggcagagaaactctaggcagacagggcaggtccctggtgaagtcccaccttccagccgtaaagcgtgaaacccatggcccaaagtgagaacttctatccctgtgtgcccactctctcctgattggttctttctgaataatgtcttttttaccaattgaatgttgccttttctcaaactacctatggctcaccctgctccccatcctgtgcctataaagaccgtagactcagtcagtagagagagaaacagcttgactcgagagagggaacttgatttcagggggatggttggccctaggaggagagatggctcttgatttcagggggatggttggccctaggaggagagatggcttaacttcagaaaagagccagacagagatggccggacatcagggaagattacctgcccatcctgtcgcctctcctgctcccctctctgctgatagccatttccatcacttaataaaattctctgcctcaccatccttcaagtgtctgggcaacctcattcttcttggatgccgaacagagctcaggactcacggagtgtggtgcccaacaaaggctgtcacactggcactttgcccttgctggcagagggccgtcaccccaccggatgaggcaagggccccactgagctgataacacactactgtccatggacggcagagctaatagagcactgtaacacaccctctggggttttgggggttgcagacaccccacctgggcaccaccatggggcctgcatggagcctgctcctgctggagtccaaagctgctggccggattctgaactcgcttgctcatgtgatccctcccacaagaggttgagtggggcgggcagagtaagttggcacccctgtcacaagtctgatgaaggggtcgagaaaaactcctgcactgctttcacctagcgggcccagtgcctttcctgggccctgagccagtcctgatagagagaagaaaaaggacatttaataaggtttatgcttcttggttgaatgtgttactcttcccagagagttttcattttaatgagaatcaagcagagtaaaaaaccaaaggaatgaaacatctagtagtggaatatcaaataagaggagcccagaggggagcagccttgggtagcctaggctttggggccctgaggaaggtggtctccactgacctacctaagaaggctgtcacattggaaacagttttgttccttatgcagcaagtatgtaggtataggctagtgtttaaatatcaggacccacattaaccagaacacccagtaaaatcactatgctgccccctaccctattcctttggcagatggtctcaagagaagtccactctcagtgacagcaatggcaaatagctatgctgccacccctgtctcccatgcctggcacatgccactcctccatcccagttgactttcctgctgagcccatgctcattcaggatccttctcaaccctgtgtcccaggcaaatattattgtttcatcagattttactaatgcgataaaatcgatctgccttcctcaggctatgatttgcacattctagataaagtaggctgcacaatcaatgttgtctcccattttgctgattttactcactttagagatggcaagcagctttcccaaggtcatccggtggtttatggcagaaagacacctcaaaatgggatctgacctcttcaaaccctacacttgtctactccgtgtagctgtttccttgaaatcacaagtgcttcttgcttttttgtttacacactttatgagatgttaacacaaaggtactgctcccaagggtgtagattttcactaaacaaaacacacaccagttatttgcttagcaaatggcatgggcttaggattcatgtgtgaccccataaaaattaggaattatctgacatacctcatcacatacttccctttgaaaagctgcctccaccgactgggaccctggtcattagaataaacatactggttttgatgatgataaagtccaagtgagccccagttttaggattgttccatgaacaaagtgttttatttgcactgtcaaattgaaataagctataagaacaaacttattgggctgggcatggtggctcacgcctgtaatcccagcactttgggaggctgaggccggtggatcacgaggttgggagactgaggccatcctggccaacatggtgaaaccccatgtctactaaaatacaaaaaacattagccaggcatggtggagagcgcctgtagtcccagctacttgggaggctgaggcaggagaattgcttgaacctgggaggtggaggttgcagtgagcggagattgcaccactgcactccagcctgggtgacagagtgagactctgtctcaagaaacaaacaaacaaacaaacaaacaaacaagaacttattgactcccaggatagcctctgtcatacagagcctctggtctccagaccagcactacattgtcactggggagtatactttcaaaatatttggtattctgaattctaggaaatggccgagtacagcataatgttctctgcttctcaaaaaccttctgtttggcgtggaaacacatgctctgatctgtatgtcaagtttttctgtgtgtggctcttcaatcaaattacccaatatgggactattcatggggagctcttctgagaactgagttggaactcagaggctggccaactcccagggctctcctggctccccacccacggtgctcactaaatgctttttttacttcctccaccagttctcgtcatcttaaaatctaactcaagtcatggttgtctatgtgacttgttgactagtctaacctgtattaatccttttttaatctgaattaatacagtgtacattttgataagagctgctttttatggttgattgtgtgcgcactgcgttaccgtaggatcccattcacagtgttgtcactgaaaatttgtatagttatcactacatcattccagcatacaataggagagtgccttgaagaaggggtactttgttaatgcacacgacggtgccatattgaatagtgaaagagctacccaccagttccaactgcccagtcagaccctgggaattatcttgttcttctctacagggcacacaccttgaggtctagaggaaacaatcattgagtgggtatctattaggtttccagaaactgggctgggcaatatgttacctcccttcattctgttaataattataaagtttgagaattgtctctttattttagaggttaaaatgtaagtaattttttcagttatgtagctgatcatgacagagcattgatttgaactccaatcttcctcatttcaaagtccacattctttgcctcatatcccattagtccccagtatatatggcacagggatcatgcctctgtggattctcaataaatgctatgagaattaattagctaaagaagagtagcagagagcagttcatgggtcatcagggttttgtttatagcctgtagagtttagctgtcctttcctgtggtgtaggtgagagaaaaaatactgaagtggaccatgtggacccatagctacttggagcctcagcatcaggacttaccatccaatcttacatcttcagaatttccaggtcttcccctgtgtggaagtggcaccactgtagtagcatggaaggttgattggaacttggtggatattaactgaaacatcttagaaactctctggaacccagagatgaaactttggttgaaactcattagaggaggattgtattagtccattttcatgctgctgataaagacatacccaagactaggtaatttataaaggaaagaggtttaattgactcacagttcagcatggctggggaggcctcaggaaacttatgatcgtggtggaaggggaagcaaacatgtccttcttcacatggtggcaggaaggagaagtgctgagcaaatagggaaaagccctttataaaaccatcagatcttgtgagaactcactcattatcacaaaaacaggagcatgggggtaactgcccccatgattcaattacctcccaccggttccctcctgcaacatgtgggaattatgggtactacaattcaagatgagatttgagtggggacacagccaaaacatatcaaggatacttttaaaatcttctacattctgttttattattcagcatctcacatttaaaatgtttaggcaatatggttctgtgagcaagggtgcctgcctgggggctatgactacatgagaaattggtttgctgcaataaacagaggcctggatgtggcaggaaactcacattccaatgcaagccctgcacatgaccagctgtcctctctggccagtcacttcagctctccacatttacttatatatagaatgtggaaaataatctcttccctttacctatgaagggcttgatgttgaggtaaaatatttcttttcttttttgagacaggatctagcttctgttgcccaggctagagtgcagtgtggcaagattatggctcactgcagcctcaaactcctgggctcaagcaatcctcctgcctcagcctcccaagtagctgaaaccacaggcatgcaccaccacgctaggctaattgttttacgttttgtagagatggggtcacaatatgttgcccagactgatctcaagcaaccttcctgtcacagcctcccaaagtactaggattataggcatgagccactgtgtttagcctaaaaatatatttttacgtagaggtgttttgaagtttgctagtggcaaatgcttatcactatatggctaataataatatttagccattcattttggatatccaataagtattattaagatctatctttcacaggtactgttctaggcactgatgatacctagttgaaagagatgcaaatggtacctgttcttgaagaacttatatttgagtgagggtagatacaatataaaaatttagtaaactgtttataacaagaaataaatgtacaatatagtttcaaataataataaggatttaaagtaagacagggcgatgagataaagtaggggtggggcctcatctggctggctacctgttattgtactgccttggggcagagatttgtttttacatttttaaatggctaacatttaaaaaataaagatctcttgatatgtgaaattatattaaattgaaattttgatattcatacttaaatttttgttagaacacaaatactctcattcaatggcagaattatttgcaacagagatcataaaaaatatttactatttatattactatttgacctttcatagaaaaagatttactgattgctgtgatggactgtgatggggatataatttgtctaggttggtcagaaaaaggctttacaggtttccatcatcaccattattatcttcatcatcataattattattttatatcttctagatgagtaatctctgacaaactatttaagccatcattgtcacattcagaacagataaactttaaattcctgcttgattttgtgaccctttgaatgatgtatagtcaagtttctctctgttagaagttgttatatttgtttaagtatccccagcaaaattttcatccttcccagcttctctttgccacctacctgcatttttgcgcaccctattctgttgtcagatggtgtgtgccaacaaattgtattagtctaaagaaaacataattatgaaggtaaaactgatacaaaataaggtcatttgctgagccaaatataaattatatttggatcacctgttgtttgggattttctgcctcagtactccacccattagagagctaatcaggagccagctgtgactgtgactggagcagtatcttacctgtgagttgcgtaaaggctggctggtgcaatgattagccgatgccatctatcagccagtgctgtgtggctgtcatgccccagtgctgaggtgtgctttacagagatctgggagcctcttcaggcatatttctggggcgaggagtgtaccacattttacccaagaggaaagacaaggaaagtcagggaaatgtaggaagtaaatgaatttaagtgaaaatctggagatgtaggcttttgggttatacatataatttgatactgtgaaacattcagtggatcttcatgtgggaataactgtacatttaacttctaatgacagataaccagtggcaaaaaaagctatttttaaatgcgttaatcacaattgtattgacgtacattgaggacagagcagtacaggcgtacacaagttatttttattcagtaaacagttcttggtgtgcatatggatttgaattttcttttctataaattgcagatctgccatgagtctgtagtccatagattgggagtcattcttccggatcaggaatcagcaagctatagctagtgggccaaatctggcccaccacctgttttagtaaataaagttttattggaacacagccacgctcatttgtttacttattgtttatggctgcttttgcactgtaatggcagagttgagtagttgtgacagaaaccatctggcatgtaagccaaaaaacatgtattatctggccctttacagaaaaagtatgggacccttgcattcagttattgttttctcatggacaagagtgggtttttaaaaagatatttaaatccccgtgtatcataaatatgcaagtactatctggtaaggtggaagaaaatatgataaaaacattcatgggattctggaatattaattctggatattgtgtgcatttctggaataacaaagctaaagaatatttcattatttatacaggcaattcctttgcctctatggccacctatttattcaatctacttaaaagaattttgtttttcagggcaaactcttccagtgtttatgaccattttattatctgcatcatgaggtgtttctgggtgccccctttctgatgggcactgagagaagatctcagagcttaataatttgaacacagagaaaattccgtcgtctaaataatgtacattgttcttctatcctctgggtatatctgtctcttcctcctcagtcctcagagaagatgaaaaatatctggtaacttgtgttgcttgaaaactcagatataccctcttttatgcaataggaatcggttgggttcctgaatgggaaaactattgtgatttcaggatatcaaatccagagttttattcaaatacattaagaaaaaccctgggacataggattttgtaaagaaaatattcatttttaaaacatgaaaacacaggtatcaaatacataggttttgctagattttatttgcagatggtagattttctctgcttactctaagctttttacccaggatctgtgttccagcctcgtggccatacccactggccatatcctctgctcatctgacaccaaaagactttccatatttggagtagaaacagaaaaaataaagaagcagcaaatgttcacatgcagtgtccagttagaggagcacgctggctttctgagggaagagggcactcacatagaagttcaggagttggatagaagctacattgcactgggctcctatccccataatcagactttccacagaattgcattttctaacctaccttctcaaaggatggctgagatttttgggtagggccagataccactctgctgtgacttcagcttgacaaggtgtctgaagatatcctcacaaacggcctgatttttgctccatggtttccatcaaagatgtcagttcatatcttcatcttactccaagaaaccttgaagaggaaatgtgtatctgagctctgtagttgaccagtggacttccgagagcagactgacctcatgaggttggcattatcagaagctatgtttacacctcaggaaatggtctgcttcttccagagcagcctgcaaaagtgaaggcaataagcagctaatgtaatgagatcagcgtttgaggtagtactggatgtctgggggccagtgatacttacacacacgatttgttagataattcagcaagagctgaggcctgactgaggcttcatgctttgtgagctgccagttttagtactgtttctatttccatcaaggccttcccttgctgtgtgggccagccttcattggcctaagaatcattcattcattcactctgcaaatgagtacctgcatttgcaaggtgtgattctgtatgctgtgagactattttaacagacatggtatacacttatgataattggttgagagaatggaacctaaccctcgaagaagacgttatctacctgacacgtgaagaaatggaggtagacagtacactccatcttctgaagattgggctctcaaggagctgataattttaaaaagatctttaggaccattgtcttcattccctaaaggctggaatagaaaatatcaaaattaattgtgccagtaaaagcaagttgacaatcttaaagcatggtaacgagagagagagggggagacggggagaggctgttgctcatgaataacgtggtgtgcactaaagatttgggacagagggagggcatacatatagcttgtagtatgctgtgtcctgggtacggtgctatttcaagagtgaacagtatgtgcagagcacagccacgtggaagggcaaggttctgggaatggaaaatagttctagattattaaggagacatgaaaaaagatgagggcaattataacagttaaggaaggagttctgaaacctgttgaccagggtttaggtccttgcttcattgctgtgagatgtatttggacagttaacctctccgtgcctttgtttctctacccatatggactggaaataggatatcaatcagcccgaaatgggggctgtcacatattaagctatcgacacatatattagacaaattgtaaagaatgtcttatggtatagaatcaagtttaataaacttttttttttcccgtaaaggtcaggcagtaaatattgtgggctgtggttgtgggctacctatagtctctgttgcaattcctcagcaatatcattatagcacaaaagcagccacagccactacataaacaagtgggtatagctgtgttccaataaaacttaagtaacaaaaacaggttgtgggatggatttgacctgtgggctatagtttaccatgtgtttagaatatggactgtgttctggctgttacaggttcatgtgtgttacagggttgggtgtaggggactcattcatagtttttacattaatagcccctaaaaagctaaaaaaaaaaaaaaaaaagaacgacacaattagattttagaatttagaaagatagcactcttttaacagagtggtgcagttaccaaagtgtgcaattttctgtatatgtttgtgtgcatatgcatatgcgtgggaatttgtgtttgtacatgtgtatgtgtgtgttagcattggcagaaatgagatgaatctacaagctgctgacatggtctagagattatgagaacttgggataagatagggcattagaaatagagaagagagcacccttgggtgacaatgtgtttagatattttaggatgacagccaggtttctactttggtaattgagataacagctactggaagaacaggctcagggaagatgctacattcatgtgaggagagggtgagtttgatcagcccatcagataagttttcttgtgggcatattgagttcagaagagacaaggtgtgtagatacaactgtggaaagcactaatacatgcctaatccaatcccagagaagggaaaatagaagaaaatagtgtgtgtgtgtgtgtgtgtgtgtgtgtgtgtgtctatgcaaaggtatttaggctaacttattcatgtgttaacataaggctagacatacatggacacacttggaagttctgggaattgggagaaagaagatttaaaattttcttctcaaaatactgctcaaattcaagagtacctttccactatgaaggtgtcagttgtcgagatactcacaagctatttaattcctaatctgtaagagtctgtagaagctaaagaaatatctttatgttggacctttaggcaagacagaaggaccagtttttagtgaataagtggagagaagaaaatagaaaacaatgcatataacactcagactgtagttctttactctaatggaggatttccataaaaatctttttatttgacctcaagggcacatagtttacataaattccgtatgtatgtggatgatctcactgactcacctacctagagtttccctggctttttttgagttctcatttaggttttttaaaattgtattttattcagcatagatggttcctgtgtgagtgtgtgtgtgtgtgtgtgtgtgtgtgtgtgtacaatgtgtccccagcaactgattccaaaaatgacttgctgaaatgcacaattctggctgagctggcactgatcttttgatgtgggtggatttctgctgatttgtggaaagcttcatgccccaaccccctgtgaagtcacagctggcttttccaggccagttggctggaggtaagagtaccatctggggcattgaaaagcagtgagactaactggtctactggggggattgaataggcaatgtggatcatgctggtggcagcctccagtgagtgcacttcactctaccaaaatgttcaaataagacctcagcttacaacacatagtttgggtgttatattagtattagtgtttgactattatcttgcctctgaccctggaaagaagactgattgtattaccatcattttatatatatagtctaatcgtaacaataaccttatgaggtgactactgtttttcttcatccttattttagagacagggtgacatacgggaaggttgttacatagtctgtacatggaaagagaggatactggcacagttgctaagagcccaagttcttaaccaagacaggctcctccctctctctcaacagttacctatcacccaaatgtggtttgtttttttatctgtgttccttgttttgaaaaatacattgtgttaaaaattggtattcttttgatgaccaaatctcaaatttaggactttccttttacctgaacattttttgtaaaacatctactctcttgaagttgtatcagtctattcaaaatagacgtggggcatgaatagtcatataggaagaccaaagccttctagggcaagtcgtcattggaatggaggaagtccaggctttccattttccttgaaagaaagttttcctttccaaatagctctttccaaactctgcctttccaaatagcagaaatcagaaactttatgaatcagccttgtatttatgcttccttaacttccatgaaggcatgatttgtttagtttaataaggctttgattgcaggtatcagcacacaaacgttgactgaaactgggtttcttttggtaaaatgcaagctgtgtgaaattcatggaaaatgcaattacgttctaatttactcagtgtcactggctttaattaaagtagatcatatttctatgaagccaattcatgatcctctttaacaaaggaagtagaaaacataaggaaatttgctatttttcctttgaatattaacacagagctggttactttttggctacttttttgagaagtagcaggccacaggtcggcatccccaggcagaaaggcctgtaggggcccagccgaggcagcttgtctgctgcagaagagcctatccaggcctgatgtgagtgcactgggaagacatctctattcttagcctttactccgattcttcaccaccatccatctcacctatctcttctgtcttgtattgtctacttctcagggtatatcaaaggtaaaaactgagttaaatgtggatgcaatacgctaccctctttttaatcagattagaggtgttaggatggaagcaatcaaatactaaccaaccagaagcccgaaagtgggcagaaccacggttgttttagcaaagtcttcaaagaccctgactttttctaacctcagctcataggcttgatctttaggtttggcttgtcatggtggcaagatggctgttgcggttgcaggcatcttatagaggccaacaatatttgataaggagaagtgtcttctgccatttatctatcagacagatatcagatttctcagatttccctgactctctccctgacatatttcattagctagattgggtcaccagactatgacatgacaggaagaaatgcagagggacagggattggggagacatagctggcaagttattcttgcaaagaaagcacctatgggaggaatatgcaaggactagataatggttgttggataaaccaatatctgtgtctgtcataccactaatgatgtccatcattagttttgatatgttcatgtaggtgtgaaactattaggtaaatgaacttataagtcaagatcagcctcattgactttgaaaacatatatgtcagctggcatttataaataaaggcataggaagttcatgcaagataattgtatttacttctatcgaggcttcctgaaaactttatagtttctgaatcctcaatgtgaaatgattcagaaaaatttttaaaataattggagacaggtagtcatctataactacatttttatatgctgtaaggggaggagagattaaaaagttttggtcatgggaatactatgatgacacttcttaatgtgatctccagtggactatgtaagacaatgaatttaaagtgcaacaatttatgctaaacaaggttaaaatgtggcaaagatggactaggttttaatgtgctataaggaaattaaaagcctctggcaatctataaacaatagcctttggttttgactgaagtgcccattacccacaaaaggtttggtcagtcactgtgctgataacacaatgcgtaattactaataggctctgcattgctgaggaggaactttttaaattttcctctctttcttgaactagatcgaagttcctcagtgctttttttaacaatcattttaatttgtctgatagtttttacttcctttcacaactaaattgactgatgacagtcaatagactttcattcattaaaagtaatagcttactatatttgctgagctaaatatctgcacataatttccagtgtaaattttgtgaatatatgggtgcaattttactgttttatttctgttttaagtatattaccttctgaagagtggtatttggattttgctgacatgccatggaaaactccttcgggataccctgtggtctaacaagaatctggaaaaatagaaaccgaaggaaaccgagtgctcattggatcctcctttttccttttaggatggatgaacttgagactaaggaaggatttttgttccaaggttaagagttgcatggggatcaggtggctgcctttaactggctctttctaatgccttccttgcttggcatagtgctgtagacacggcagtcacccagtgtttgctatttgggtgaatgaattatttaaggacatttgtattttcttttactcagctgctaggaagttatggcaatggtgtggggatcatattggccacaaatcatgatggcaagtaggacaggatatcagggctccggatcatatttttctgaggtgctcttaagggcgtatacctagactcatctatttaatctgattgcagttggttggtgggatggttggttcagagtaggaaccactgacatttggtttaattgccttggaacagttatgtcccatgtgcctcaatgatggccatcttggataaaactaataaataagtggagtgtgtggtgtaaatcgaatgctttctctagattttttccacatggtacaacatggctaatgaaggcatctactctctggggcatgtgaaaatccaaaaggtatggctttgcgtttacaaaaaatgctgatggaagccatttcccaattctgattttgtcttaaggctagactgcttttaaagctactattagcaaataattgtcccttaagtgaaaatagcaggctctcaaaggcagaccattgaataccacagagtcaacagattagattataatttagattagattttagatttttacaacgtagatatagattagaatttcagctctaccacttattagttatatcaccttgaacaagtcacatatgttctctgtacttcaatttattaatatgtataatgggaataatcattattattacttttatcctctccagctggtttttgaagagtaaaacaatgcatatgaaagttttgaaaacagtgtggtatcatgtaaatctaagagattagtattaacgtctatcagaaccatgcagcaataaaaaataacaattatattgggaggcagttttccatagtaagtgccttagaatcattaaaagtattgaaaaggacctaagaaaacctaaaatggcaatctcgtattgaagatgaaggagctgatgttcagtggagtttcgtgattctcccagggtttgtgggaaatggcaaaagtaaaaatcagtgccttcaactgttcatgacatattccttcttgatcacaaggtttcattaatcagagagaacctgtagggaaggtgaatggtgtaattccaaagtaaaatctaacccggatgaatcaaccccatagaagattactgaatatccattatatggtaaacctggtccgatgggaaataaaaacgcttggctgctgacctagaggagccgttcatctgtttggaagatcagacatgccccttggaaagatgagggatgacaagaatgaagtgtgaacctcacatgaagtactgttgggtggcgaggctgtgggtgtaacagggaaattgccacagcctagcactcagtttcctcggcttggtcacaaatgcagaatcttggaaaatgacttcattccctggtttgactgctaagaatcactcaggacgcttgataaattcacagatggctcacctttttttctgtaaggaattacgtggctctgggttggagcttggaatctctctctttctctctctacttctctctctctctcccccgtcctgtttctccctatttctttgtctctgcctctttctctatctctcttccctctctctgtttccctctctttctttgtctctgtctctctctcaatctctcttccctctctctgtttccccctctttctctgtctctgtctctttctctctctccccccttccttttttgctctctctcccagccagccccctttctctctttctctctttgcccaacataatttctactttcaagcaagattaggaaacacttctttaactgatatcatcagactgaatctactttttttcttgctgaaaattggagggttgaagtagaccagcagtcattttcaagctgtttccagagttgatctgttttacgtattggttttccacatatgcattactctgtggaaattgacccaagattttgatccatgcttggcagagggctgtggatacagtccacactcaataaatgtctgctatttaagttagtgaattatagataattatgtagttatagtataggtatcgccataggtacctatgcaaaagtgtgtgtgtgcgcatgtgcatatgtgtgtgaatagataatacagtccctgccgttgggtggcttacatgacactggagagtgaagacatatgctgtgagtggttggcagaggcaaggagaatatttctgttagtttcctgagcagactgcagagtcagcttatcacctcctggaaccttccctcatccaggaaggcaaagccctgcactacgcctacaaaaaccaaagcaaaactcatcagcttcaaatggaaccgtctcacttctgctgtctctgagggtgatatggtgtgggtcccaccacctcctttcctctggggataagttcatccagtctccggtcatctttcacttgtgaaaagaacagggagaggcttaattcatgactgctgcctactttctgcttattcactggctgatttcattaagccctttagaagccagtcgttgggctttgcctcattcagctcccaagcatttcgttcttttcttattttctgcagtttatggagaaaccgggtcgtccttacacccttcctgaaagaaaacagcttaatgaagcagacaagtgctaaacaatgcagaaacacatattacaggtttaagaatgaccagaatgggctgcagaagtgatgaaagggcaaggaagaacatcttcagcttgtccttaaagaggatggagaacatttgaattgttagtggtgcagaaaaaaaaaaaaaaatactccaggcctgatgtgaaagaaggcctggagacattaataacacatggtattcaacaggaattttccagaaactggtctaggcatcactgggctaaaatattacttctgaaggtctgcagaatgctagtgaacaatcgtttctcaaatctgactttcctatttcttgttcagtatgtattcccttgccctgctttccttcctatttttgtgacaaatgtacttataataggtcttaaaaagggctttgaagactgacagtgaaacaagcacttgtgaaataaccacccagagaaggcaaaatctgatttcactaggatgttactggattcctcttccattagatgttttcacaggtcctatggcaatatggggcttgtgatggtggctaccttatccgtctctctagtttagtaaagaaattgtctgagggaaaacagggtacagattcttaggactggccacattcatttgcatttgggccctgaccaagcccccagcacagcccagcaggggctgtgatcctcctgtacactgtgagatagatgcttttgaaataggctagaaaggcaaggaagcagggttgctgctgttcacaagctcccctctcttctgcctctcacatccatccctatagttttggcttagaaccagccacactgtgagactaatccttaacttcagcaggaaacgtcactgagcgaagtcttggtggcatgtcatgttcctttttgagctttatgccccagatctatgtccagacactgtttccatatttaccgatgtctgccctgcatttctgattgaagttatgcagagtatctaggcccaggtgccatctttgactcagaaccatacccttgggactggattaagtgcttacacaccttgcctcattagatcctcatcataatctaagatactttttgtccccattttaccagtgaagacattgaataacagagtccttaaaagaatttcccaaatgcatgaatcaagaaagtagcggtccggggttcgcaaccaaatataacttcatattctttataaaatatgctctctattagaatatatcctcatttttttccaaacatagtttactaaatattttctcgtatatagtacaaaggttgaagttgtgtgaagacattggtatttgcttccctacccaaagttcttgagaaccaaattctgttgcatcaaagagacctggtcaaattgtgaatatttaaatccattacctaaatgtacagcgttgccatgcattgcttttcccaggggttgagcgaggttacccctccccttcctcttcctctgaataaatatgcaatctttgagagtcctcaaagacccctgtcaagctttggacatcagcaggagagttttagaaacatgtcgaggtcactgatagctttgcggaggaagttgagcaggagaatgaatagacttggaaggcacacggaggagctgagagtggagcaggggccaaggcagaggggaagatttagcatggcctattcaagggacaatcggtgctgatttgccagcttggaagagaacaccagtaccattttagacatttaacaaaatgtttttggaaagaacatcagtgaaccagtttggatgagaaccaaatctaggttttgtctgaaacgattgaagtacagcaaatctggggcatcaaaatcttagaattttatatctggtgtcatttggcccaaatgacattttacagcagaggaagatgtgttaagtgtgaagttagttactctgtgtcattcgaggtgacaagtctgggctcaatcacaggctccggctctcaagtccattgctggctccactgcaccgtggagccttccccaaatgggatctgagcaacactgatggtgtcctcagtctggggacctacgaagattacagtgacaaggactatctctgatgcagagatttcaatgggactgtagacagctcttggatatggatagattagttttaccagtcatttggccgcccacatggatgtcagtaactcatggagctgatcattccatctcatgcaaggaaggcatctctaaggcacacatgcaacctctgccatcctgtgcatagagcagatgtcactatctagataccacagcctcctcctactggtcccaggtggcaagagaatggttctcatcagactccttcatgaagctggctttaatcaattggagttggcatgtgagatgaaacccatttgccatttctgctctagtgcctggtgctgaaattagagatatctttctaattttcttcaggccaattcttaatgctttgtggcaccatccctaatctctgcagcctgctacaatggaaatttttgtgtaaggcaaaatgatatccacacacaggccaataataccccacatgatagaaagcccagggaggcaaaggctattgtacttttctgcagaatgggaataccgaagcacctggttcacttttgtaaagaataaaagcaataatgattggaaagtgcttagtactataactcgcactcagccatctatctctataaatgttagctcctccctctcttgcctgatataaacatttccccatactcctatatagatttttgccctgtgtagagttgtgctgtttctgctcctgcttctttgcctacatttttacctttcttctgtgtttttcccctcttttttctgaaaagaaaaatgaggcaaggtattataaaatttgcaaaactcaaatctaaagcatggtgtctggttaatagtgggagctcagcatcacaagtgttagattgggtggatggttatagacatagagggtttaaaatgactgttttaaagcactgccattgcatgaccccctcctctccctaatgatcctccccatagagtgaaagttaaggggaatcctcaaggggagatcttctctggcccatcttctgcttctctttgctctaaatctcttacctccaactcctaccattctctctctctctctctctctgtcttgatccctctcccctaatccctctcccaatcccctttatttcttcttaggttactttcttctttattctctcctccatccattctgctttgccctttctttccctccctccctccctccctccctccctccctccctccctccctccctcccttccttccttccttccttccttccttccttcctcactccctccctttcgtctttccttccttcctccccagcttcccttgtctaccaactcatggcctacccttcttttcccgtttccctcagggcttgattaaatcatggctgtctgatttaatctcaactacccttgttctgttctttctcttgccttccagcagtcacatctaaacctgaagagaaacttggagaaagagaatggactggatgaagcagctaaacaagcttaagaaaaccacatggggaggaggaggtgtaggaatgggaactctgttctgtgtttccttcagctcttctcctttaaatacggctcttagtcacaagtgtgggttgttgctatgattcatcagtgttgttttctcagacaaaagacaggaaacatttttggagaaaactgaaatgaggactaggttgcattctttgacaaggctgaccttgcaagttagtcaggtaaacagatgtttgcattgtgattagggagccctgaacagaagtgtctgtccccaaatcaactttatagccagtctttatcataatgatttactattttagatcaaaaggtttttttttgttttgtataggacctgcaaacaatagattgttaaattttagctgcatatatgtttgttattccctatacaccttagcttgctgtccctgtagagagaggaactccagctatgccttttggggcagaagaatatgctatgaagaatagatagggaaactgacatgaaagtggttaacactatggactgactactagtttcataatgatcagcctttccctccaaccatctaacatgacagatgtggaaatctgtatggccaggtgtgcatgtaaaagctaggacatagccaagtgtatggacacgcacagttatttggaagagattcaacccaggttgtttaaatatttgactccataccctagccccttcttcctgcccctgaagaaggagaatagaaaatgaagtagagatctgtgactgcaaattagcagttaggatggttgtcttgctggagtgatttgaaaaggagattgcacctgagggagacagagtcaagacactaatgccaaatgtgtcattttgaccatttactgaagtgcaactctctggaactctgggctatcaattagtgtaggatttgcagggatcattagcctaaagagggacatttttacttggagtacagggggcagctattcttagctcagtatgatctctgtgggagagttcttactggtcacaaatctctaaagtcattgatttcctaaaatatcaattatattcactgacatgttttgcaaacttttggacaggcgattgtcatggctcactctgctcagtggttttgataaaatatgctgatgaaagtcatcagattcttctcgggggcaatgatcaagaagataggtttttggggaaaagaagaaatttaggaagctacaggaaaagcaaatcatgcctcagggtatcagccactggcagaagttgtgattgggtttgaaatgtttttgacaatgcaaaggccagagccagtcaggctgtgaaaaccgaagcctggtgctctaatggtggaaaggaatttaactgcaattactccaaatgtgattttgctcatttgagtgatcagtgttagagaatcctcagcttggtactatgagaggcacttaacctctaatgggagtcagcacagctgagggctttgggaggattgacacagccagcctctgtgagctcagtctagtccctatcctctctgggccacagctttccaaagaacaacatcagaataataacatctgcccctctgccacgcatgggtgttttcaaagcaacgtaagttaaaagacggataaataatgggccaatgtaaagcacagtttgtataactttagccaactctaaacaccagaaatttacccaaaaaacagtgccaattaaacccacaaagatcagaagtccaagtagcagcgacaatgtgccaagtacaaatggtttcctgtttatatttttcttctctataagctcagggagtcctgagattgtgtcttttgatattttatctgttccatctatatgaccccggaaacgattccaaaattactgatccatgggtagatcagtcttagaccaggtttgggagtcgtcaccaggccattttcaagtggaaaaggagaatgtcttaaagtccattcacacactaccttaacattatgctttgctcctggatattgcctacaaatggaaatagatgtgctagcctcttctgtaatgcaatccatggatggggatataagacagcataaataacatcatatgatctacacttcaaagaaagtatgaagcttcttttaggtattgtcagttcatgccaagatatgattctaagatggaattaaatgtacaagagatcttgggaaacacacctgtaaatgatgatgggagtagacatgatgtttgggagagcctcagaccatgatgcaagcctaacatctgtggatggacagaaagaaagaaggattatataggaagggccttgaattgcagtcctggctgtctcagtcaggctgatgggaaggccctgaacaaagtctattacaggggtcccgcattaagcaggaattaccactgtagcctccatgctcagtagcctctgtaaataccatggcagcttcaaaggagtagcgagttaaagctgtcagtcaactgctcttcacagcaggttgtcttgcagggagagatgagtaagacaccttcatggtcatcacgggtgttactgatacctcctatcctgcacttctcagccctatgttggaatccctagacacctctagggccaggtggctttgctgtatggccaggctatctactgttggttcagttacccaattaactcagcagtcaccaatattctaggcaccaatcaccactgttagtgaatttttgctacatgtcagatgccaagctaactggtacgcatataagatcatctcatccttaactacaactctataatggaactcctgtgaaaatccccatttgacagatgaaactcacagcataaatcacttgttctgatccacataactggtaagtgatggaaattcctttggaacctggatcggcctggtcacctggctactctactgtgcttctgcccatctagtgcaagtctgcaagtctcccaagtaatctgggagtgcaagtaacctcagaactatgctaagtcctggggattttgtgattatgatgagagtcagaactgaaatctaaataaaaaattatgatacaggtcagtgtgggaattgctcagagcactgagataaactggagctcagtcttgcaggatgagaggggattactaacctgatcaaaagaagaagagaaattgaggcagaccaaagtgcatttgccaaatcacggtggtgccaaagagaacctataaccctttcacctgctcacaatttttccattcagtgttctagtcaagctctgctgttttaagataagatctacttgcctggaaagcttatgtttattaaagcagccatttaaaaccattatgttacatagagatcagttacaaggtgtagttcaagtaattactacaaataattaaagccctagaatttctgcaggctttactgtttctctaaattggagcacattcaaggtaattcccattatagagcagtctgtcacgtattccaactatttttcatgagtgggagaaaaagagatagagttacaactattgctccaggagctgcagttgggagtatgtctcccactctcctacatgaatatcatctgccatttgtatatcagtgagagaaaatgtttgaaaatcactttagtaaaaagatgcaagttatgtatacataaaacatacctgtcaaagtagagaaagattaaacgacagggaacacagtcaacctgcgatggtggttgtatctgaatgcgggaggtggctagaacctagaatgagaatagagaatactttaactcaaaacaggtatataagtaaacagcaaatctgctttgaagactgtgtttgttatttcttgtactcttttttttttaattttctgatataaagttgctttttaaaatgttaatggaaaaagaaaaaaaagaattcatgaagcccagataaataggggatggaaatagaaatgaggcttacaacaagagtaggccaactctaagaaaatatattaattcgccttgtgattaaaaagaataatactgaatctatatatgagagaaaatgtcacagctataccaaaaaaaaaaagagaagaattgataaaatccaaaaaagcatatggtttagttcattttattgtaccaatgtcaatttcctgtttttttgtttgtttgtttgtttgttttgagacagagtctgtctctgtcgcccaggttggagtgcagtggcgtaatctccactcactgtaacctccacacccctgggttcaagcaattctcattcctcagcctccagagtagccaggactattggcgtgcaccaccacacctggctaatttttgtatatttagtagacacgagatttcactgtgttagccaggctggtctcgaactcctggcctcaagtgatctgcccgccttggcctcccaaagtgctgggattacaggcataagccactgtactatggtcatgtaagacattatcattgaggaaagctgggtggaaacatacacagaaactcactgtactattgtaacaacttataggtctcctactatttcaaaattaaaagtttataaaatggtaatgacggtataaaattctatctatttctaagagatttttgttcttagaggggatttttatcatcactgcactagaacctagaatgaggatagaaaatttactaaagagcatagctctctaatagtgacaaatcaggtagggggtagaatcttccaagacagcccacagattccatggctctgatttttttccacccaccccaaattctaagcctcaccatgtgttcaattattaaacttgtacatacattctctcacatgttcttaaatcctcaagagcagtccttctaacaggtgtcttgtgtaggttattaaaaactatcagccgggcacggtggctcatgcctgtaatcccagcactttgggagcctgaggcaggtggatctcctgaagacaggagttcgagaccagcctggctaacatggtgaaaccccatctctactaaaaatacaaaaattagccagacgtggtggcaggcgcctgtaatcctagctactcgggaggctgaggcaggagaatcacttgaacctgggaggtggaggttgcagtgagccgagatcttgccatcgtactccagcctgggtgacaagagtgaaactctgtctcaaaaaacatgtatatataaatatatcttgtgcagtttaattttctgcttggatgatatgcctgctattgtgatgtttgtggaagtgaagacgtcttagcacgtactgttagctagagcactttggaggagaagagtagacacattgctactgaaagcttcatgctgccagccttacatgagaaccttgggctgtccttgcatgcaggtgggagagagggctgtctcataagcaggacttcaaggagtcgtagagacaagactggtctccatctgtttcaaagtttctttcatgcatcttccttccagatatgctctagttaaaatataaatgtatcacaggagagagacacattaatttctctccataaaatccgagtacgtgtttatgatatactatccaagtgcaaagtctagaagcaatataattccctcctaggatgggtggtgtaagggctttatcattgttactacctttgaattgattatttatttctatttaaagtaacaagttactcttggcagcccaaatactcagcagtgaactggaattggagaatgggggtgagagtcaagagcagaacccctataaatgcaggcattgatgtgagtaaaactaaaattagcagaatgttaataattgttgaggttgagtcacaggtacatggggacacattgttattctctctattttgtttatgtatatttgacatgttctatagaaaaaaatttaaaaagaaaaaataagtgattttgtattccaatgtattgtcaggagattattagatgttataataattttcaaaagaaggtaaaatcatgactcatatggatataaaaatgaacaccttgttatggattgaactgtgtgcccctaaaagatatgttgaagcctgaactcccagtacctgagaatgtgaccatgtttggaaatagtgtctttgcaggtttaatcaagttaagatgaggtcattagatgggacctaatttaatatggctgatgcccttataagaagagggaattttggacacagacatacaaggaggacgccatgtgaagacacagttggaaaagcagggaagagatggccttgtgtataaggaggcagagactggagttatgctgccacaagccaaggaacaactggggctacctgagctggaagaggcgaggaaggattctcccctagagggttctgagggagcgtggacctgccaacaacttggtttcagatttctagtctccagaactatgcagtaataaatttctgttgttttaagccacccagtttgtggcactttgttacgtcagccctgtgaaacaaacaaacaaacaaacaaaaaacaagttaaatattttatttaactcataatatggaaataggtgaggtgttacaaccaattcaaaaaagaagtgaaaaataagcccaaatgtatatagagtaaaggaatgttgaaatgaatgtgcaaatggaagcaaaactagattctcctacaatgggacagaaaagtcaattgaacctctactggacagaacataatttgcatgtgtatagaaaaaaattgtgcattgttctcagttcacctacaatttacagagtcgcaaaatagctcctgttgcatcagaatcagataaccttgacaggtgttctttaaactacgggttgttttctactgaactacataattttctctatatgactaagcaaaacaattttaaagccttcaatacaaatgctcattatagaaaaagaagaagaaatgaaaaagaatgaaaaattagatttaagacagactatatgtactgaattgtgatagttgagaaagttaatcaactctgtgacccctgttcctcattagtaatatgggaataatactattagtgcctgtctattaggtcatggtgagggttaaatgagataatgcactcagagtacgtgacaatgactggctcaaggtgttcaataaataattgccattattgctattattattttacagattgttgggaaaattaacccagagaatcaatagaagtgttgtatattatcaagtattcttcaactctagcttcacccaacaatcattactaacttgaatacaggacttgttttaagatgagagtaggctgaaaaggttgcaagctagagtaggatagtgtctgagaaacacagagcaagaaggaggcctaagaatgaagggagcaaataagagtaagaagaggggcatggagggaggaggcagggatgagacaaatggaaccaaggccaattgatggttgctgtgcaactacgctaagtgctgaccctcccccaaaccctttggttggtaaatgatcaccataatggatatgcaacccgctaatgacccagcttgtaaaccttccaggggggtttgcagaaaacccgttaataaacttcaacttcatccatgtgaccctgagaccccacttctgagggcagacagaagaggaagtgggtattattcagatgcacagggcaaatggaattaaggcacactgatgactgggtgcctgcgccatgccattcatgaggccagctttgtctcttcagcatctcactcaaaagagcacttctgccaaaaagccaccacccctgttctgcctttccggttgtgcttcaaagccgttattgtgtcacttgctctgggcttgaaattgttccttagatttcttccccgaaagagtttacagacattgtacaaagaaattaattaagtagattttccatttgcacaattttaatgaataaatgatgttcctatttgtttatctgctttctaattataacacaattcaaaacatcttggttttctgcattccgacaatgttattgttatggtggtgttattgctgttctctcagtgcaggtaatattattttttttagatagatgccaggtgcagtattccatatttattaaaatgtgatctgcatatttttctcttttcatgtactgcttatctgtacaagagcagaaagttaaatataatgctctgcattaaagagcctgaaaagagtttcacagacagtctgaggatttgtggtctggtgtggggattaggcttgggtgatgcagttcagggccaacagagagagacttgggctaggggccaaccagcaggacctaactttactgctcctagcagccaacaggccatgaactctggcaggaaggcctgacaaatggagttttcccaaggagacagatgtcagcggctcaaaagccagcaggcctgaaactcatggggagcaatctagagacaaaggaaggagggctctggacaggagatacagcctcttccttctttgtcgtagagttttgaggtgggtagaccagaaatcataagtgtttgttacagacagaattcagaggtctgtagaggaatcctgccttactgaggttgggcagatgtcccacgtctcttttctgccctctcagggtgcagggaagcatcattgtacacttttgcccttgactggaggagagttgtctgtaaatctgtcctgacctcagataggcacttgagaaccatccagtttaatgactgattgtgggccccctatgatgtgtcattcacagagctaagtgctgggaagacagtcctgttcttcaggaatttacagtctagactccagaaactgcattgggagacctctgtaaatatgagttgcttggctccctgaaagagttatatccttggcctgccttgaggtcaaatgctgtggatactgctcacagtggcttgaaattgcactccttttctccttgtgcactccttataaccccaggggtaggaggatggtggtataaaacatactcactgtccatgcttgctaacccatggtaaaaggcagtgtggtatagaggaaggaggattttgaagtagagcgatctggaatcccaaatatttcctgccttagtgtgagatactaagtaggtaaacttaatctcctgggcttatgtatcctactgtgcacaatgacaacgtgattcttggtttttgtatagtagttgcagcatttagatgaggtaatagttgtgaagttcctgagaagtgcctggacgttaataaatgactgttcttgatgcataatgactgttcttgatgcataggcctgcggaggaggcaagagcattgtatcattgtccaggatctgggaaactttgccaaaacctggctctgtgacttggtcaaagtactcaacctctcagccttagcatctgatttgtaaaatgaggatttggattagaagacctttggcaggaaggtcttgtgatttattgattgctatagtcaaccattgccaatgctaagtttgttggctttcttctatgaatagtcaatgtaccctgcttggactcttccttcttgtggtttccaaaacttgacctctttcttatgcagtttcctcccagtgagcaccctagtcatcctttatcctcacaactatagttcttttgtgttgcgttctgagcttgtgccttacttctcagggattttgctactgtggacactttcatcttttgtatgttatttcctgttcctttctttggtgactttctttttgtctgtactctttggcctcttgcaaaaagcagggccattgatctttatacccttcttattttattttcgctgagtctgttgattaaattgtacattggccacatactatgtttattaatgaagccaccatttaagaggtaataaagtctagtgtaattggctttattgcctctgcccaacctctttactggacagaaggtcagtcaaatggatagacacatgtttatctctttacaatagcagcacacaactgctgctgcatgaaggtggcctcttcattgcctccctccgtacaacatgtttatgttatctttatgtgaaaagatcttctttcctgatcagccatcagtgatgtgctccaagcacaggaagtgcctgtggtacccaggaattgcaacagctgtcagaaataaaagatatgtctcttgttcctgagaagtttatagtttactgagggagaccacacagcacacagggagttacatataatctgggctgttatcttataaggcagaatacagatattttgagaaacctaccacagtccaaggtggtaaaggagggtttatttcactctacactgagcctaattgagggataggagtttggggctgctaggaaggaagttataggcaattgaatttggctcagtaaaaggatgaactataaaactgtcagagttgctcaaagacataagaagctgtttcatgaagtggtgagttccctgtcaaaggtggtaataaaatacctgatgggaacattttgataggagatacgaactaacagtgaattagcaaggcaatttaaaaaatctccttgaattcctgggagtctgagacttaagactccctggactagggaggtaatgggaaagttctttgaagaaatgggactttgaggtcccgttaactaatgaaaggctagttaagtggaaagcactggaaaggtgctctcaggcaatgggatagaataagttaggagcttggacattggctgatactcagacgtaggaccatgcacataggaatccatgggatgggttttagaacagctggatctcctgccttttttttttttctaagttccttagccattcagataaactagggcatttctattgggacttctgtgtatttttggacacttgatcattccattgttgggattttaaacaacaaagtattgtgaatagagtgtcttgggctgcagtttctcaaactgttttgctgggggacacatgccccaccccagcatggcttcataagatggaagaattagctgttagagctacaggtcattctggtggcatatggacaagttcaaactcagttttgtgtcaattttacaaaggagaagattaggtgtggaaaataaagaaaaattgatatggaattccacagagcatcctggaagtatgacaaaccttcaatcctttggactctattaaatccataaatatcttgtatagcagaagagggaataaacaatcaattcaccccagtgtcaacagagtggtcttagaaaaacctggatctgatatggctcctttgcttaaaatcctttagtgttgcctgatcacctctaataagaacatcaaccttcttggggtggaaaaaaaggcagttaatgattgacagcatcaactttacagtcccattgtttggggataaatgttgatcttaggctagttacatagcctatctatgccttggtttctccatctgctaaatggagagtattgtaatagcacctgcctcatcaaattgttatgatgattacatgtgttaatatacattaagcatggagaatagtgtctggcatgcaaataatattagtactgggttttgtaccccctactcactgtgagcttcttgagaacaggtatcatgtgctttttgtgggcatcttcccaagtacccatcacaacacagggctggcacatgatatgcatgaaggttaagaacacaggttgagcagctggactgcctgagttcatattctggtttcatcctgggaccatctgcatggtactaactctcctcattcttgatttttctcatctgtaaaaatgaggtgaataaatgagacaataccagtaaagcatttcatttagcacaaagcctgacactaaaattgttagctaatattatccttagagatcaataaaaatgcttgcagaatacatagtcaacattccaataaaaaataccaagatgtgtccactttttttgtgcccctctcccttttttgctgtcgtagtggccaatcaattccctgtacctcaatttccatgttgactatatggtgataattctaccaaatgtttacttcccagaaggaccaagaagatggatgttcatgtttttaaagttgctctaagcgacctatggaaaattgcaagtgaaaagtattgttctcatcatgattattaattgattctccaaccactcatcagttggaatatgactgatccacagactctggaggaagatttatcacttgcctccccaaacctatggatgtgcctttcattaaatgcaattatctcccagccaatgcacgcgtcttgagtccaccacctcttactcaatgaaatcattaaacctctttgcagcaaggagccgtcaaaagccacctgatgaaaaatgaccatggattggtatttgcttttaattatacaatatctgctcttggagagtttcaaggatgttgctctgttgtctctgctccctctgtttttttcttttattcttaaatatggtttaatactcctttccatttctgtacatcacaacaccaagattttactgcttaggatctgtctgtaaaggcaatggagaatgcaaaggctacagttttcaccccctcttatgtatgtgtttgtatgtgtaagtgtaatacgtatcagtatatattgatacacacatcaatacataatacaatatatattaccaaagggaacacactgattaaagaaacacaaaaatttagcatcatttccaaacttaaatagtaaaaataaaaactacaaaaggagctgcacaccctaaatgtatcatgtgaaacaacaagcacattcaaaaatgtaaatttacatccaatttctctggtcttgtcatatcacatcagacccatttacaatggcaaaaccctaaggtactgctgtgaagaaagcatgtttgcttgctcttgggtgttctgcaaacaaatagcagagcccaaagcaaaaaaagcctgtcccggtgaagtctcccacattggtgaacaccaaagaatcaactcttctcactgggggttgagacatcaggttacacattgacagacagtatttggacttcagagtacagtgtgagaactagaatctttacatttaagacatatttcctttattcaagtgaaacaggattattggaacaataggcaggtctgtaacctgggaacaaggagttggttcagaccaataaagctacgagtgactgaatcaagtcagcaaagaacaacagtcaggcacgaaagtgttaaaagtacccaatttgaaaaccaaatgcaccccactatcctagttagtgtggaggtgataccaattgacttttaaaacctttggtccttcaaagtccatttggtatactttttatcattgctaccactggccacatactatacactttgttcactgtcaccacctcgggcatgccatgaccttgcatgtcagctgggttcaagtctgacttacagcccagctgtgaagcataagcttcagggtttcaggccaccttttggatccaacatggtcttaagtccatggtgacagaagctctgtcctatcccttcccacccatccctcatttctcatgtgagaggtgcttgtacgtcccacatttgaaacagatgctccaaccccaccaggaggtcaggagtttataattacatgcagtcataaatgtctgtcattcctgtgaaaaaccttgtagttcattttaataaatcaaaacattcacataatctcatgccatccaacacaaggaaaacacatccacctcccttttaacagggattgacccaagcaaaagaaaatcctctttaaatttctttgcttccacttaaattgcatgttttatttctcccaatcccagcaaaagcagagaaaccccatcatatccatcccaaactgattgcgagtagattaaggttatagggacccttgtcagatgcttgatacaaagggctcccaaatcccaggcacaaatgtgtctgcaaacagatggaagttaacagtgcaccagcccaaatgcttcatgattcagtttgattttgcaatgcagtttgcatccttgaaactgccagtctgggctccctcctttttaaaaatgtatttatttatttatttattttactcagccctcccttgttactgttttagaatgtagaataccagtgtatgtgcttcttcttaggaccgctccataggcaggagcctgcctcaggaaggatggacatatttgagaagggtgatgagtcactcagggatggctgtctagagctctccctttctgacatcctcaccaagaaagaaagccctcaaataaatattagtctttgtctcgcggaggccacaattcaacatgtaacacagtttccttgaaggaattttttgagccctcttatattagctataaacagacttaccaagcagaggatgaggtttaacagcagtaaggttcaaaggagggtggaaggctgagataatccacaaactggggaaaacttggggcatattgtgagggagggagaaacattaaagggagaaagaaaaccaccaaagataaatatccaccccctccaaccctgtgagctctgcctcttgccggcctcatcttacagaaagagcaagcccaagtgaggtgactgtaggtttggggcagacaacataaaccaccatgaagggcaatttctgtaggctgagttccaccagtgagatggagcagggatcactcttaggggtctgcaaggcccaaagcatggaaataaaggaaaatcttgagttatttcatgggaaatttcaggcatctagctagccctgagaagtaagtgagcaacttgtcaagcaagaaggtaatagtagcttaaaacagtatcccagaaagaatcatgggatgtttggttccctacaggaactaaagatagcattttttttttttttttgagacagggtctcactctaaagataacgtcttaacatatgtccctgagttgtttttcagaaatccagatccccaccaaatggatccgctggcacatagacctcagataaagaggaactgaggactgaattctgactgctgttctttgttctgaatttcttcctgaggggcctggaggtcagatgtaatattctgctgatcccaagcttttagagaaagcttcgcctcctaaaccaattgcaaattagaaaaattttggatgcacctatgtcttatgagcccctgcctcaagatgtcccacttttttaggtcaaaccaatgcctatccttcatgtatttgacttatgactttgcctgtaatgtctgcctccccacctttaaaaacccttacctgtaagtcattgggaagttggagtcttcagcgttagctgctcacctcttcttgcttggtgccttgccataaatgcctcactttctctcactgcagtccctatgtcagtgtttggctttgccgcactgagtgagcagaccccagcttggtttgataacaccagcaagagagtatttgaggatgtcttggaagccctaaaatgaggagcaacaagaactgttaacagatgaaaaaagcagaaaatggagtgaaggaaagaagacgtaatgaagctggctatctggagatggaacattcagtttctcagttgcaagtctctgaaataccctgtgtgtagctgagatattttcccaaagttccacaatgcatatgagcaatgaggccatacaagcttgtccaacccaccttattttgttgttgttctgctttgttttgtttgttttaggctttcagcagcccaaagccatggtttttagtttctgtctctagtgattaagtggaaatgagagatgcgaaaggggctttactggcctaaccagaaacagaaactaaggacccatgactgtattctctcccttggacaaccttgtatggagtaacaaagggccattggatcattcctcaggtgccccatcaagattaactaccgttgacaatgcctcataatgataagtggaaaagagagatgaaaaggggctttactggcctaaccagaaacagaaactaaggacccatgactgtattctctctcttggacaaccttgtatggagtaaggaagggccacgggatcatcccttgtgtgccccattaagattaactaccactgacaatgccttattctccagcagctcaggtctttgatgctaggtgccagtgctgaatggatgtgaaagttctctgtgcactttgacttacggcccaagtgtccttcctccaacagccttcctcagaactttacgctgatatttagtcacaagcaagtgaacattcctgaaggacatcagaatgacttctatgtatttttttgtgttatattatttgggactgtcaaatcataattgaatatatttatggagtataagtaatgttttgatacattcatacattgtgggatgatcaaatcgagctagtcaatgtatctgtcacctcaaatattcgtcaaattttttgtgagaacacttaaaatcctctcttttagctattttgaaacaggcagtacattattacttattgtaatcaccatgctgtgcagtagaccaccagaagtcattcgtcctaactgaaacttcacactctttcaccaaagtctcccctttacccacccatggaccctccccaagaatgaacaatttggagtagaagatagatttcacgatattacgtaaaatacattcctacattctcctttcaaaaagaagcaagaaataaaaaaatcaaaaacatcaaagctaaagcagccctaagtgtaacttgaaactgcctgaaggagggcaggggagggatcacataattgcagtgagaagttctgttttgccaaatacttgagtggaaaaattattgttccaaagacccagtaagtgtgacaacttacttgtcaaaacattaattcacattttgctttgatggagagaatttagattttaaaatatatctgcaggggtacttaaagcagtcacatctcatgtttagtatagttgtcattaacaatttcaaagttttgggggctagaggtctttcccccaattaatgagactaagtccaaaaggcttctgaccctctatgttctttatatttgatgatgctgccttgttaggtttttgtcacttttgccccgtgcaatcttttagctctaacacaagtgtttcttacttataaaaatagtaggaagcttgaggtacgtagacaaaatgtgacagtagtgatattagtgcagcgggttacagtcctatccacatagaaaatgaaaattttacgtcctaagcaagaagttggcagcatgcaactgtaagaggcaccacagattccccatagatgcacctggttaaaagacagcctcctccttaacaataccagaagaaagctatagaacttgtgagtttataaaaatttaaaaagattagttaagatctgaacccgtaatatgaaatgagttttatttaaattcctaaagacaaacaagtacaaatgtaagaatacaacaacttatcaataaggcagtttcacagcagtatatttctgaagctgctcaccagtcacttcttcctaagtcatcactggaacacttagaggacggtgttgagggtttttccctgtcagaggcctgagctgtctcttactctttatttgtcctcactcatttcagctggtgtccattgttatttttcactttcgcccaagtcacttcctattaatccagttgtatttgtctgtctgtagttgatcaacagagctgagatattttgccttaaccacacaatcttcattaactgcattagtgttgttcttcatttgtttctcattcattatttctcatcctgaaaatatttatggaatacttactctatggcagagtttgttactctcatcacaactgacgtttggggctgagtaattctttgttgtggaagattgtcctgtgcattgtgggatgtgtagcatcatccctcgcctctacccactagatgcaagtaacacctctccccccagctgtcacaaccgaaaatgcctccagacattgccagatatcctctggaaggcaaaatcacccttggttgagaaccactgctctctgtcaatcacggttctagaagctatggatacagaaatgaagaaaatcttgaaactgtaaatgcatgcaatataacatgttgacataagaaaatctccttagttactagcctatgtgccctgtttgaaataaatgatctatataaaatccactgcaggctgggagggtatttatagacccacaaggctgtaggtggcagcaaaaggcattttctgggttgaattctccctggaagggtcctcttatctacactcaaagcatttttctccccagtcattcatccaacaaatatttattgagagtccactggttaccaggcatgttatgcttgtttccccttctccctttgattagctttctccatgacctccagaactagccactagccactgttgggggttttaaaagctattcatttgcagtaccatgctgcctccccaaagcatttctatttaactgccatgtgcctactccatatggaatacacaggaggtctggaaattcacgattcaattaacaggaatttaattagtgcctactctttgtgaggtagattaagaagaatatggtatgtgtccttcacttgaccatgagccattctggaagttgggacatcttgtttcagaagccctgggagcgttttcctagcagatcaaagtctaccagagagaactgttcagggtggttcccacaaaggtttatagtatccatcatcagcaatctaatgtgtatatgactttacagaaaaggtttcatttttcttttaaaaattctccatttgccgcacacacactggtaacttggtcatagttgctggggtggattatagatgtctaaagatgtctcgtgtaatatttttaccacttctgccattgagcagtggagtctatttcccctcttctggagtctcctagctttgacccatagaatgtggcaggagtatactctgtaacttccatggccatgctgtaggagatctgcggtggctgcttccagccatttgcagtactttctcttggaatatcattgcaatgctgtgaaaacctcaagccatgcagaggagcactgaggtgctccaatggacagccctagctgtctcttcaaacagcagggagccttcactggcagccatggaggtgagactattttgaattttccagttgttctgcagccctagccaataacacgtggagcatagattagctgtccctggcgaactctgccaaaattgcagaattgtgagcaaatacatgatgttttttgttttaagccacagttgtttcttggattgttactcatcaatcgattcaatagacaacaaagacagttacttctcaaaatttcttccctctgaactctctccaactttctgctgattaggaagtccagtccctaatggcctagttgactgtccctggcatgggctttcaatttagcttctccatccatttttttctctatccgtgatgaattgtcttgcctttggggaagaaatagaccattccccaaaacttacccacttactctttcttgctcttacttgagtctagatttggaccacgagactctcactttaactggttaaccaagaagattgatcattttctagttatagattcaatttatactatcgttttctgaagtaggaagtcccctctggttttttttttttttttttttttttttttttttgagacagagtcttcctctgtcacccaggctggactgcagtggcacaatctcggctcactgcaacctctgcctaccaggttcaagtgattctcctgcctcagcctcccgagtaactgggattacaggttcccaccaaagtaactgggattacaggtttccaccaccacgccctgctaatttttgtattttgtattttatttatttatttatttatttatttatttatttatttatttattttgagatagagactccctctatcacccaggctggagtgcagtggtgcaatctcagctcactgcaatctccgcctcctgggttcaagcgattctcctgtctcagcctcccaagtagctgggattacaggcacacaccatcatgcctggctaatttttgtatttttagtagagatgggatttcactatgttggtcaggctggtcttgaactcctgacttcaggtgatccaccggccttggcttcccaaagtgctgggataacaggtgtgagccaccatgcccagcctaatttttgtatttttcgtacagttggggtttcaccatgttagccaggctggttttgaactcctgacctcaagtgatccaccaactcggcctcccaaagtgctgggattacagccttcttttgaatcacagggatgttaatcagtgtgcagtaaagactgaacataaaaatggcgaatggatataaatgctgttgttgggaactatggtcctagctgaggggcaccaagattagaagaaaacactcaccacccacgatgaactccaacaggactccctgtcagattttccaacaaaatgccccttgtaaatcacttttaggggcctttgaatccctaaatttcagcaaagtcctgttgagatgctgtatatgcttttcttatatgaaatatttaatggtccatctcagccccttgtagcaggctaatgcatttcctctcctgttttatcagcagtgttttgtgttagtcatttataccacggggtggacttctcagcccctacctccctgcacccacccacccaatcttgttatgatgttcatttgtcacatgcagtactgtggttccttagagaaacacaattgatatgccatcaaattgctcctgacagagtggttttaaaagcttttagagcggatgtacaggggaaagttttgtcttcacggagtcagtgtggctcatctgtctttattaaatgtctaacagttacactgaacaagaatgacattttaaataagagtaagtactgcttaactttttaatgtcatttttttagagccaaggatttgaatttttttggtaaatgtacatagctcagtttataatataggctttcatttttttctccactctttcctccattgcaaatatctaaatgtctctattttcagttgagttggtagaatctgtctctcttgagatgttcggggatttctttttaaaggcattggcagatttctttctgtacaggcttaaagttagccagtcttgtctggattcagggggttacaaaagtagcatcagcagcaaagactgctgagtacagggaagttgggaaacatcatgtgaaagacaaggaactggatatttacaagtcaacagtcaggtgggcaatagaatcccaaagaatacaaaggctaaatgatcactgatccagctggcatgttccagtccttgcaaatagctgcctaaaggcctctaggcctgcaggggcaaactgaggcaggagctcatgtgcactgtggggcaatgcacccgagagagcagaggagcagcaccagaagcaaagtatgggccttaccaccaaggccacctgtcccagctgcaggcctttattttaagagatttgattctggacgagcatagttttcccaagctctttgctgaatttcagttttatttctctgaggctttgaaagtttatgaacgtatgccatatagagtgtagttttccttaggttccataaggaaaactgtcttcctcttcaaaataaaaccaaactctcctaggcttggcactggaaagagcatctccggatgagaagagaaggttgaaccactggactcctctgtgccctaaatcaacttcaggctgcagatcatcttctttattgctgccttgtgtgctccactcctctgttcagtggatggaaatctctttcacctgatgtgtcattagcactgctgaccaaactggaatttaccaaattaaaaaaacaaaactcagaaaagcttcaaccttctgacttattttgttattttttttttttttttttttttaagacaagttatttctctatcatccaggctggagtgcagtggcgtgatttgatcatagctcactgcagcttcaaatgcttgagcttaaggaattctcctgactcaacctcctgagtggctgtgactacaggtgcatgccagtgtatccagctaatttttaaaagtgttttttgtagagacagggtcttttactttgttgcgcaggctggtcttgaactcctggcctcaaacaatcctttccactcagcttcccaaagttctgggatgacttataaaatacatgtttttgatcctgttatgagaagtctgtagaaacgctacctctagaaaatgtactgttcacactccaagatatttctctatagatggacatgtacatacacatgcgcacacacacatcatatccatttaacagggctcagcccaaatgtcaccttctctgttcactacagccaattacagtttcttctttctctatgtcagggcttttctaataatatgtccccagcccttgtagtgctccaggcattaggccatagaaataccccttaatatgcaccatttgtgtagcatacttacgtaactgtaggcctagcagcattaactaaggagattgcctgtgtagacactgaaatttccaactgctagttcctttccaagtcatgttgattaggtttcttaaagaggatcttcaactctagattcagggaatactcgattagaatggatcacacacacacacacacacacacacacacacacacacacacagtgtattcactttctgaaagtttattagacaatgacccaagatgcaaatgtttagttacaattttaagccacattcaagatcttgtttaaacacaaaaaacacatgcctgaagaatgaagagtgaacgccaaagcatccaccctaggcctgttcattatctcctgcacctccacctgcatctgttggcttcttgggtcttgtgctggtcatccccaggctccagaggccctctgcacatcttctcagggtctgattagtatggtcaagtgatttgttgccacactgtggaaaatctttttctgagatggtcacgcctgcattactgctgccaccactgagattgctgtggtggtgctttcatttggattttacagcttggcattttgccatctgtgagcccagactctctctctgtctgtcttctctactcattacctcctctgaggcttctctttctgacttcacaattccatctcaaactttacatcctctcagggaccctgactttagctccctggccacagggtctcagtctcactggccccatctctcttcttcagccttgaggaccttgcatgccgctcacttgctacactttggtctcacatcctcccactcaaaaagtgatggaaactgaggcttctggggcagatcactggggtcagattgggaaaagcctggaataccacaccaaggaatttgcattctttaggggatgtaaagcctgtttttcatgttttcaattccaagctacaactttgaggatttttagattttggaacacatgtgatttggagaagggcttacagtctctcaggggaccatttggggagaaaaaccacacagtatgattattgtatttaaataaacactggtgttggttcagagcactattccctgtaattgcctacttacagaagtatgcaatgctagaacaaaaacttcacctgttttccccgtgtggtttctgaaaatggatatttacactgacacagtacacttttttcaacttggaaaaatatatcacccttttattttcaggcagatcatggaaccatttgttttttaatgtgagggatggtcgtgggcaggtaagctgctggatgtggaaagggaaccagtctcccatcactttctcctcaggtgaagttgaaagctcagcctgttgcccacgaggttagctgtctagaatccacagagggccatccctgggcaaaaatgaagaagtaggcaggggcatttctctgtaagcctactttaatctccccattctcttttatgccccactctccaggcctcattgctgggcagtttcgtcccaggctctgtgccttcaagcagctcagaagcctatgtttccttcctgtttggtctatttatatttcccctccaagccaacacactgcctttccttccctgtgacagtgatattcagatttttccttctgtcttatctggattcaatttcataccaaaccaactagaaatggagtttagttctcccaagtgaataggcacagtttctcttgagctacagtctagtgtggagtgtagagtcctttgatgaggagttctaacactaatgacaagctattgcttctctttgaggcttgatttccatagctgtacaatgattgtgaaatatacagtaagagccacaaaatagcctttactcacacagcactttcaggactctaatggcaccccacacatttcttcccagattgctctgagcatcccctagtgtttctaacacatatttttagaaagcacttgacttggcagtacaagatctctgccattgtcttattccttcttgctccttctcaccgtaagcccacatagccgtgccaccagcatccatgacaggctccaccactgttagctgagcatcaccaaagtcctcatggttcctactggtcccgatttctgtgtaatggctggcactacccaatgtttctggcaagggttgccatgcctgatgtctggggtccagctgctgctgccagtgctgcctcttctgctgccaaccccactcttttcatcctcctgctgcttccaccaacatttctgctgccatcgccaaaattacagatgctgccagcactgcagctttgcttcccccctgctgtcttgttgctgcattgccatgggcatcaggcaagggttcaggggcctaggccaaatggcactgtggccacttgtatgtctccctcctggaaaatgcaggctatccaataaaggggagagaggaacagggcagagcactataaaaggcagtgagtgattggtaaagttaactgggatatgtatatatatttcatctttctagactgtggtttcatacgattcagttaagaatacttgatcccaatatcctttcaacacttcagcatctgtgagtcttttcagtggagacccagaacctctaagtggatggaatagggcaggtggtataggcttgtggcagatcccggagaagaaccaatgccacttgatgttttttttttttttattccatggcattccctgtgtgagactgtgcatgtgtgcttatgtgtgcatgtgtgttctctgtatctggagtcactactacaagtttttcagagcaggggttggttctcattataatcacattaacctccaagcatgcactctgatgccaagctgtaggattccataaatgtttgatgagaagtttgtttgtttttcattcagaacattttttttattattaaaagctccaaatgactaggaacaaagtgcttaatattctccagcaactccacccagtcagcacatcaaaagttaccaaaaagggacaagagaaatcaaagagatgcaaatgaacataatgtcaccaccttgcctttattgtacttaaaaaaaaaaaaagattcagaaaaattttctcactaacacaaatctgttattcattaaatattggtgatgtggacagggacatgggacatttgtatctgtgcaagccacaacttaggccttagctcctctcctgctagagttcagaaatctttggacatgattgttaagatttgggtaacaataaacccaaaataactggatttacctttattttcctgcaccttcccttcaagaacttcagccttttatattcttcccaaatagctatagaagtcctcagaggatctaagttgtgtttgtaaaatcagccatattgacaactacatggatctttgactttttcttcctgctcccgcagaacaccgtggtgaaatttgcagcaccatccggtgccaaatttagcatccaggtcactggtgccacggaaagcgttgccactgatgcttgtgccgggaaaggcacctctcctctgcttcagtgtccatgctaagggtgctcatacccaaggctgcaggtgccattgtttccctctattagtgtctccaggggcttactgaagggtcttttcatcctgggagcagcctatggtcttgccctttctcagtatttgtcatcctgccttgcctgagtgccattacttcagagctaagaaagaagatgctcagtggttttaattaggttaaactaatccctcctggtatgttacccttccaggaaacctaatgcctcacactgacaaaaatgcacccagtggatcttaaaaagtagtagagattatgccaggcgttggcctcgtttgaaaggaaggatctggcttttcctggaaataataaccgcctgttttctctttgcatcagatcagctccctcttcttcctcactgctccttcttttcctgacctccattcctatggattagctaattagtacaagcaccacatagatgaggctttatagcaagggtagaaagagcagatgatgttgggagcatggagaatgatatagctaattaaaacaacaacaacaatattcaacaacaacaaaaaccagcagctgcctcccttctgcttctggagggaaaactttgaatcattttgtgaagttgattgagatgtacagagcattggaggaatgaatagtagtattattacattcaaattacatggttctccctgaaatatgagagtgaatatagtgtaataagaacacaaattttcttcctgactcaccacttccaaactctgcaaccttggacaagttactcaccctctctgggcttcagttttcatatctatcacaaggagaaaatactagtgtctgtcccatagacttgttagaaaaatgtaaacaaagaaagacctatgtaatagaattgtagctgatacaacattagtactttataaatattagctatgacctgaaatttgccattataattattatttaggcactgccacccacatttagttctgcagtttatgtggtttgattatttttccctagagaaggctcatggctttttggctattaagcattttttttcctgttggtattttagaaagatataaaatggcatctcagaagggcctctagctattggaaaggtgaatcgcccgttggtttaattagaagagatattttcaggtggtgccctgaaaaatgagatgatgttttttgaagagctactgctaccggggagatagcttatcacggtgtgggtttccacaatgccgggagctaagttccaggaataaaccgagctaagaaatatattctgagtattgaatgtgattacgaggggtagggagcctgaaaacatgtgacattaaggcaattttcttagggacagaaagtcatactctattaggtcttttggcctcataaagtgttctaggcctgtatgggtattttgtgtttgtcagggtggacaagattgtgctgagaaactacctaatccccatcccagtggcttaataacacagagttatttctcactcctaatacctgctgagtagaagcagctgcaggggtgagtcctatgtgtctcctccacttatcagcccagatctccaggctggtggagcctccacctttaataacagccattctcaaactttttaatttcctaaattcctttacattcttaaaaaatatatacaagacatttgttcatatgatttataactatagatatttactgtattatgcactaaaactgagatgtaaaatatttatttactcatttaaaagtaagtatatagccaatacatgttgagataaataacacttcatggaaaatgaccacattttccaaaacaaaacaaaagaacgactctgttttgcatttcctggtctctttaatgtctagcttatttaaggacagctggattcccatatctgcttctgcatttaatctattgccacatgcttttttgcttgaagagaaaacctaggctttcacagaaatgtgattagaaaagaaacaatctcttggacccctataatggtcttaagaaagctcaggggtccttggatcacagtttgaggactgctgaagtaaaacttttccagtcactgtggctgaaaacaggagtgatagttctccagctctttaatatcagaaggaatgtaagtcgcttttgcttataatttgttgcgtacaactcaccacatgatcaagcctaacttcaattaaggctgggaaatacgggaaaacaaatggagtaattaatgaggaacactgtttctgccacaaaatcatctacttcatatcttggtagtccttcctttccttcccacctccctccccagttacttgcttgccagtgacttcttcatttcctttccttttcttcttttcttttttaatgctgacctgtagagtattgaaatcaaactcaatggaagttggttcagaaaatgggatatcagggagagctgaggcagattggcaagccttgagctgcctttattgcaactgtgtgacaccttcctcttgttcctttgtatctttttcatctactcttctgctgtagctgtgttcccttgggctattttgaccctctcaaaattaaaattctattggcattttttctgtctgctcacattcaaatccatggtttgccagacattgtattcacatcaactatttcctcaaagcagttctcagatgtgaagtagagatgattcaccttgggcttctggaactttcagcatccatgtctgcctgaggccttctgttatccattgctctaggccactattgcccagatattagcatgcatatgaatcacctggggctcttgtaaatgcagattctgattcagtaggttgtagggtgagactgagattctacatttctaacaagctccaaggtgatgtggatgctgttggtcctggatcacattttgagttataaggctgtaaacccaaccccaacatatatatcctctggggagccattcctcttgatgatttgcctcttactccagaagagactttggctaatcttccaaatctagccaatcatttgaaactcactgtgaatcccatccgctacacactttgtaccaccaacatacttgaagatgttcaagtcctcacgttagaaatatgatcgttttatggtttctaataattgcccagaacttggtatgatgaatcttctttcctactttgcaagtagctctcttaaaatttgctgagagtctatcatttttcagttgtatgcatttacttacaaatacaaatttggatttctaaggttcactttccttatagctggtaatctctcttctgtgcctgggcaggtgctccatgtagcaatctaggcttaggagaaaggagaaaaaggtaggttggtttggtgctcacacatcatgtccccttttaattctggtgctagtggactagagaaattgagaaggaatagattagagtctcctcacttgacatggctgagcttcgctcctcattagccatgactgctcttcagcctcactatctgcagactcagcacagacaggtggtgggtaccacacgcattgctgatgaggggcacatctgtgaacagctgcctagttgtggtgatccctttggccacatccttcagttggcagaaccatacttactttctcttaaccctcaaactagagttgtattagaaatacagaggcccccaaatttaccttctcagacctttaaatccaagcaacatctgatgttttatcttatccaaaatgaagaactcaaaagaagggagaaggagaactggtacttcttgctctacccctctccatgagactttctgtccctatttctggttttctcactctggtggtataggacagatcagctagttcactggctaagatatacactgcaaagaggaatagaatgtaaacattctcttttctttccttgttgcaaacttcctcaatcttttcaggttatcctcttcatctcagggtagaaaaatatgttctttcatcctccataagaggggatgaatgaggcaaaaatgcatttaataaagactacagtttccaaaaatgctcctacctttctcaccactctgtcatttatattgaacaggaaagcgggggcgtggttggtgtgagaaagggttctttgacaattctcagtaagcccagcaggaatggagctatctcatgggtcctacgggaccctgaacttcaaggggaatttagttcctttattctcaacactgggcctttaacatgagtgcacgacaactggaaacatcccagttgactgcctgttagatgtgtgtatgtgttgcatcagatctgatcatcagttgagtgaagattcgtgaccatttttttgtttatcaaaaccgtatcaagtggaacttgggcaaatgaatggtttctatttttttttctcagctgttctggtgctgtgtacactgtcagaattaggtcaagggaaggtagttattctaatttgctaacacttgctgtgtctgagaatgtttaatgcaaccacagagaaaaaacagacatgtttaaaaggtatggtatgtctgtgacatgtgctatcccttgacacatttgtgtcacaggtgccgattcctgcagtttactggtgttccacacttcagttctgcaactgcaaaaggtgatgagtagaggttgtgcttgcctcagctgggggcagcactccccaatcaaagatcaagcatacagactggcaggaaatttaacaattccctttcccattcatggaaattcaagctcttttgtcatcatattgtttttatttgtatactatatagcttgctgagcctctcatgagattttgaatatgaaactgatcaattaggtaaaaagcaacttaatttttaaaaaactcaacctcgtcaccctgcatcacttcagtgtggtgctattgaatgcaaatgtcagaaatagcctcttccacccgattaattatgaaccaaagagatcatcagagagtaaggttgccccaaggtctgtgttccttcttggcctctgtccatcaatcttctggatcagtggtcttcaagcattttgactcaaacacacccccttaaagagttttgaaataccatgtactgtctcatacattttaacagaaaaattttgagataatcatctattcacatgcatttcacatgtcataaataatacaaagagacctgtatgctctttccctcgtttcgcacaatggtatcatcttgtaaaactgtagtacaatattccaaccaagatgttgtcattgatacagtgagatacagactatgtctatcactacaagtatcactcatgttgctcttcaatagcaacacccacttctctgccagcctcatcccctccttaacccttaacaaccactagtctgttctccattgctatagttttgttgttttaagaatgtcatacaggccgggcatggtggcttacgcctgtaatcccaatactttgggaggctgaagcaggcagatcacgaggtcaggagatctagaccatcctggctaacatggtgaaacctcctgtctctactgaaaatacaaaaaattagccaggcatggtggcgggtgcctgtagtcccagctacttgagaggttaaggcaggagaatggcgtgaacctggaaggcagagcttgcagtgagccgagatcgtgccactgcactctagcctgggtgacagagtgagactccgtctcaaaaaaaaaaaaaaaagaatgtcatacaaatggaaccatacagtccgtgacatttggggattgggattccttacttatcattattctctggagattcatgcaggttgttcagttggaccattcacccattgaaggacatgtgggttgtttccaggtttgggctattatgagtaaagccacgaaaaatatgtgtatctagtttttgtgtgaacacaagacttcatttctctgggataaatgcccagaagcacaatttgcatgtttagtttttagttttgtttgtttatttttaaataaactttattttttagagcaaaatttcaggttcacagcaaaattgagaagaaggtacagatatgttccctatatcctctgccaccacacgttgtttagttttttaagaaattgccagattgccttccagattagctgtaacattttacattctcatcacaatgtatgaagtcatcctgtttctctgaattctcaccagcatttggtgttttcacaacttaaacaaaaattagccattctgataggtatatagtgatatctcagtgtggttttattttgtgttttcctaatgactaatgatgttgaatatattttcttgtgctaaccatatatctccttgcttggaatgtcccttcatatcttttgtccatttctaatttctcctgcctcagcctcccaagtagctgggattacaggcatgcaccaccagagctaatttttgtatttttagtagagatgggatttcaccatgttggtcaggctggtctcgaactcctgacctcaagtgatccacctgcctcagcctcccaaagtgctgggattacaggtgtgagccactgtgcctggcccgtaacttcttttttaatcctcttaacaggacctttcacagagcaaaagttttcaattttgaagttcaatttatgtacatttcctctcatagattgtgtttttggtgtcaagtctaagaactcctttcctagtcctagatcctaaaaatattttcctatttttttctaaaagttttacatttttccattttgcatttgagctgtgatctattttgtgttaattttatgtaagatgtaaaatgtaggtcaggcttcacttctttacctatggagaaccaattgctctagcaccatttgtgtaaaaagctacctcttccccatttggttgattttgtacttttgtcaaaaatgtgtccatttctgggtcctctgttccattgtactatgtgttgatttttccaccaatatgacagtcttgattgctgtaactataaaataaatctcaatattgagttaaatagattcttccctctttaatcttcttttttaaaattcgtttcagtatcctagttcctttgccttctcatatacattttagaataatgttatttatacgtacaaaagtttttcttggattttgctagaaatcgtgttaacctgtatatcaatttgggtagaattgatgtctttattaccttgaatcttccaaccaatgaacacagtatgtctctcaataggtttttaattccttttatcatcattgcatagttttcagccaacaaattctgtgtatgttttattggatttacatctaaatgtgttcttttttgagtgattgtaaatgatgttatatttttaatttccatgtcaggtgtttattactagcataagaaatagaattatgtttcatgtatattgtatcttgcaaccttgctgaactcccttatgagttctaggagtttttgtagataccttagatttttctaggtagacaatcatatcatctgcaatacattgtttttttctttttcaattgctatgccttttatttccttttcttgccttattgaactggctagaacactatgttgaataaaagtggtgagaatagacatccttggtttccaatcttataggaaaatcattcaatctttcagcattaactataatgttgactatagtttttttttttggtagatacattatatcaggttgaaaatgttcccctctattcatattcttcagagagtttattttttaatcatgagtggtcattgacttttgccaattgctttttctgcatcaattgatatcattgtgtgaattttctcctttagcttttttcttgagacagagtctctctctctgtcgcaaagactgcagtgcagggatgtgatcttggctcactgaaacctccccgcctcctggagtagctagaattacaggcgcatgccaccacacccagctaatttttgtacttttagtagagacagggtttcaccatgttggccaggctagtctcaaactcctaatttcaggtgattcacctgcctcagcctcccaaagtgctgggattacaggcgtgagcccccatgcacagcccttagcttatcattattattattattttatattttcagtatattaaaaaggaacagtacgaacgctgtggtattaaaaaggatccttatttttcaacaaatgaacttttataaacaattctgtaatgaaatgaaaacagtatcttaatacattacaagtttttgttaaacaagattttaaaattttaaaattagaaaacgttaagattaaattctttcaaaggttcaaacaaaaaaaacaacctgtacagtctccattacatgtgtctttgtacacattctgggcactttgaaaatgttaaagtttttaacgtttgactgacagaagtagcacttaaaggcttcatgaatcttttttccaaaaaagtatgctttcagtaaaacattttaccattttatctaactgtgcactgacatttttattcttcctgaaaaggggatttatgctaacactgtatttttcatgtaaaaatatacgtgtagagatattttaacttcctgagtgacttatacctcaaatgtggtttcatgaacaatgtctaaattttagaatgaaacagtatgtgtagatctacacatgtatgttcaattagggtaaagctcaagagcatgtcacagaaattatacctaaattatataagaagataagcaatgcctttatccccaaactttaccaataagccttctcaaatagaatgttagtaaagtgaatcactgaaaagtttcatttttgaattaactaaaataccagtagccattttagactgtcaacctggatgttttcttgattcactagcaagaaatttcttgcaatacaaaaagataacaaataattaaaatatctgctttatcatacaacttcaccccctcctaaagtgtctaaaatgattaggaattgtagcaccatcttttgcataaaaccctttcctcttcataaaaccctgaggtgaaaggttattaatgtaataaaaccacaattcattttgtattaaactgtagctttaaaaaaatgtataaagaaatgtgacaacttgtaaagctgctctgtacagtttttcaacaaaatatttccatatcaacttagtcaaagggcctaaaatgaccctataaaaacaatgtgcttttaacatgtgttagtgtcgagatgagcgccattttccatctctgctactgtctcttctgttatcatagtcatggctccagccatcatgattcctatcttcatagaagaaatcatctctttcctctgtaatgatggtcagacccatgatcagtgtaacgctgttcccggctataatgtctatctgctaggtagggatgagaattcattctgactttacgctgtgatgatggtgtaccttggcgccactgggagcttgaagactgattaaaactatgactgtgtgattgaactgatggtgaaaatcctgattgatccagaggtgaagaagcaaattttccaccatatgacatttgtctcaaagcactgttcatcactgcttgtctctgaaaattttctggagaagagaaagatctctgaattatctgtgctgatgaagtcatgttatccctagtcctttcgtacctgctaggagttgtggaggtagggcttgaatttccaacatgatattggggatatggcaaactgacatcttgcgaggcatgactacttcctgatctaaattgaattttgataggccttccataaagtttgattccattaagtagattcattgcataaggaacagatacttcatgtttgaaattcacaaacgcaaactgctttggtttaccatccttatcttttggaatttcacctttattactggcccagcctggtggaaaacctcgaaaaggagctcctcggtcactttcatttcaaggttgcccacaaagaactagcttattattatagtagattatattgattgattttccaatattaagccagccttgtatccttgatataaactccacttggtcattttatatatatataaatgatatattgctgggacaggagatttctcttgagattttctctttgatccataaattaagaagtgtgttgtttagttttcaggtgtttggagattttctttttatcactctgctactgatttcaagtttgattttattgtggtcagagaacacattttgtatgatttcaattttttttaatttgttgatgctggttttatgacccaggatatggtatatcttggtataggttctatggacacttgaagagaatctgtattctgctattgctgggtggaatgttctacaagtgttggctatatcctaatgattgagtattgtatcttattgattggtactgttgagttcttctatatctttgtttttcagtctagttgctctaattgttgagaagaaagtattgaaatctacagcaataattgtagagttgtctattctttcagttctatcagtttttgcttcacatattttataactctggtttttaatacatacatatttagggttgcttttttcattgattaacactttaatatcacctgtctctctttgactctgatagttttgtttgctctgaattctacttaatctgatattaatatagccaattctgctttttttcattaataatatttatattttcatatatatgtattttttcatccttctgtatgtatgtatttttcatccttctacttatattattacttctacttcctatattattatatttgaagtgattttcttatagagagcatatagttggataatggttttggatccagtcttctaatatatacgttttaattggcatatttaggttatttgcatttaatgtaattattggtatgctaaagcttaagtctgccattttattttttgttttctgtttgttttctctgtttttactttgctgttttcttttcctgtcttcctatgtattacttgatcattttttcttttatggaattctgttttacttatctataatatatctcttggcatagcctttttaatagttgacctaggcaatacattctttacacataaattatatatattgatattttcatattaccaattctagtgaagtttagaaatatttatctgcctttatgtccctttatcctcactttatttatagttattgtcaatattttatatgtgtacatttagaatcaaactagacagtgttgtaattttataatttttgcttcaaccatcaaatataatttagaatactcaggagagaaggtaggtattttgtattttcctgtatttttgcttaccatatttttcttttttctttatattctagccttcccccaacccctccccctttcctttcctttcttacctttcctttcctttctttcctttccttttgtttagagagccgtctttagcccttcttttgggggaggtctattgataacaaagtcttacattttcttcaatagagcatgtaatggtttcctccttaaagaatattttcattggatgtagaattatggttaacagttcttattttcagtcttggaaaatattgtgccacttccttctggtctccctgacttttgataagaaatctactcttatttgaacagcttttcccaacttttggttttttttttttttttttctagataagacttgtattttttcttaattttcggaagtgtaaaagtggtgtgccttaatagggatttctttcaggttacactgcttagggttttctgagcttcttgaacctgtaactttatatttccagacacatttttgaagtttttagttcttattcctttgactacttttccagccacatgctttttctcttctccttcaggacctcaacttacaggaatgtcagatcttttatagtaccataggtccctaaggctttgttaattaatttattttttttttcaatctggtttctctctgttgttcaaaagattggctagttcctgatttttttctttccttttttttttaattttccagttcaccaattctttcctccatctcttctattctgctattaagctcatccactgaaattttaatttttgttattgcattgttttggttctaaaagttacatgtagtttttaaaaatatcttctacttctttgttgaaattatccatttctttgataaggccttctatttattgtttgtttcaagtgtgttagtaattgctctttgaagcatttttttcatacctgcattacaagaagtggaagtctagaagtctctgttgacatgtaagtggggaaaactcccattgctgctggaaaggattgggagttctggcttttcatgtctcctgtgctgacatcttagtggggatgaccggattatcactggctgatggtaaagacctgactcttcacaggcctcttctgatgtcatgtcaacagagtaggatgatggtatttcaagctcctcacatagtctccactaagacccctggcaagttttcttattatgtggatcacagtcttggcgttctacttgggcttctctgataccaccctggtgtgaatgttggaacatgtcattacagcctcataagggtggaagtctcagctccccacttggcctttgctggcctacatgaggttggaggcacagtttttttcaatggtgtttacctaaagtggctattatctaaaatttttctacattaacaggctttcccttttatgatcctttggttagagaaagcagctttgatgtcatgatattgtgatatattaagaaatatatatttgatctttgaccctagttcctggcacagagctccaaaaacctttgaaattttctgagtggtaggagtgagaggatcatgttttgttattcttaatatgcacattttcaaccatacctgagtttagtttatgctaaggaatgactcttaggggatggggcatattgtcaaggaaagagttttatgattaaagggttggaactttcacccccactctactttcccatctccaagaccttcagggagaggaggactggagattgactcagtcagcaaaggccaatgatttaatcaaccatgcctaggcagtgaagcttccattaaaacctaagggatggggtcagagagctgctgggttgctgaacacatggaggggttgggaggatggtgtgtttggaaagggcatggaagctccatgccacctcctaactcccataccttagcttattcatctcttctatttggctgttggctgtttctgagttgtatccttaggtcaatgtttttctgcattccgtgagttattctagcaaattgtcaaacctgaggaaggtcatgggaacccctgatttatagccagttgatcagatgacaggtcacagtctggggcttgtgatctgtgtctgaagctgggaggggtgcagtcttgtgggaatgagccctttacttgtgggatttgtattaactctgggaagctggtgtcatagttgaattgtgggacactcagttggtgtctggagagctggaaaattgtttggtatggaaaaccctcacgttttctgtcagaattaggaagcagtttgtttttcttttaggttgggtctttttttttgtctgtgccgtcagcttcaagtgtaagatattacagaaagaaaacccaggggactcaccactgtccttctacagatcctgtaatccctagccagcctgacttcttcttgcatttcattcttcttacacttgttttatacataatggccacagattttactggtacttagcaggaggaataggaaaaaaaagtatatatatatattagtaattgccattattgttaatggcaaaaatcacacttacttttgcaccaacctaacgctgtatcttccaagaagtctatctcacacattttgtttatatttaaacattttaattaaagttcaaatatatttttcttgttattagaagcttgacaatatgaaacagctcagagagtgaaataagaggaatcattataattgaaataaatatacaaggttattttatcaaaaagttttaaaccacattttagaaaataatatttagctttatccctttggtgcttggaagtatgtctattctcagggcaatgcagtaatgatatttatgttggctaacagttatgcaatctttggtaaaatgggaggacttttgaaaaaagatacatcatacattcttgggcaatttgagagagtaaatacagtgaaaatatggaatttgtttccctcataactgtccttgaatgtggacctgagggtaccagtgttaaagatcattgttctaaccaaaatttgcttaagcaaaacatctgcctagacctttagcctaaaagataactacagtcagatattcttctctggccatattcagaatttgtcttgaatggttatcaggaattagttgtaatgcacggattttttttccatcatttcactaatgcattcagcttgagttttccattcagctcttagagggaaaaatgcctgaaaataaagtagctaatacgtgattgtaactggaatttccagtagagccttaggaaaggtgtgctttgataatattgatagagataaagcaggggctctgcggctgtttgtgagggaagcatttaatcagcgtgtatttgtgtgctcactttactgaaacactttttcccactttttattctttgccataaccagtctaccctgaggacacaaaatcagtgccttgggggagaagcagggaatggctgtacgtttgtttatttcatctcctgaataggtatcagagaggcaccaccaggggaggggcatggctgggtgcagtaccagaggaaaggagcagaggtatttgttctctgcactccctttctttccccctccagcctcacagctctcagaaaagggaagttcaaggacatgatcctggaagactctctgaccctaagtagaagtaagattttatcaaaaccactagtttgaaataggtgacaggcattgaggtgcagggatgtggggacaatttgaaagaaagaaaatatctataaaagccaaataaaataattccatcccccacctgcccatagaaatcacgtatcattactcctggagaaatgctttggtgtcagatgaatggtacagtcttgtctcagtgtcttacctctgtcctgggcccctacctcccctcctccttctgatcaccttcctactattctcactctcacccctaagtgatcatcaaagtttcacagacacatacatggttagagtgggaggagttgtttccaggccataatatccattcttttatgtaattaatagtagtatccaatcttggttgcacatttacatcccattgggcagctttacaaactttttgatacccaaggtgctttccatatcaattaaatcagattgtctatgggtgggaccaggtatatgtatttttttttcaggtacacatttttttttagactttcttaggtgattcgaatgtatagtaggggatgagaacttacgaattagaacatttccaacccagttgattcccgcaaaccaaattttcttctccctttgcaagagaagtatgtgactccacaagactgacctttgatcttggcaagaggagcacctatcctaagccatgcgatttagaggcccccactttggcctcccctggctgggctctgctccgtgagataaggaatccatgggccacggggcctgaccttgggagcccatgcctttatcctgcaccacactatgggtaccaaggccttaaaactgactatccaaatagctccgagctggcttccagggtttgtggggcctcttgcctgggggcagaaaacagtgatgctgtggatggatcccccaaatgctgttatttgtagggaagattgtgtgactcaagcctggacattgattttaactggatgtccatagtcatgagcacgaaattcctcaccatggagctgggatcggaggggagagggggaaggccttgggatgatagtggtggctgaggtcacagattaaccacttaggttggagaaatccaatcagaatctggccttcccagcttttacaaaggtatacgttataaaggtatacgtgttacaaaagaagaatggaaaatatttaagtttgtttgcttgacttataacacttaaatatttaagatatggtatttcagtccccatattgactctttgctgagctctggaaatgtcagcatctggcctgtgaccacccctgctctatctgtttctgtggcctaaactctgtgggtaggaggtgttggcctgatggatgcttcctaccttggcggcaccttcctcttgttacccacagagccctgagcaactgagatttcacctctggattcctttcactagctccgtgtcattttggctgtgagctgctcctgctcttgcatggttgcatatatagcattgtaacagtatacaaaatacatgggttttggtgccagatagacatgatttctagtcttagttctgccacttgccacttgcgtgactttaggtgacatccttgacctttctaaaccttggcttctttattatttatatttatatttgtaatcagagttagcaatacctacctggcatggtgttagaactaaatgaggaaacaaggaagcatggaaaagtgttggcacagtgcctagaggtagcaagaactcagtaaataattgtttccgtttatcaagtaagggcaattcatttaaaaacaataacaattctcctctacccctcttatttacattttctggactaaataattgatattttttgtttttctttttataatgcattttccaactcttagttctgcctgcttgtctctctctctctctctctatctctctctctctctctctctctgtgtgtgtgtgtgtgtttgtgtgtgtgtgtggagtacatccttcatatatcaaagtgacaactagcctactatcaggaggccaagcactttgagtttttatgaggagaaggctgttcatatttctttctttgacagtttatcttcttcttcacccaaccgtcacctgatctaggttttctacagtgagaccagtagaactgatatgtggatggagcctggtcatttggcctgggtgtactcagccagtggcactcagtatgtgctggtaaactgaggcaggactgactccagtctcaagaggttaaccatgacctattacaacctattgtagtgtttcaaaaacaggactgtatgctccttgttcaataccctttcctgggtgtactgggccacacatagtaagtgctaagttaatgcttatccgatgaaataatatgcaaatgataagttatataactggcccattttatgttaattaacaggcaagccacatgtttattggttgaatatgtaaatttttaaaaagtaagaataaattaaatgaatgaacaaatgaatgaatggtgaataagcatctgttgggtgggtgaggtgttatgctggggttgcttttatatttaactgctctatacactgaaagggtacaacttttcagtgtatcagtttccctgtctataaaataggtccatagtatctgcctaaacagggaaaaatgtttaataaaactaggtgctctagttgagtgctgggaattcttgggcattgctctcaatataagttgttgattagcagaagacctggctgtgtaaatactagctctgaaaaaggagagattttttattatttaaaattctccttagtcatccagcatttgtgtttgcttttttgcagggctgatatctgttttaacattttagcctgtgcatatacatggatggaataacattggctccaaatgaagacaagagcccatctcagttcaggcacgatcgtgcttgatggaaaagcatgtccttaaggctcatgcaatggccggaagctgctgtacagccctgactaaaaatgaaggtgctgatcttctggtttgtgcatgggcacagataccttagtactgctaagtcccgccaatctcaaataaagcagaatggagctggcaggccaaggcttagaattggagatggacagcaaggttctataaaagtaaacattgtggacagtttcttagacagtgatttcttagggtatctgttaagatactgtaacaaagaagcccccaaatatgtgacaacccaaaggtaacagcaatctaggatggggaggcatcagtgctcaaggcacctaggctagcgagtctcatgcactttcctccatgcagcttccatttttgagtctaacagctgctgttcttgttgctgattcccaggttgttgtaatgaaaaaaagcgatgcccagggaaagctctgccttaaggacatgatgctgaaattgcacacatcacgtcaacccatattccattgtcccaaactcagtcacatggccacacctagtggcaggggagctgggaaacaaaatcatcagctaggaggccatatgccctggtaaaattcataaaaggaagaaagaaaagtaaggctagcaggagacaatttaatatctctgctgtgggggatccattgcagaggacagatgtgttcatctttactaaaatgctttgtgtattttaatagttagaacactttggttacaaataatgagggaaagcaaagaggaagtattatgagggtgcatgtaaagcagcaagggagaaatcatagaaaaggcaagcctagcaggatcagaccccacaaagatcatgacagggagcggtttccatgtttatggctactcggggacccctgcagttggactttgttgatctgccacctcctgcactaaaatgatttggctataccgtcacatgtgttttttcagcccaactaactggtttgttctgcttattcctcttaatttatgcttgtatatgaactgccttgagctttactctcccttttagcaatatataatttctccctctatgccaaccagaaaatcatttcattgttttgagacaggctatacaggttctaggttactggccagactatggggtttgttcctttaaccgatactgtaggaaggacactgttctctgaaaggaagcagggggagaaggtatggtgtcctcttttatatactcactcctcattccactcaaagtgtgatctaaagaccaatagcatcagcatcacctgggagtttgttagaaattcagaatctcaggctacacctcaagcccactgtattagtttcctagagctgccataacagcgtgccataaactgggtggcttaaacaatggaaatgtattgtctcatggctctagaggccagaagtctgagatcaaggtgttagctgggttggttccatctattgtctctgagggagaatgtgttccttgcagctcttctagtttctggtggttaattggcagtctttacgtcccttggcttatagatgcatcaccctgatctctgccttcaagttcacatggtgcactccctgtgtgcaggtgccttctcacatgccgttatttatcaaaacactggccatattggattaagggcccagtctacgccagtgtgacttcatattaacctaatcatctacaatgatgccatcttcaaataaggtcacattctgaagtcctggggggtgagtactttaacatataaatttgtggggaaggggtacaattcaatccataaaaacctctgaatcagaacctgtacttatataggtaatttgtatgcacattaaagtttgagaagccatgccttaacattcttcaaaaaataatgtgccaccaacacacttactaccacctttaatgtgtaatggaaagcagcctagtcttgggttctggattctgaacctaccctagccacgtcacgtttagtgcacagccatgtgccaggctcatattcagcactcagtaaacacttattggatgagtgaaaaaagtgggacaaagtgctttcatgtctaaaattggaatagttatttcaaaagaatattgtaaggactatcagatttaccaaatatttaaaaatggaaagcatgactgtatcagtcagaatccagtcaggagacagacatgcaattcatttgaacagagaaattagtatctattagaggagagtaattataaaggtataaaaagaactctaaataagaccttagaacttagggagattatttaaggaagggacaaattttaaatgaagggaccttctctccaaagcttgaattcagacttcactggagaaggtatagtttcctcgcactggatggtaaacacgttttatgggttggcctgtatgctccagggtataggctgcacaatgctggtgagggggatcagagggaagcaaggtgccaggaacctgctgcctgtcaagggaaggcctagggtgcatggcgtctgcatcaggaggtctgcagttacatggatactggactgcagacagagccctgagctcacctagggaatgtacacaacactggatgcccctacagtataccactagtagcctgcaataggaagatgtgaaaagaagagcagtacaccagaaccgggaagaaaagactcttcttctctcccgctccaacaccctctactgacataatttaatgtcatgcctgttgcaacaaagaaatgctaaaggatccattccactattgcacaacaagtaattaagggcagactttgtagctgggaggtaatagattgatgagtggcacatgcactgtgccaatataaagtcgttttctcaatgctaatatcaaatatggcctcagagaataagagaaataaaaaatgtggaattcttaatgccttatccgatagataagtagttagttctccctagcctttctctaattcccatacatacactgcttttttccaactgtgttgcctcataatatgatttggaggggtgagataatattgaaaatggaagttgttactaaacttgggaactgagcataccttgatgatggtgctcacctatgtatactcttgtgttatgatacccgcagcacagcagtgccaggcactcaccctgactcctagttatctaagacgtcatcctctggggctaccttccttgggctgtttttccaagactctggaccatttatgccataattgagctcatttacacaatcctaggccatctcattcttgcccatggctttcattactcatgaacacattcctctgaccgggttgctattctgagttcctaacgatagtctccttgaagccaatcttgaaggtcacaaagacaccccaaactcaacatattcaaatcaagctcatttattatcaccacattcacccccagtctgttatttttttctctttctcaaagaatggcaacttatgtttatgttatctttctctcttttcctttaccttccatatcacttccatgtcagagttcctggatcttatcccctaaatacctcttgattttgttcacatctctctgtctacattagcaccacccacatgtgtactacatcacatatgacctggaccaccatacagcctcccaactgatttattagcaacccctctggcctttttcctaatatgaatctaatatcaccctcaccttcacttctctcccactgcttcatatttttcaatgtttcttcattgctgttaggacaaacacaaaactcttgacatgactttcaaagtcctgcatggtctagctcttctccacctctcaagactgacttcacctctggccttctcttgatttctctggatcagctacactggcttttttcaacccactctttcgggatataggacctttgcgtatgctcttccctgtgcctggaatactcttcagatcccacctcaaccattccctgatcactctatccagctcaaatgcccccattatcagctcccattgcaccttaggaactgcttctccctgatagcacttttcagagtcaaatgttatattttttcattaattgtttggtcaatgcctatttctagactgtaggatctactttggcaggatacgcattaataattcctcactattgtattctcagtgtctagcccaatgccttttatttaggcaaaataaggaatctaaatattggaattcatgtgctaaaatttcttgctgaaatttactctctccttcaacaaatatttagtgagcacctacatgtgtttgcttctatatttggaactgtgcttccaaataagattcctgctctctcatgttgtattagtttgggttgtctagagggataggactaatcggataaatgtatatatgaaagggagtttattaaggagtactgactcacatgatcacaaggtgaagtcccacgataggctgtctgcaagctgaggagcaaggaatccagtctgagtcaaacctcaaaagtagggaagccaacagttcagccttcagtctgtggcctaaggcccaagagcctcggcaagccactggtttagttgtaggtctaatagttcaaaggctgaagaacttggagttcaatgttcgagggcaggaagcatccagcacaggagaaagatggaggccagaagactcagccagtcttatccttccacattcctctgcctgcttttatcctagctgtgctggcagctgactagatggtgtccacccagattgagggtgggtctgcctctcctaatccactgactcaaatgttaatcccctttggcaacaccttcacagatacatccaggaacaatactttgcatccaatgaagttgacaatattaaccatcacaagtccactccttgtcaccttaaacccatacacatcttttgaaatcatacataatcttcaaataaagacaataataaggtcataattatgcctaacataatatagctatcctttgtactaccagaaactaccaattcccaacccaaatgctattagataaatttaacaacactgaaatgctgatatgaagtcaataaatcttatgtcacatgacaaaggaaaaagaaataaaatgaagatattttcttagtacaagtgtatacaagctgaaacatgttcataacaaaatagagaggaaatacgacaattaccatctttgtttctgcaactggtcacgtgtcatagctggtattgatgactaccttcttctactacctattctgtattccttttgccttcagcaatctcctcagcaggtcgtggtttttttacctggtggagtgacacaaaccttcattcctgtagggtctatgtcatttgtagtcctgcctggattgggttgttatagttttccattgaccttaatcacagggcatgataatactaagagatgccctaagggatctcctatattccatgcatactcttctttacctccactgtggagtagtaaactgattttatcttgataatctgggtcaatcaccccagccaaccctataacttcctttcttcctttgttgcctgttgacttagaggtagggggagcccaaagtggccaagtggcaatcttaacttccagtttaatagaatcgttgttgtgtcttctggtgatggtgagaaatgacgcttccatttccatcccttgattcctggaaccatgaatcctggctatgggagaaacagtaccatatattggatgctgattcagatcatacacagccttctagagaactttgtcccagccctgcaaagtattgtcacctagttggcattgtaatttgacttcaaaaggccattttaccattctatcagtccagctgctttagggtgatggggaacatggtgagaccagtgggtttcatgagcacaagcccactgctgcacttctttagctctaaagtgagtgccttggtcagaggcaatgctatgtggaataccatgatggtggataaggcattatgtgagtccatggatggtagtctcggcagaagcatttcatgcaggataggcaaatccatatctggagtaagtcgattccggtgaggacaaattgctgccctttccatgatggaagaagtctagtatactcaacctgccaccaagtagctggttgattacccaaggaatgttgccatattgagggctcagtgttggtctctgctgccagcaaattgggcactcagtggtggtcatagccaggtcagccttggtgagtggaagtccgtgttgctgagcccatgcataacctccatctctgttaccatggccacttttttcatgggcccactgggcaatgacaggggtgactggggaaagagactgagtggtgcacatagaacaagtcatcctttccacttgattattaaaatcctcctctggctatggtcaccctttggtgaacacgcacatgagatacaaatatcttcacagtttttgaccactcagcgaggtccatctatatacctcttccccaaatttctttgtcaccaattttccaataatgctttttccaaattcctgaacatccagtcaaaccattggctatagcccatgaatgagtatataatcacacatctgtccatttctccttccaagcaaagtgcacaacaaggtgcaatgctcaaagttctgcccactgggaagatttctcttcaccactgtccttcagcaatgccctagaaaggggctgtagtgctgcagctgtccactttcaggtggtgcctgcatattgcacaaagcctgtgtaaatcaggcccttgtcaccttttcctctgtcaactgatcatagggaaatatccatgaggccatcagtgcaggctgggggagagaagacaaggtggcaggagtggggaccatgggcatctgagccatttcctcatgtaacttacttgtgccccaaggacctgttcaagcctgttcacgtacatacatatcatttacatttgatgatggaatggtgctgtacattcccccactttatggctagatgggtcagaaagcacttggttcatgataggcagttcaggtcacatggtgacttgatgacctatagttgaacgttcagtttctaacaaagcccagtaacaggccaagagctgtctctcaaaaaggagattagttatctgcagaagatgacagggccttgttccaaaatcctagaggcctctgctgtgattcacctatgggggcctgccaaaggctccaaactgcatccctatttgccactgacacctcagacaccattggatcttgatgggtcacatggctcaagtggcagagcagcttgcacagcagtgtggacctgttgcagagccttctcctgttctggaccccactcaaaactggcagcctttcaggtcactcgaaaaatgggccagagtaatacacccaaatgaggaatgtgttgcctccaaaatccaaatagacccacttagcattgtgcctttttcttggttgtaggaggggccaaatgcagcaacttatccttctccttagaaggaatatcttgataggccccacaacactgtactcctagaaattttactgaagtagaaggtccctgaattttagttggctttattttccatcctctggcacacaaatgtctcaacaataagtccagtgtatttgctacttctcactcactggatccaatcagcgtaatatcatcaatgtaatggaccagtatgatatcttgtggaagggaaaagcgatcaagatctttgtgaacaagatcatgatacaatgccagagagttgatgtacccctgaggtaggacagagaaggtatattgctggtcttgacagctgaaggcagattgcttctggtgggccttatgaaaaggaatggcatttgccgaatcagtggctgcataccagttaccaagagatgtgttaatttgctcaagcaatgaaaccacatctggtacagcagatgcagttggagtcaccacttggttaaacttatgataatccactgtcattctccaagatccatctgtcttctgcacaggccaaataggagagatgaacaggaatgtggtgggaatcaccacctccatgtctttcaagtttttttttgtttttttgttttttttgagacggagtctcgctctgtcgcccaggctggagtgcagtggcatgatctcagctcactgcaggctctgcctcccaggttcacgccattctcctgcctcagcctcccgaatagctgggactacaggcacccgccaccacaccgggctaattttttgtatttttagtagagaagggatttcaccgtgttagccaggatggtctagatctcctgacctcgtgatccgcccacgacagcctcccaaaatgctgggattacaggtgtgagccactgtgcccggccaagaatcaccacctttgcatatttcaagtccttgatgatggcactgatctctgcaatccctccagagatgcaatattgtttttgatttactatctttctaggtagaggcagctctaatggcttccatttggcctttccctccatactagccgtcatcttaccagtcaggtagccaatgtgggggttctgccagctgttaagtatgtctatgccaattatgcattctggcactggagaagtgaccacaggatgagtctggggactcactggacccactgtaagttggacctgagctaaaacttcattaattacttgacaaacataagaccccactttaattggagaactataatgatgttttgtgtcccttggaatcaacatcagctcaaagccagggtccagtagtccccgaaagttctgatcatttccctttccccagtgcacagttaccctggtaaaaggctggagatctccttgggcaaggatgggagaaagattaacagcataaattatcaatagtatagtggggtctttcctcaaggggacccagtctctccttcattcaaggggttctgggtttgtaaactggttcaagtctggaaattgattgagacaccatgattctctatttttataattcaaattagttttttgttcactcgacctggcagttttctgcctatataaattaaataagtatgcaataagcttgctgtcaatttcagttctaggaacactgtgattaattagacaatgccagagctctacatgagtcagactattctgattgctgctttgcatctgctgtccattacggtaactatgcccaccttgcctttgacagttgagtgctgccatttggcctctgccacctcaggatctaactattcctgttgcatttaaattttgtagttgagtgactgcggttcctcttgtaagatctgccatacagagaagagcaatcacagagcccttcaaggatgcaggtcctgctctcacatatctattttgcaaagtattgttaaagggtatatcttctggaccctcccagctaagatgagtaagtctaaattgactcgtctatcccaacatcccaatctccctaagccttttgatcccttcctctacattaaaccaatggagagcaggcatttgcagcttgctcacagtggcttttgatctgtatttcagctaaccaagcaaataaacgattagaccatttttttaactctccaagctgcaacattaaatgcagaatccctgcttagtggacccaaatcaataaattcagcctgatccaactttatgttccttccatcattatcccatacccttaatatccattcccatgcctgttttccagttttctgcttacataaattagaaaactcaaggagttattttggagtgtagtgcacttcctcatgggttacactctcaacctcacttctaggggcttgccaggactttagttataggtctagaagcaaacaggtttggggtgggtcctaaggagaatcagcattgtcttgcctagcaactgcctcaggggaggccatcactgttgtctcaggcagtacaggattaatctctgacaaaggtggaaaggctgatggcagcatgggtggggaaggagatgttgccaccactgggggtgggaaggctgtttcctctggcagaagagacttttcagaatttaggagttcggtgcccacagcctcatcagggtcctcccacacatccccattccaagttgcagggtcccattcttttccaatcaatgccctcactttaatagtagacacctattgaggctacctgtgcaccttttttcaggtcagccactcacatgtcaagagcttgtgtctgattttccacaatttcagctctttctctacaggagataagactcagggtaatcttggaagatttgaggctcagtatgtgcttctgaagctgggagctagaatccccgagttcatcattttctttcatcactttgtctagtgaactaggcaaccaacttcattatattccttggttctccacgtatggtcaaaggtattatgtatagagtcactgtattctttgccactcacaaatggtgaatcaggagtatcaaatgaatttattttgcataactgtctaaacagttcatgccaaggactatcagtgttctccatgctattagaagtagagtccttagcattttttgtctaatcatattaagcagccaactccagaagcccccaaatcaactaaagaactccatccttaaaattctgttcctctagaaccactcttggtgacaacatctgtgttagtctgggttctctagagatacaggactaataggataaatgtatatatgaaagggagtttattaaggcatattggctcacacaatcacaaggtagattcccacagtaggccatctgcaagctgaggagcaaagaagccagtacaagtcacaaaacctcaaaagtagggaagcagacagtgcagcccttagtctgtaaccaaagcccaagagcccctggtaaaccactggtttaggtgcaggtccaagtgtccaaaagctgaagaacttggagtccaatgtttgagggcaggaagcatccagctcaagagaaagatggaggccagaagactcagtcagtctagtccttccacattcctctgcctgcttttatcctagctgtgctggcagctaattaaatgttgggtctgcctctcccagtccactgactcaagtattaatctcctttggcaataccctcacagacacactgaggaacaatactttgcctccttcaatccaatcaagttgacactcaacattaatcatcacacataccatgctcattctgatggggaaggacaaaaacaaaacaaaaaacacccacacatacatgagaaaaattgcagatcacaataggctcaatgaagaaaatcaaatagggtggtgtgatagaaaataaggattagattgaaaatggcctcaggagaagagttggattgcccaagtaggcctctctgaggcattgcatttgagctggatttttatggcgaaaaagccagctatgtgcagttgaggacagaggtttccaggcagaagcagtagtgagtgaaaaagccctacagtggtaaggagctatctgtgtcagagaaaatgagaaaaactttaacatgccattattcatagggttaacaagggcaaggcgttgacccaaaggcatgacatctgagcaccactgcatgtgtgattagaaggtgccttagaaaaccagttattcaaagggagaaggagcatgatcacttcggttaggacagtttgctgtgcaggagcattatcatactgcaaaatgcttgtcaatactgtttacatagaatacaacctgaatggtattcctggtattattcctggtgttattcctggaaattctgcctgcttcccaccgctaaatgtcaatagatccccccagacaccatttatcggaaaataccaacctctccctcaccagcatacacacttttctacatgtcaatcaggggtggtagtgatcttgattagaatgactggaaccttttcagtttacagatgtggaaatggaggcccagtaaaggaaagcaaataaatggcacagcttgggttttcttttctgactcaatacctggtacttattttactacagcacagctagcacccatatttttacctccaatcatagttggttttggcagatggaaagcaagcaaaccaaaaccacaaaaatgctgtgtaaaaagaatattttcctaatattcctctttgatacattcagatttctatggatgacattttcttttaatggtctttatctgtgttttgagggagggtaaacttgaaagcccgccttctgttcaatgctgccccagacaaataagtttgatttaatgcaataaacattcttccattgctcactgcagccggatgttgtttataatgtttcatctgccaaagcacattgtatattatcattcagatgcaaaataatttatggctttaactccctatgcatttagatgagtaaatcacttgatatttagaagaaatgattgttgtttaattttttgcttcacttaactttttagatatcaatacaactttgacttcatgtttgttttcgattaacctcgcgattaaacgtaagaagaagtgtgtgctcttgggtgtgtgtgtgtgtgtgtgtgtgtgtaagcattgtatggggcatctttggggagatcttaaatcataacaagtcatcaacttgtgagcttgtgccttgttttttgaacaactaaaagtcattctgaacaaattatgttgaatgagatggataataaaattggattttaccattgtaggctataataataataataataataaccacaaaacatgttatcttttaaaagtaatttaaaaggaaattatgcaaaaaaaacctaactgatgacagcatcataagaaaagtgtgagttcttcagtgtgatacatttgaaggagacaatgctcatttgtatttgtacattctgtatatttattaggaaatcaatcttattaattttagcatgtcattgacagacagatgcatatttatttttgtttatacatttatatattcattaagtgtgataaagaaataataataatactaacattaagcttgtattatgcaccatcacagtgcttagggctttgatggcattctcatattgcttcacagtggtaagagtataaatgatggaatcatagctttatagtggcagaatagttttgatgaattgaagcatgtttgaatcaggggccaactagaaggaacagtagtattgatgaaatataattttaatactgtgagtttcataccaagacttaaactggtctgaaaatgtgtggtcaaggagagccattttgaccacctgcttgagtggataggatttagtgtgcaatgaactccccaatggattggggtatatccagagtgcttgaagaatgtgtgcctgtcttttctatactttagtttgttttatataccctcctaatagacagtgaaaagacaaaccttggctcagtcattttaatttagtaacaattgagttcattttgtttaaaggcttatgtaatttcttcgctaatgcaatttttaaaatttccaatgattggctttatctcacatatttaaaagatgtgcaagaaacatcctatgcttaaacatcctatcagcacatcctaaagtcagtttcccatagcatagttcttctgtatgctagtatattggcactgctatttgctgtgtaataaattatcccaaaactcaatggtttaaaacaacagggtttattatctcctggttctgtgagttgtgaattcaagtatggcttagctgcatctctcatgtaaggtgtctcacaaggctgcaagtcagctggggctacaggaatcttaaagcttcactcagagaagatccactccaagttaatttgtgtggttattggcaggattttgtctcttactggctgttggccagaagtcaccctcagttccttgccaaatgggctgctctgtaggtcagctcgcaacatggtatatagcttcatcagactgagcgagtcagagggcaagagagggagtagtaacaagagggaagtcactgtcttttgtaatgtaatctcagaagtgacaccccatcacttttgccattctgttgattagaagctaattactaagtccagcccacactcaggaaaaggaattgcaaaaaagcatgaataccaggaggtggggatcactgggagacatttcagaaactctctgtggcaggtagtaatgttatgagggtttaatgttctaaaagattgtgaaatgtcaggtttatcacaggacctttcagagtcttgagcatgctaactgcattgcaaattgtaagtggaaagggtctatggaatggagtgtttctcaatcctgtttgttcggtgagtcctttttgttaaagagcggcatgttaaatgatcctttctcaaaacctttggtgaatggctgcctaccattttcacttgacacagaagttactgagaatatgagaggtgcattgccattggctgcagaacctgggccagtgcacttatcctgaagctgttaggttctttgcatcttattagattgacacatggtttatttatgccaccatgatcatgatttccactgggtcatctcttacatcagctgctggcaacataagccatataagtaaaaaagagtgtaagagttgatgttgaacacatttatgaaatgtctgtgagccaattgttgtggagattagcttccagctggtgctctcctttctccctttgtggatggcaaagccagactgtggccaactctgccacttctgtccttagtccaaccccaccccacccccatcctatgggaattggaaagccaccagtatccatcattatcttcttcactctggaaataaagatgttggagccttcatacatcactctaaaaaactgtcaactcctagagacacattgccttattgattttactttatttctcatgtctctcctttaaaaatgaacaataaattgcagcagctcatgtatagaaggactccattgctatttaacttcttgtttggatctttaatggcccatgtgatttgtccttctcagacagatatcatggccttgatatcacgaactgtagcatgcatgtctgcatgtccctccccagtacagcagagttcagtgccctggacacttttctaaataggctctgggtgtttggtggattgagtagattgtcacggcaggtggggcataagcatggttattattagctcatagttaaatgtcagaacacattaacaatgtttgtttgtattttagcctgataattattcttttttctcatttcctgccacttgtaaatattattttgcacatttccagtggggaggcctggagagaagattttgatcgttcatacctctttgatgccaagcccacttctttatagttcttatgagttaaattaaatcaggttttttattgtgtctacatctatgtttatgtatttttgtctctctgcacatccacacttttttcttatttatgtctcctacaatttcatgagatagtctttcagcaaaacaaaagtcaccaggaagtctcactaatcaactcaccagaaatctgcaaaagaagggttcctgctggaatattgcctcagtactaatctatgggtggttgatgcatctagaacttacactggatagcatattaaacaccttggtgaattatggtgcttgctccagctgcttttaaaaaattatttattcattgatgacttttgaaggtgagcagatgtttccatttgctcattttggtttatggcccattctgcaattggtattgtagtacacacatttctatgtaatatatatctcatatggtccaatgcattagaaaaagagagaaacttataataaaaacatgggatcactggcagcaaacagtatgcctggagctcgtggtgacttcagcattatcagaatgttgatagcattacatctgttgtgtctgaaaagtgccagaaaatggtgctaatttataacgtaggaggagggaggtgaagaaagatatggtgatgaaaaatagtacacagtagaagatagtcaactaaatagtaatttgttaagttttattcacactatataacaaagtgctgtcacaggtttctggtttggtttataaatcaactacgtatgttgctcatctatacttcccgtggaaacggctattctaaatagggcctttccttttttacagaaaacatgtttgtatttctaagggttgtgtggttcagcccaagaacgagggcagtaatagaataaagtaaggccttgggctaccattgaactttacaaggcaaagggcagagaataggcagaaaaacagagggaaattggaaccagcaacatccgtagaggaagaacagagagaaagaggggcagatggttgggaatgatagtgagaatgatgcttatagttatcacagatgcctctcaatttttaaaaccttgaatgtctacatctctgagaaatttaaacactaaaaaaaaaaaaaatgcttttttctatccctcatttccactccttttatcctcaccttacaaccatatgtatcttttttttcttcctaagattccattgctaaggttgtagatgtataggttagacagagtatgttcccaagacatcagaacaaagtttacaggatgtcctggtgtagccagaaggacagagaagtttgtacctgcctgtgtggaatgtttacaagatcccgagtaaagccagtgcccccaacctattgtttctccattactggctgctctttgaagacaatattttcgaatttcatctgttatttcaaggttttatctatgctaaaatgcatattgaatatttgaagctgacatcagtcacatgtatccttctagtctagagggaatgttttaggttgtctcatgagactgaattttgataagaaaatgtgaatgtgaagatccttgcaagggagaaaagttacaaaataagaagattttttagtttttctttttctttttaagcaaattcctctgcccattttgtgacagtgttttaagaccagatgggagtgtccctggatcctttcagctggtggcactgtatgagttttctattgctgctgtaacaaattacaacaaacttagaggcttgaaacaacaaaaatttattatctgatagtctggagattagaagtccaatatggtctcaatggactaaaataaagatgtggacagggctgcattccttcttgagcctctagaaaatccatttccttgccttgtacaacttctagaggccacccaattccttggctcacagcccctttccatcttcaaagcctgtgacagtaagacaagtccttctcatactgttgtctatcctgttcacagcagctaggaaaggttctccactatcaaagactcatgatttacattgggaccacttggatagtcgaggtaacctccccgtctcaagatctttaattgtgtctgaaaaggtctttttgccatgtaaggcaacacatttgcagggtcctgagattaggatgtggatatctttgggggagtgcctaccataagcactaactaaaacaaactctttccaacctactgtgtcctgtgcaggtggtcactttttttttttttttttttttttttttgagacagagccttactctgtcaccagactggagtacagtggcatgatctcagctcactgcaacctcccatctccaggtttaagcacttctcctgcctcagccttccgagtagctgggattacaggcacctgccacctcacctggctaattttttgtatttttagtagagacgaggtttcaccatgttggcctggctggtctcaaactcctggcctcaggtgatccacctgccttggccttccaaagtgctgggattacaggcatgagccactgcacctggcctggtggtgtttttaataagctgcctcagttaacaagagtactgggcctggtcagaaatttctgccaatgctgagtgctgattctcttctgatattaattgaagtcagtgtcttgtcagcctccacttctcaactctagctgagctagccacaagagaagttggagtcacatctttgattccttctccatgcttacaaaatcttgtatcccattcttccctgcagcatgggatcctgagactttggcagccatcgtcaaagtttgccctccacaggacagtagcattgagttcctagtagccttcaggatcacattgtctaagcctattattttcctaagggagcaaagaggagctcagggaaggaaaataaattagcaaagatgtagaacctagacctacacagacttccaggcccatgcctgggccgcctatgtggcgttgttccacctcacaataccagactagaggtgactagacaaggtcctcaaccagttaaaaaaaaaacaaaacaaaaacacacacacacacaataaaacaaaaaaatatttccccataagaaaatgttccaggtagaagtgtaataatgtcaaatatttaggaagcatttgtactaacaaggataaatcagagagttttgttgtgtgtgtgtttaatcctcagttaatcagaagatgttaaaatgggagcattccttcatgaaaagcatacacttaactaagactttgaggtcagaggaaacatgaatggggaaatccatgaaaaaaaaatctaattactgatgcctttaaggtctggttttagagattcaatgtgtgcacacatagaaactgaatctctaaaactagaccttaaagccatcagtatcatgattaataggggttaatgaggttaacccctattaaccttaacagggaaggctttggttcaaaagcctgaaggagacccagagccagcaaatgtgacatggggttttactaggggctgattacaggggagagagtccagtggtggtgggctggagaggaaaaccatcttacctgcagaagtggtccagtggtggcaggctggaccagataaccgcatcgctcagtggcagtggcctgggcaggaaaacttcaaccacctgcaaacagcatgcggtttgtatagcattttcagttaacactttccccgtaatgaactccacctggcaaccttcatttaccccaaaactcagggcctcagtcctctgtatggcccatgttccacaggatgggccgggggttcagatgtttattatatataagaaacaaatctcagggttggccactcccagaatctgtagctcaaaacacacattgaggtgcatctgccatacagggttattctaagggtatgctgaaatcattgctatcaggtgcatttacccttctatgtggccccttggtttgactactgaggtcagttgcaaaaggtaatatcctggcttctatggtttctggcctaaatacagtcccatattaaactcctgtttgagtattttgtgaagtctcttcaacttagaatgccatctcttatggtttcttaatttctaaattatagggattccttttgcaacagcaatgtccatctctgaggcagctggctgttcagtcgttgctgttgattattctttatcctatgagctgtcctgggaggagacgagacagctgatttccatgatctgaagtgcaacttgttccaccgcctttaaaataggctgcagctgttctagtgttttgaccgctagggtcttatatgtatggtgaccttaaacttcctcagtgaaatgttctctatcatagtcatattttacactattcaaaaagttaaatcagacagcattttcctggactactttgccaggagatgaccacttttgtgctttccttgtctgaggaaatttgcaatttgccaatattttaaaagggaagacaaagccataagacagaatagtaggagatatgaaactagcttagggaaaaaaacaaactttggtaagattttactcacacttcctatcagtattccaacaaaccccagcatgaattaagtcttctcttccttattggctgtctttatttactatctctctttcttccaagaagtatttattcagtacttgctgtgtgccagaagtggtactaaggactagttaagatgtaatccctgcaaatcctgtcaggagattgacttcaatttagatgagcaagtgagtctcacttcttcccattcagatgccctttttcttcccttcttcacctttttcttcactcctcactggtttccaactggaaatcaagtaatctcagtatatactcaacttcagatgtagtctcttgagtcatcttaaagttgagactgagagagcaagtgctgtttagagaaacttgaaaatatgaagagtaacaaaaaacattatttgagaagtaaaaatgcctaatatatctctgtagggaagagtgagttattacgtatatatttcaacactgcagtgtaaatgatggtgactacatggatactgattaaggcatttcatctacaaacagtacttagttcagtttactgaaaacaactcagagtttagggtgtggttaaagataaccaaacatggacatcttttacttctccaggtttagacataaagctaagacataaggaaatcctgattaattggctagtcatgacccattctagaaagtagaattattcagagcattaggacccagtgaaaggtcctaccataattcaaactgattagtgaattttctctaaaattatacattgaaaatatgggatttttcatcttcaaaaagagtttgaggtctgcagtggtgaatattcatggaatcacagaattgcagacataactttggaggaactctgatctaaccatctcattttcacactgataaggaaaattatttattttatagataggtagaagaaatgttaaacaactatcaaatgtaatctaactacgtacaggcaagactgaagttagaaactaggacacctttcttctaattcaaagttgttttcactctatcgcaagccttaccttagccaaaaccaccatacgattgtctgtaaagaagactctattgcccagtggtcatgatgatttaactcctttctgttttcctttcttcttgatttcttgtcttcccttttagtatttattcatcttctctctgattaatgagaatagtaaaataaatcttaaaatgggctaatctgtaaaacttttctttttttttctttttattttttgacagagtcttgctcttgtcacccaggctagagtgtaagggcacaatcttggctcactgcaacctctgcctcatgggttcaagcgattctcctgcctcagcctcccgagtagctagggttacggcactagccacattttttgtatttttagtagagatggggtttcgccacattggccaggctggtctcgaactcctgaacttgtgatccacccgcctcggcctcccaaagtgatgggattacaggcgcgagccaccgcacccgtgcactaatctgtaaacttttcaaagaatccaactctttgttaccctcagaaatataatctactcagtcatgcatctactcagtcccaccatactgagaatgatgaaactactatgatgcgtattttgggagtgtgtatagtggtgtgtgtgtgtgagtgattgtaagtgtgtaaggtgtatacaggattgtaggtcattgatgattgaggaacttcatattgaaattactgtccctcaattctcagtgactaaccttcagctttgttttgtttatatgctttcatattcataaaatgagcagatttttaaaaacccttgacctttatcttataaaccttagtgtttttagtaataatagttcattggtaactatcaactgaatgttcattcatatcaaccaatgagaaatattagttcttaattatttcttgttcctttgtccctttccacttacatgtacatcaagtgtttggtgtgattcatgagaccatgggcatagtcttgggttagtgaaaggtaaagtaggtgtaatagaagcaagcttgaaatggcaatcggtatatttgggttctggtcgtgggaagtcattgacgataaaatgtgtcttttattgagcacttgtgtaagtcaggcatgtatgcattctcactgacctgtgagattggaattattcccttctccattttacagatgcagaaattgaggctgaaagatagtaagttgccttcacagaactaataagaaaagagatgggattcatagattttctgtctgtaaatcccaggccagcatctctgctgggcagtgctgctttcttgctctgtgtttttagaaaaatcacttggcttttctgggtcttgggttttctcattaatcaattggtggtttgagctcttatcatgtgtaacattccttagagctccaggaattagagaaggtcattttcttttcctcctccacctctcacccctttgacatttacttttcccatatccagctgttaatcattaaaaatgaagatgatactgaaagtcatgtctggccatgaggacaggatctgaatgttttcattctgacctctaaatcagtctgcatatcttgcctgtaaaacaaaatcaaaaggtgtggtggggagggaccagggactttaattatatttttaaacaatggatttccattaaaattgtattattctacacctctggaaaattacattgtagatgagataaatgcagcttggcatttaaattaaggttatctttagactggtaatctcatttgctgtttagcaattttaattcaagtcaaggcagtgtaattagtgccctcagccaattgccatttctcaccgctttgtagctgtatttactactgttaagacacattctatttgtgtggaaagtataagtcaacatactaaattattaaaggtggcatacatcaggaaatactccctgcacatgctgatgcttcagattaggaggctttaagccgtcatgccaagagagcagtgataccgtggatggtaaatgcaggacatcaccattttttaaatacagagaaattaatgtgagatgttcttagggcaactatactaagtttagcagtgcttcaacatgttttcaatttgagacaagcttagcataatttaacttcaaaattatattttacatgatgtgatagtttttttttttacactaaggtatgcaggtgtgtggtgggggatagggagtgatgtgtgggtgtatgactcaatgtctgtatatatagtttctattatagcttaaaaccagacccaggcaaatatctctaggtagtaaaaaaagattaggtaataaggagttctattatacccttgaggagacaggcgattttttatttatttgaggaaaaatacccgtgtgtcactatacatacttattaatattaattatataaattaattctattaatatattatatatttgcaattgatgaatcatgctatatacatctgtgtttttgtgtgtgtatatacatttatgtatgtgtgtgtgtgtatgtgtgtatatatatacacacaggctttatttgactttagattcctgctttgaagaacaagcgatattcagaattcaaattcaaacataaattcaaaccttttcttccttctgcctaataatggctttaatgaaaaaaatctataatttagtttgcttcgtgtattttaatttccttgagaacaagagctttatctagttttcattccttgcagcaactagcggacctttacttaaagactcttagtaaatgtttgttgaactcaattatgtaaaggaacagttgactgttcttgatgacagctttctaatgtatgagtattctcttggttttatagtctatatattgaattccgtatgcctgcctcttttctgtactccaataggactataagcatgtttacagacagacaaatctgttgcccatttgaagaaaagtataccactcagaacatttctggagaaatattagcattgtaaatttgattttcatgcctggggaaaaaaaatcaaactgcacagagaacatattcatgtgatattttggtttgtgaatcttgatttaacatatttgaaaggtaaaataaacaattccatgtgagcaagaatagaactgtttattttgacaaatcgagtccaagtttacaatcttagtcctcactccaatcttaatccttagtccttctgattgacccttaatgacttctagagataatcggatttaatcatccatccaagcccatggtggaaaaccaaaacatcttttttttttttttttttagaatagaagcaatatgatttaggacattaaaaatgcaaagcaattcagaaagattcttgcttttgaaaacaaacaagtagaaaacctatgtgtttttgcttcctgatattcatggaatgacatgaaagacattgctcattatcttgctagccacttgatattgcatatgccagatgcagtggctcacacctgtaatcccagaattttgggaggtgaggcaggaggatcacttgagggcaagaaattgagaagtagtgttgcattgggaaccgcaggtcacaaaccaaactgtagaaaagacaaggtccacatcttttaatagccagagctctctatagtcctgagacagtggatttgcatcactatcaaacagtaaatgaaaaataccattatattaaaaatagataagtgatattttgcttacgtggcagggtagtgaaattatgtctttgaatgtgtcattttacctgacctaacatctttttttgtaaaatgcatgtaattatagatttttcttactgggagactgtaaaaaacatatacccaaattaagttaataaagcacaacaatcaccctttgttgctgcctggggacagctaggtcctaaggttgggtctcatagctttcatctgttagttcagctcttcctagtgtctgagactgatcctattcctagttataggatattaaatgcattgccagccatcatttcagctttggcaaacatgagcaaactatgctatttcctgtgaccttgtgcccctacctcgtaactttcagcgtccatgtcctaccttatctgtagtcacagaaacttgcatgtcacaactaaggccctattttaatctcttggcactgcacagattttatagaaaatgaattcctattttgctttacccataccaactcagcagtggaactattgccaattttcaacaaccctaaatgcctactatcttctgctttgatttccctttttattggataattttgagtttcctgctgaaaagttttacctagctgctggaatggccaatgattacttcttcctggacttctatgaagccgttctctacactttggcccaagtcatcaccatctgtctctgaactactacaataattttctgttctctcgtttgccagccaccccaatacgaaagatcactttaaaaagtaaattggatcatgcagcatctctgctcaaaactactccagtggctttccagtgcattaaacagttctttaatgtgattcttgaagtccctgcttaatcttgcctgtgcccaatcctccaaagccattctgtctcttattcactgactgcttttaatcttcaaacccgctgccctttttctttctgtatattgcatgcacgtactattttccatctcttgcctcctttcccctctaagctcttaaaggtaatacctacccatctttcaggtctctgtgaatatgttatttccttggtacactctgttattttcccaatgagatctctattcagagcacttttcacaatctgtagtcaattatttatgttgtcttacttgcttaatggctgcttagatagtaggatctgtgaaggcagggctcagactcacatcgttcaccactggatacccaaatcttagcaaattgattcacttgtagagtaggttggtttgtggacttcatgtttaaactattaaatgaacagattgtctgcttggattataatgtatcgcttctttccctactctactaagaataattattgtttattgcagtcacatcttatgtaccaagaaatcagcatgaattacctcaaatccttacagtctcaatataaggcagatgttattattcccatcttacaagaatggagatgataaacatgtagtgatttgtgccaagtcataaaactagtcatgatgaagccagaattatgttccgaatctttttgactcccaagtctgtgctctcccacctcagaacattcattttctactgcccaaacttctccatcctctctacagataactactgtagagccatcaccaagtgccaacctgacccttgatgtgtgtgtcagcctttctcggtccagtcaggctcaccttcagtctctcacactgatgtggaattatcttcatgtagacaagtctcagtaattgagtcataagctagtatccatacttgctttttgtagcctagagatgtttgtttggttaggcagagcccaagcattccctacttgagtggtagctactacctaaattatttggtctagagcttgggagaaaataagttcccaacttacaatgtgaatagactcatggacatcccacttccccatgtatcctacccactgaacatttatgactgtggcaatagtcactctgaaatactagcagggctcacaatataagaaaacatttagaaaaggattgatgctttagaaccagagtttggggttttgtatcacccctcatgcacatgaaaaaatctgggtaaaaacaataaactccaatggaggaggagctggtagtgagcccatgatagagtcaccattgttaaaattcaagtatgacaccagagcacctaaggacgcctcaggaagtgagctcaccagttacgtcaggggtgtcttctgctcttacccttgtttgaggtctttgctctttcagatttataggaacatgggactacagaaaggagattgctttcaaagtgattaaattctggacaataatgtctatgagaagatgaaagaaattagtatcaatgcagttaaattagtgaaaggagtgaaagctaagctctcataaaatataaagcattattatcaagggattgtgtctttgttggatacatctaacctatgcttaataaaccataatattcacctctcttcagtttatgagattgccagttagtctgattttttaacagtgtgcttttcaacattcaatgtgtgagactgtttttaaccaatcaaattagaatcaaatttgcaagtgaaatgccacaagacagaacagtatattctctcctgaagttgaaatatgaaacaccattcattgccgaatttactaattttatgacccctatcccaaagtgcttggaagaggatttatgttgactatattcatgaggcttattgcccgtgatgtcattgctcattattgtgtttactgatttatttctcatatgcccaacgtcagttttgttttgttttgtttccttaaatgagtggaactgtcctttagaattgcagtgcatagggctgggcttgatggttcatgcctataatcccagcacatttggaggccaaggcgggcatatcacgaggtcaagagttcaagaccaacctagccaacatagtgaaaccccgtctctactaaaaataaaaaaattagctgggtgtggtggtgcatgcctgtaatctcagctacttgggaggctgagacaggagaatcactgggacccaggaggcggaggttgcagtgagctgagattgtgccattgcactccagcctgggagacagagtgagactccatctcagaaaaaaaaaaaaaaaaaaaaaaaaaaaagaactgcagtacatagttgataggaacagtgctaaactctttaatttagaaaattcaaggcaatcactgccatatattttcaattgtctgttctagctatgtggtgagcaacttgaagacatgatccctgaaattgaagagagttaagacatagagggttttaaggatctttaggattttgtgtgctgtgacacattctttttaatatggcagtataatcaccatttctaagatcatctctgtcttgaatatttcagccaaaagaaatgcaaatattcctgagggtagtaacctgttaataagtcagctgtcataaacagtttgtccagattaatgcctgagcaggagtagcacatgggaggtgagagccagaatgagggaaagggcagtacatttcaaaggagaaaggcagagaaaaatatttgaagaatgcaaagtagcttgaaccaccttgctgaccaatcttaggtatcatggttacctctgtggaagcacaaggtgggtatttgtttagacttgatccttcctgggacaaagtgctggtcaggatagtaaagggagattaaatgtacttaaatgtgcttccagaagacaggtatgtcatcataaagaagaaagggctattagctcctgacctacttagaaaaagtgtaactaaagtggaaccaggaattgtgtgagatctgcctatgtcctgttctctctctctcagggagagcagagggcaggaggtttcaccaggagctcacctgactctctcctaggcacctatgtttctgactttccttagatacaaccagaaagctaacacacttagatacttggagacatttgaaacaactcgacagccagttcactatccttggctacccaactgtttgggagagtaggaatgctccagaagaaaattgaatcggcaccactttcccattttgacccttgagaaaagaaagaaagaaaatcagcatttattgagtaatttgccttgtgccagacaatgtatcatatgttttatatataatattccacaggcagactctgttattccctttctatagatgagaaacagactctgaattgctttagacgactagcttaaagttcatgaggcccggaagggatgaacctagaatataaacccaagctctttaatttctaaatcagtggccttcctcactatcattatgctgtgttatgtaattgatatctggagttcagggaaaatcaccatactactttgtatgagaatagtgtgtatatgtatacatttgtattttatataaacctatgcatggacatattaaagtgagtttgtttgtttgtttgtttgtttgtttgtttttgagatggagtctcactgtatcacccaggctggagtgcaatggcgtgatcccggctcactgcaatctccacctcctgggttcaagcaattctcctgccttagcctcctgagtagctgggattacaggcacctgccaccacgcccggctaatttttgtatttttagtagagatggggtttcaccatgttggccaggatggtatacatctcctaacctcatgatccacccacatcagcctcccaaagtgctgggattacaggcatgagccaccatgcctggctgtgagtgagtgtttttgccaacctgatagccttggtttttttttttcctgtaccttctcagtgtcttgggatgggatccatgatacctgaggaagtaacaaagattatacaatcatccctaagtattcacggggaattgattccaggacccctgaatcaattccctgatataaaatggcaatctcaagtccctgatataaaatggcatagtatttacacataacctgcacacatcctctcatttactttaaccatctctagattaattaaaatacctaatgcaatgtaaatgctatgttaattgttatcatactgaattgtcttttatttgtattatttttattattgtattgttatttttaatttgtatatttttgacatttttaatgctcagttgcttgaatccatgggtgtataactcacagataaggaggcctgactacattcccaaagaagaaaaatgaggcaaatcagtcttttatttaagaatatttgggcatgttttatcgtatccacaatatttctttttctttcttttttttttttttttttttttttgagacagagtcttgctatgtcacccaggctggagtgcagtggtgcaaactcggctcactgcaagctccgcctcccaggttcatgccattctcctgcctcagcctcccgagtagctgggactacaggcgcctgccaccatgcctggctaaatttgtgtatttttttagtagagatggggtttcaccgtgttagctaggatggtctcgatctcctgacctcgtaatccgcctgcctcggcctcccaaagtgctgggattacaggcgtgagccaccgtgcccggccacaataattctttttctaatcatggtaaagtgttcagcaaacatgccaggtttcccagtgtttcaacatgcaggactaatcttgtagttaatgtatattccttttcttcctgagccttttaacaggagatgtttttgcctagttgttgttatttttctaattgcccaattttcttttctctgttaaacactaattaaagaatgatctcaggactgccacctttttggagaaaacattaatctgctgccctcgctacattttaatgggcctaatttatccctattatctactcccttcaccaccccaactgagcaaggaaaacattcttatcccctgcacccttctcatactctactgcatttttgcattttattttccctactagcttcaactgatgctgcctagccttgtttatgtttacttttcattatcagcagaatatgcatatgactataagtcttctctcctcctccctctttccctgcttgatctgctctgtattaatttcttttcctattactaaacctgtatgtacctgtatctgttgatgaattaattaatcacccagacatagctcagcacctgtatgaaataggctccaggacactgaagcatcaattctagtctccaggaaccagcagtctgaaaggagaggccgacacataaacagaaaattgtaataaaatgtggtacaggcaaccatacagattagaagaagattcaggaacacacagaaggagctaccactccagccttggtagcagggaaggcttcccctattggctgtcatttggaatgattgaccataccataggtagaaaaatgggttgaatccagaattcatttgcattaatagcaaaccttgataatcagtgatattgacttccctttcatctcttttacacaactcagtaatatttccattaagaaaatattataaggcactttggaatgtccatattaaaaatagtatattaattaaaatagcacaaagctcaactaataatcaaaccagccataaactatggagcaaagaactttgtttccaagagatttaaaaaaaaaaaagaaaaagacaaagctacctgtaagccctgagctgattgtattggcttttaaagactttttaaagcctctccttaaagcaaatcacactgtattagtctgttttcacactcatgataaagacatacccaagactgggcaatttacaaaagcaagaggtttatggacttacagttccacgtgaccggggaggcctaacaatcatggcagaaggaaaggaggagcaaggcagatcttacatggatggcagcagacaaagagagcttgtgcagagcaactcctgtttttaaaaccatgagctctcatgacacccactcactatcatgagaacagcatgggaagacccatccccattattcaatcatctcccacctggtccctcccataacacatgggaattatgggaactacaagatgagatttgggtggggacacagagccaaactgtgtcattctgtccctggcccctctcaaatctcatatcttcacatttcaacaccaactatgccttcccaacagccctccaaagtctccactcatttcagtattaattcaaaagtccacattccaaagtctcatccaagacaagcaattcccttctacctatgagcctgtaaaatcaaaagcaagttagttacttcctagataccaagagggtacagacattgggtaaatacaccaattccaaatgggagaaattggccaaaacaatggggccacaggccccatgcaagtctgaaatccagcagggtagttaaatcttaaagctctaaaatgatctcttttgactccatgtctcacatccaggtcatgctgatgcaagtggtaggttcctatagtctttggcacctccactcctgtggctttgcaggatattgcttccctcctggctgctttcacaggctggttttgggtgtctgcagcttttccaggtgcacagtgcaagctgttggtggagttaccactctggtttctggaggatggtggccctcttctcacagctccactaggtggtgccccagtagggactctgtgtgggggctccaactccacatttcccttccgcactgccttagcagaggttctctatgagggtcccacccctgcaacaaacttctgcctgggcatccaggcattttcatacatcctctgaaatctaggcggaggttcccaaatcccaattcttgacttctgtgcacctgcaggctcaacaccatgtggaagctgccaaggcttgaggcttccaccctctgaagcaacagcctgagctataccatggccccttttagttatggctggagtggctgggtcacagggcaccaagtccctagactgcacacagcagagggaccctgggcccggaccacaaaatcattttttcctcctaaacctctgggcctgtgatgggaggggctgccgcaaagttctctaacatgccctggagatattttccccattctcttagtgattaacatttggctcctcattacttatacacatttctgaagccagcttgaatttctcctcagaaaatgggattttcttttctattgcgttgtcaggctgcaaacttcccaaacgtttatgctgtctttcccctttaaaactgaatgcttaacagcacccaagtcacttcttgaatgctttgctgcttagaaatttcttctgccagataccctaaatcatccctctcaagttcaaagtttcacaaatctctagagcagaggcaaaatgccaccagtctctttgctaaaacataacaagtgtcacctttgctccagttcccaataagttccttatctccatctgagaccacctcagtctggaccttattttttatatgcctattagcattttttgtcaaagacattcaacaagtctctaggaagttccaaactttcccacattttcctgtcttcttctgagccctccaaactgttccaacttctgcctattacccagttccaaagtagcttccatgtttttgggtatcttttcagcagcgccccactctactggtaccaatttactgtattagttcattttcatgctgctgataaagacatacccaagactgggcaatttccaaaaaaaaaaaaaagatttatgaacttacacttccacatggctgggaaggcctcacaatcatgatggaagacaaggaggagcaagtcacatctcacatagatgtcagcagggaaagagagcttgtgtagggcaactccagtttttaaaaccatcagatctcatgagacaaattcactctgacaagaacagcatgagaaagacctgcccccataattcaatcatctcccaccaggtccctcccataacacatgtgaattatgtgagctacaagatgagatttgggtggggacatagagccttaaccatatcatacactcagttctgatattcttggctttctgacatcctggacaattagcaataaccaaacctaaaaggtagagagttatttgaaggattgtattttgatcccagggaaaatgtgacccccaacacctgaataatgaaaaagaaaaaaaaccatacacacagaaactatgaaacagttgaacaaaaaacctctttgaaaaccaacagatccagggaataaaaataacagcagatatttagctttctcaatagctctccctgttgtccctgcatgataaagagcacaataattagtgttgacactgacggtccagaggcagcagataaagatttatttagattaaaggaaattcatttcagaaggtaaagaagatggataatttatggtgaaaaatttccctgaaaactgaattaaatgaaacaattttcttctttagcaggaatatatttcaatcagcaaatgaccacacacatttaacactgtgtcatcctgaggttgatattggatgctcatgagtttcttttttgtttgcttttggtgttaacttactgcctctcttgcggttttccagattgctaaaccttctctattgaaactcttctgtatgtcttaaggtactcctcaaatagaaggtgactgcgattgtttcaaaagagaaaattgtttctcatgtcagcagtattttatttctttgtaatccaagaaaaaagagatacttgtttaaaaatccaaagttctgacatcttgaatataacaactgacactaaaagttttttaaattgattcaggacaatgcatttaaaacatatttataaagcactttatatagatcatcaagtgactttagatatagcctttcacattacaatgaattatattttgttcagctttcttgtcatggtaatccatttcatgtgttttcttttcacagctgccataatactctgactcaccattgccttttttccataattatcagcatattctccttaatcatatggaaatctattattatttttgtctcacggcattacagaatgtagacctgaacttttccgaccatgtcactacagattaagatgtggattctttagaatagaatgtgtatttttagaacaccattgtgttcccaacccttatgtaaacatcactatcatgtagaccccaaggaatccttgatttcaggcatagccttgctggggagaggtactcacacacagtgggattagaacaatttgaagcctatgcattatttggggctaaactgaatatatgacttgcacatatagggaagatccttgtatttgtaagatgctatcacatcacatccaatgttctttaacaagacatgatcaattttgaaattcaagtgtttaataagcttctgtggagaagcaacaaaaacacagttttgcatggtgaaaagagagaagaggtatctacatatagtgcgggcagggagaagcgagtgcattctatgttcctgttctatcatctgtgttacctgcatcttgtactcattctgattctggttgtccctccctcccctacatctcccactctgaggtggtgttttgaatgctcttgaaagtctgtcacatttgcttgatatggttttggcctgaaaacattagaattgataaaccaatttgtttttttatgaatcactaataatttgagcatgatagatttcctctaaatgcagagctcattctttcatggccatctgatgtattaacagaagctggtctggagaaaggctgaggcttcctccttaagcatgttcccagtgccaactgataagcaattagaaaaagcagagctggcatctgaaggctcctgtgttctagggtgggcatctcaatatctgattctcattccatcgtattcatttctggttgtgtgactttgcttacttatagtctctgaggctacgtttcttcccctgataaatgaagggttttttgattttgcacaggactattcctgaaatagccatgggaaatgaatggagaatagtttgtatatatttttaaatccactgaaataaatctggtcatttattcttttcttgaacaaagattaattacagatgtattggacattatgtctataggaagggtaggaggtgtggtacaatagaaattccagacagagagaaatggagatgatgatagctatattgagcctagcagggccattggcctccttgctagaaagtttgaatttatgctgaaggcaaaataaggagatatgattttatgtactttaaagatccaactaaaaccgcatggagactggagtagagagagaggtgaaatggaggcagagagcatccttaaaaataatccagtgaagagatggtgagtgtctgaactagggcttatggcattagggatgaggaagtgtggagacagatgaggaataactaagggatagagttggcattgcttggaacataattaatgtgggaggtgagcaaccctggggaagatgctaagttcagtctgggacaagttgagtttgagggcatgcaggcagagtgaatggttttatataagtgtttggagtgtgggagagggtttagggatatagctatagatctggagtgcagcagcacaccatatataaataaggctctttgggccactgaattgatgagattgcccaaggagagaaaggaagatagcaaagaatagaattctggggagcagcagaacttaggggagcaactaagaaagggagccaaaaaaggaaactgagaaagaatagtcaggcagctgagagaagaacaagaagggtggagtcacaggaaaaaagaaattgtcagcaataacacatgcagggagatcagatgaaataagaactgaaatcatccagtggtttgtggatctggataagtagctcagagagaagtcagatgtgtttccagaaaatgtttattgcttaagcaagaccaatccctgtgctagggtactttgccaaggtttctaaattggctttatttacagaaggattacacctctacaaatgcacacaggtcaatcaatccactccattctcagccaagatcattatgacttcttttcatatgtgctttaattttcgttcatttgtttgtttgtttagaaataggagtgttgaaaaataacctagttgccaatttggttatgtgcaactgttaaatatagatggataaatagatgggtggatagatagatagataagacagataaatagtggctaccaaaatgtttgaggtaggagagcttcagctactctcttactatactgctaacaattataaggaaagaaattctcaacaaaatgtattgatggattctcagtttcctgtcctaataggtgctctgaacaatagcttgcatgaaaggagcacttgaggtaaacctgctgcctttgggaggcaggattgttaccttatgggagtgatcaggcaggcagaaattctgcatctcagtctcggggcacagagcatttagggctgagacctcgcgtaccatccctaaggatccaggcctcaggcatagctatatgatttgttcttcatataatcgtgggcagtatctctaaaatattttagcccatccacaatgttgaatatcagtattttcacccatgaatcatccgttgtgttaattaactggccaacaatttcaccaatgaaaagccatttctaatatttgttatgcaaagcccctgatgttaattgaaatatacctaggagcatttacactggccacctctactgtgtgacttttatgggggaaaacttgtgaccacccatgagggtgtgaattcctgattaaggcaataaactgctccttcagtgggatttaaagaaaagaacacacataactcactctttttttctaaggagaattttaaagtaaatagaaaatatcatagtaaggaggtaggaagactgagacatcattgtgaaaccaccaactacatctttgtgatgaatgaaaatatcatttggaaacaatatctgtcacactaaaaactagcctttcagagtatgtttattctttttttttttaattcttttttttttttctgagaaggagtcttgctctgttgcccaggctgaactgcagcggcacgatcctggctcactgcaacctccgcctcccaggttggagcgactcttctgcctcagcctcctgactacctgggattacaggtgcacgccaccacactcagctaatttttgcatgtggggtttcaccatgttggccaggctggtcttgaactcctgacctcaggtgatccgcccgcctcggcctcccaaagtgctgagagtacaggcttgagctactgtacgctgcccagagtatttttattgtgccacaaatttttgaaatcctctccataaccgatgttcagatctcattctcttatgaacatttttgtcatagcccactcattctcatacacacagacacacacacacacacacacagacacaccacacgcacacacatactaaaaacagcatgatcatcaaattgcctgaagtgtaccatcataatatttcacatctgtgcttgtacaaagagaaatattctgatgctctgctgtacctgcaagttgtttcagtcagttaagaggttcctcagctaacaacctgagtaaggctatacatgattaagttaaagagcgaaaacccgaatgctagcatagacctgtagtatttatatatcatttttttgattacaaaaatattggtatgcttattacataacgttcaaatattacagaaaagcctaatgtagaaaatgaatatcttcagtaatcctatttcctaagataactgctgttagcttggtgtggtttatggaagaacttttcccttgcaagaataaatatatgtaaatacaattttttcgataggatcctagtcatatatgttgttttacaatttttaaataattcaccctaaacacatcttctaatcagtatgcagagatagttttttagataactttagggtttccatttccaatgtcaaattaaagccatcctattacatactttctgaacacattgtttttctttcttttttattagactttaagttctagggtacaagtgcacaacgtgcaggtttgttacatatgtatacatgtgccatgttgttgtcctgcacccattaactcgtcatttatattaggtatatcgcctaatgctatccttcccccctccccataccccatgacaggccccagtatgtgatgttccccaccctatgtccaagtgttctcattgttcagttcccacctatgagtgagaacatgcagtgtttgattttctgtccttgcgatagtttgctgagaatgatggtttccagcttcatccatgtccctacaaaggacatgaactcatccttttttatggctgcgtagttttccatggtatatatgtgccacattttcttaatccagtctatcattgatggacatttgggttggttccaagtctttgctattgtgaatagtgccgcaataaacacatgtgtgcctgtgtctttatagcagcatgatttatataatcctttgggtatatacccagtaatggcatggctgggtcaaatggtatttctagttctagatcgttgaggaatcgccacagtgtcttccacaatgattgaactagtttacagtcccaccaacagtgtaaaagtgttcctatttctccacatcctctccagctcctgttgtctcctgactttttaataatcgccattctaactggtgtgatatggtatctcattgtggttttgatttgcatttctctgatggccagtgatgatgaacattttttcatgtgtctgttggctgcataaatgtcttcttttgagaagtgtctgttcatatcctttgcccactttttgatggggttgtttgattttttcttgtaaatttgttgaagttctttgtagattctggatattagccccttgtcagatgggtagattgcaagaattttctcccattgtgtaggttgcctgttcactctaatgatagtttcttttgctgtgcagaagctctttagtttaaatatatcccatttgtctactttggcttttgttgccattgcttttggtgttttagtcatgaagtccttgcccatgcctatggcctgaatggtattgcctaggttttcttttaggctttctatggttttaggtctaatatttaagtctttaatccatcttgagttaatttttgtataaggtataagaaagggatccagtttcagctttctacatgtggctagccagttttcccagcaccatttattaaatagggaatcctttccccatttcttgtttttgtcaggtttgtcaaagatcagatggttgtagatgtgtagtattatttatgagggctctattctgttccattggtctatatttctgttttggtaccaggaccatgctattttggttactgtagccttgtagtatagtttgaagtcaggtagcatgatgcctctagctttgttcttttggctgaggattgtcttggcaatgtgggctcttttttggttccatatgaactttaaagtagtttttttccaattctgtgaagaaagtcattggtagcttgatggggatggcattgaatctataaattaccttgagaagtatggccattttcacaatattgattcttcctacccataagcgtggaatgttcttcctttgtttgtgtcctcttttattttgttgagcagtggtttgtagttctccttgaagaggtccttcatatcccttgtaagttgggttcctaagtattttattctctttgtagcaattatgaatgggagttcactcatgatttggctctctgtttgtctgttattggtgtatagcaatgctagtgatttttgcacatttattttgtttcctgagactttgcagaagttgcctatcagcttaaggagattttgggcggagacaatggggttttctagatatacaatcatgtcatctacaaacagggacaatttaacttcctcttttcctaattgaataccctttatttctttctcctgcctgattgccctggccagaacttccaacattatgttgaatagaagtggtgagagagggcatccttgtcttgtgccagttttcaaagggaatgcttcaagtttttgcccattcagtatgatattgggtgtgggtttgtcataaacagttcttattattttgagatatgtcccatcaatacctagtttattgagagtttttagcatgaagggctgttgaattttgtcaaaggccttttctgcatctattgagataatcatgtggtttttgtctttggttctgtttatctgatggattatgtttattgatttgcatatgttgaaccagccttgcatcccagggatgaagccaacttgatcgtggtggataaactttttgatgtgctgccggattcggtttgccagtattttattgaggatttttgcatcaatgttcatcagggatactagtctaaaattctctttttttgttgtgtctctgccaggctttggtatcaggatgatgctggcctcatagaatgagttaggcaggattccctctttttctattgattggaatagtttcagaaggtacaagctcttccttgtacctctggtagaatttggctgtgaatccatctggtcctggaatttttttggttggtaggctattaattagtgcctcaatttcagagcctgttattggtctattcagggattcaacttcttcctggtttagtcatgggagggtgtatgtgtcgaggaatttatccatttcttctagattttctagtttatttgcacagaggtgtttatagtattctctgatggtagtttgtatctctgtgggatcagtggtgatatcccctttatcattttttattgtgtctatttgattcttctctcttttcttctttatttgtcttgctagcggcccatcaattttgttgatcttttcaaaaaaccagctactggattcattgattttttgaagggttttttgtgtctctatctccttcacttctcctctgatcttagttatttcttgccttctgctagtttttgaatgtgtttgctcttgcttctctagttcttttaattgtgatgttagggtgtcaattttagatctttcctgctttctcttgtgggcatttagtgctataaatttccctctacacactgctttaaatgtgtcccagagattctggtatgttgtgtctttgttcttattggtttcaaagaacatttttatttctgccttcatttcattatgtacccagtagtcattcaggagcacattgttcagtttccacgtagttgagcagttttgagtgagtttcttaatcctgagttctaatttgattgcactgtggtctgagagacagtttgttataatttctgttcttttacatttgctgaggagtgctttacttccaactgtgtggtcaattttggaataagtgtggtgtggtgctgaaaagaatgtatattctgctgatttggggtggagagttctatagatgtctattaggtctgcttggtgcagagctgagttcaattcctgggtatccttgttaactttctgtcttgttgatctgtctaatgttgacagtggggtgttaaagtctcccattattattatgtgggagtctaagtctctttgttggtctctaaggacttgctttatgaatctgggtgctctagtattgagtgcatatatatttaggatagttagctctttttgttgaattgatgcctttaccattaagtaatggccttctttgtctcttttgatctttgttggtttaaagtctgttttatcagagactaggattgcaacccctgcttgtttttgttttccatttgcttgctagatcttcctccatccctttgttttgagcctatgtgtctctgcacatgagatgggtctcctgaatacagcacactgatgggtcttgactctttatccagtttgctagtctgtgtcttttacttggagcatttagcccatttacatttaaggttaatattgttatgtgtgaatgtgatcctgtcattatgatgttagctggttattttgctcattaggtgatgcagtttcttcctagcatcgatggtccttacaatttggcatgtttttgcagtggctggtaccagttgttccttcccatgtttagtgcttccttcaggagctcttataaggcaggcctggtggtgacaaaatctctcagcatttgcttgtctgtaaaggattttatttctccttcacttatgaaccttagtttggctggatatgaaattctgggttgaaaattcttttcttcaagaatgttaaatgttggctaccactctcttctggcttgtagagtttctgccgagagatcagctgttagtctgatgggcttccctttgtgggtaacccgacctctctctctggctgtgatgggcttctctttgtgggtaacccgacctctctctctggctgcccttaatattttttccttcatttcaactttggtgaatctgacaattatgtgtcttggagttgcccttcttgaggagtatctttgtggcgttctctgtatttcctgaatttgaatgttggcctgccttgctaggttggggaagttctcctgcataatatcctgcagagtgttttccaacttggctccattatccccgtcattttcaggtacaccaatcagacgtagatttggtcttttcttatagtcccatatttcttggagcctttgttcgtttcttttactcttttttctctaaacttctcttctcgcttcatttcattcatttaaccttcaatcactgataccctttcttccacttgatcaaatcggctactcaagcttatgcattcatcacatagttctcgtgccatggttttcagctccatcaggtcatttaaggtcttctctgtgctgtttattctagttagccatttgtctagtctttttttcaaggtttttagcttctttacaatgggttagaacatcctcctttagttcggagaagtttgttattaccgatcatctgaagccttcttctctcagctcgtcaaagtcattctttatccagctttgttctgctgctggtgaggagctgcattcctttggaggagaagagctgctctgatttttagaactttcagcttttctgctctatccctatctttgtggttttatttacctttggtctttgatgatggcgatgtacaggtggggttttggtgtggatgtcctttctgtttgttagttttccttctaacagtcaggaccctcagctgcaggtctgttggagtttgctggaggtcgactccagacgctgtttgcctgggtaacaccagctgaggctgcagaacagcaaatattgcagaatggcaaatgttgctgcctgatccttcctctggaagcttcgtctcagaggggcacctggctgtatgaagtgtcagtcggcccctactgggaggtgtcttgcaatttggctactcaagggtcagggacccacttgaggaggcagtctgtccgttctcagatctcaaactctgtgctgggagaaccactactctcttcaaagatgtcagacagggacatttaagtctgcagaagtttctgctgccttttgttcatctatgccctgcccccagaggtggagtctacagaggcaggcaggcctccttgagctgcagtgggctccacccaattcgagcttcctgaccactttgttttcctactcaagcctcagcaatggcagacacccctcctccagcctcgctgccatcttgcagttctatctcagactgctgtgctagcagtgagcgaggctccatgggcatgggaccctccgagccaggcatgggatataatctcctggtgtgccatttgctaagactgttggaaaagcgcagtattagggtgggagtataccgattttccaggtaccgtctgtcacggcttcccttggctaagaaagggaattccccgaccccttgtgcttccaaggtgaggtgatgccccgccctgcttcggctcacactgcgtgggctacacccactgtccgacaagctccagtgagatgaacctggtacctcaattggaaatgcagaaatgacccatcttctgcatcactcatgcttggaactggaactctgaacagattcttttcagcaggcacagcagtttaattaatatggaaaataacaataataataataatgtatattgaatgtttgtgtccaacaaaattcatatgttgaaactgtaatctcattatttggaggtgacgcctttgggagttactaggtcgtgagggttgatccctcatgaatgagatcagtgcctttataagaagaagccatagagctagctatctctctttttaccatgtgaggatactaggagaagttggtagtctgcagcccagaagagggccctccccagaagccaaccaggctggcactccagtcttgggcttccagcctccagaacggtgagaaacaaatttctgttgttgacaagtaatttgttatagtagctctaactaagactagtaaaaataataaagaaaatattcacagacataatcaggaaatatttctccggggcctgacttagcctaagctatttccattttttttttttttttgagatgaattcttgctctgtcacccaggctgtagtgcagtaccacaacctcggcttactgcatcttgtgcctcccagattcaagcaattctcatacctcagcctcccacgtagctgtgactacaggcgtacaccaccacaaccagctaatttttgtactagagacggaatttcaccatgttggccaggctggtcttgatctcctgacctcaagtgatctgcccacctcggcctcccaaaatgctgggattacaggcatgagccaccgagcccagcctatttctacttcttagaggccccacaaaatgataatgaaccagatgaatagtttctatgtagcttttgaagcaaacactacagggttggttggcatatatatattgctaagcaggcaaagcttaaattatggacttcagatgcccatttttacattggtttctaaacccataacttcatataacttcatcctcttcatcaggaacccagtgtctcggggtccaaggacaccttagtgtgagtgccagctctgctactcagcagctgtgtaattctgtgcaaatcatctaacctctcaaagcctcagttttgttacctttaaaatgggcctaatgccttccccacagagaacctaaaaattaaagatcagactcagggtctgacccattgagtgacactgaaagcccatggctttcaagaaatgttacttccttactcccaaatccaaacctgctctaagggagtgataactgactcttaattgttgtaggcactatattagatattgctgagtacacattttcactctttccactaaactgtgattttcattttataaaaactgtgtaatgattttgttgttgttgatcatttgttttccccaaagtgaaatgcagaacccaggctagtagcagataatagcagagccactgtggttgaaatggggagaggggttcagggctggaccacttgatattctgcacacctgagcctcctctgcagagcagagcgctcccagaacacagcttgaaaacctctgcataggccatcatgcttcacaggaactgttgcaaaaggatctcatttattaatgaggccatatcacaggttaataactcattatgatgtatcctctcaatatgtttgcatttgcctattacctaactctgaagaatgtgtttctaaatatgaatattccagcataacaccaatcagctagaggttatttatttttcccaacttggggatgagctgaaagggtggagcagttgaggtgttgagtacttctcaatatctctgttttcaccaactgtggaaaactctctctcttgactacccataagtctggctctacccagagagaagtaaactgctttgggctttggaaggcaagaagaaaatggctgtgggtctctgtttgtgccccatcttatgggaagaggctgagggggcagagatatttgctcaatcaacaaggtgacagctcttacagtacctggaggtgggcagaccttcaggacatcctatgttaatccgacagcagtttatggattcatgaaaagaccagacaaacctatatttaaagggattgcccttggggcagacatccgattattgaccaatgtattaaaaggtgaatagaaaggcagtacaacaaagtagttaagagcaagggctctggaatcagaggagattggaattcagctctgatatgattagctctgtcaccttgaacatattccttaccctctattaggctcagttctcttgactgtaaaatgagagtagtcatattgtttactcacagggttgttgtgagatttagaagacataatgcatgtaaagcccttagcccagtgcctgctacttagtaaggactcaataaatatagctattagtattcatgttggcctccttatgcattcaactttctccccatttgacaaagtgaaaatatatttaagagtactttgtgttgttgaattggtgctacaatttatttaatgcttagaattatctgaggtataggataatacttattatgagaaatatttaatcgtatcatttagtaatggatgattacacacattaaaacctcaatttaatgttatgtagaatcacatgctaaggatccacaaccagaatataatcacctgtgtagactgtacttaggttacttggatatcgtggcaattattagtggaaatagagaaatccattttcaagagctaaagaaagagaaagaaagaaagaaaaaaagccaggattgaaccttgactgacttaggttgctaagaccttgacttttgtcatattgtaattttgagcacaccatctttgcatcccatctttgcatggcctttgcaatgccatctttgattgcagtaattctgtgcaataaactttgttcagtatcccactatattcccaggattctgcacagtgagaggggacttagcaatatctataattcaaccaaattattgagaaactattgggtttgaagcactgttatctattattatcttaatacacaatgttcctatagcatttaatgattttaaaataatttcttttatatattttcacatttgattcaacctctttgaatccctatgaattatctaggtgaggatcaaagtttctaatttctatcgcttttgttttaaatatatactacctaatttaagatctagaataccagtctgtgtccagactactcaccaatcgacccattcacctatcttctctgtaatacctgtaacactgcagagttgatgtacatagttctttacctttgcccattctatttcctcagtacctgcctttagaaagggtttgattaacaaaaacaaaaatctatatctaataagaaaaattaaatatataacaaaacctcaattttgtgtccattattgattcatatttctagccctcttgcttcttaattagcactctttttgttaagtccctttattttctctccatttaacataaacacatcaagagaggtttctctatgcaactttatgtttaattactctgcattttatatcaactgtttacatttttatgatataacagatgtatgtttattccttccctcacagtacattaaattgaaacaaacaaacaaaaaaaacacaaaaaccacaaccaacaaaccaacaaacaaaaatacccaacttcctgtgcaattgcatccctttaataccttactttgttttgaccacaaaggatactgaatgcagtataccaaggatactgctggggatactgactgcagttcttcctgtaactgtaaaagttcacgatttaaatgaattcctttgccctcttcttctgccatagacatactaattcatcagttcatgcttgatacttggaaagaagctacacaatgctcctctctccccagtctcctggagtcaacactgaatatttttgacacactcaggacgtctgccacatgggctcacaaataatagaagactcatcagcttttatatggcatccacgttttttccttctgcctcaaggcaattaatttaacagtaagttgcctagtttttgcattttttaaattttcagctgggcatggaggctcatgcctgtaatcctagcactttgggaggccaagactggaggactgcttgagctcaggagtttgagaccagcctgggcaacatagcaagacctcggctctattaaaaataaaattaaagagttaagaaaagattccttctttgggatggccttcatggttctgggtactgctgcatttgtcatggatagtcacactttgcagtgatttcttccatgtttgctgcttctgttggacttcttgctgctggtgtaggagcccaccatatgtgtgctgaagctcagcttgtacaccctctcatcagaagttagaattcttttctgctattttagagttatatattttccatctgagtatctaagctttaggaccttaagggtctgttaataacaatacttctttctggttttttgtttgtttttgttttgttttgtttttgttttctgagacagagtctcactctgttgcccaggctgaattgcagtggcacaatctcggctcactgcagcctccacctcctgagttcaagcgattctcctgcctcagcctcccaagtagctaggattacaggcacccgccaagcatgccgggctaattttggtgtttgtagtagagacggggttttaccatgttggccaggctggtctccaacgcctgacctcaagtgatccacctccctcggcctcccaaagtgttgggattacaggcgtgagccaccttgcccagcccttcccgtttttattaaagactaccagctgcatataataggaatcaagcacataggttctgatagctcattaagtgtaggattactgccctctttcaaggactactactttcttactgggacaaatgttggcttaagttctttccccagattggattttcttctgcagtagaggggtgtatggtagagaaggaagtgatatggggacctcaggccagctggcaagttggaaagaaatcccatttcttacaataccccaccctgcccaagttaggggcttacaattctgctgacccatgctggggcaccatgtcccaggaatggctaagtgaaaggtgatttaccaattcagcgactatactagaaaatgcagactgagtctaaatctcctttcatgagccacttattcctgatatactcatttcctggcattcagcttcctttcttccattggtacctcttccccttaattattgaaaatttcatggaagaagggtggaaatggatccgatgctgcactaccttggtttgattttccatgtgctacatgtcttataaactgcctgagcaatcaaaaagatgaaggaaaggatgaggtggtattggacagccaaagagctttcagattaatgatcaaaatgtgtgcaagacagatccttttggtaggatgctttttataggtttttaatttctgaaatttaatcatgcaggtttaattgcctccagttgtatggctttaaattgaaggagtttggctttttatctaaattgcttcataataaaaccactgcttttgagaatgcttaccagtgctcagactcctggaaggctttgccattccccaccactgccaaacagccaacacttgacatgtagaattatggagagcaaaccaacacatcccctttgcccaagccaaacacaagggcatttgtcaatacacagtgagataggagtcaggatgaaaagcactggtgacaaaaaccaggctagaaaatcagccataggccccatcatctcatcatcctggtctatattttttaaattacttttctgcctccagagtcccaaattctgcttatacacaaagcaagtcttacttccacaataaattattctcatactctacctgatttcaaattatatctttatcttatcacttatatttccttataccatgcatagttttgttaatatttaaatattaaatttgctgtttatatttgcaaatcttatataatgcaaagagaaagtcatgactcagatcttctagagactcagatcctaaaggttagggtgaaggaatttaaggtccaaagaaatgccataggtgactcctctgaaatggtacaactagttaatggcaaagacagaactagaattttggtcttctaaagcccaggcccaagcacttttttcttcttcactcttgctgtcacaatacataaattagttagctggtacacaaaccctaggaagccaggtgggtgtacaaggatgtacaagaaaaactcaaaagtatttgtcatctcattgtaaataaagcttacgttccctatcaggcagtgataactttatgcctggatctctttagctataatctcaaatcccaccaaagcaccttcttacacagttggatttgcaaatatgtacaatataatatgtcagcatttttgtttttgttgtttaataaatgttaaagtcctgaaatttgaaaaaaagagaatgagattgtggtttcttttgagatttcatctaaaatgactgtggacttctcctaatttgggggttatattagttttgcttggataggatttgtattcgggaaaatctcagtaattgattgtactcatgcagctctccataatctgtttttttacatcctaggtttcagatacccatcatgaccatattattatctgtttattgagtttgtaaattctatgggctgtccagtgcactggaaagatcaggcaaattgagttaaagttagtgtttctcaggatgtaacagaggctttctttgagtggtctttatttctggaacgtaatgaagaatacttgttttccaggaggcttttggtcaataaagcgataaacgaaaacatcaggaagtcaggatagaggaagggaagagagaggaattgctggtggcgcaatctcggctcacagcaacctctgcctccagggttcaagtgattctcctgcctcagcctcccgagtggctgggattataggcatgagccaccatgcccagctaattttgtatatttagtagagatgggttttctccatgttggtcaggctggtctcaaactcccgacctcaggtgatctgcctgccttggcctcccaaagtgctgggattacaggcgtgagccactgcgcctggccctatttcttacatataaaattttctcagtctccttaaacagccatatcacagaacactcaagagttctgtgttcttgtcacaggacactctttaatctgtctgttggaaggaaagagtgaccaccacttaggatatatcctaaaagcaactttgctttctacagaatgaactaggctcccatctagtttggaaaatttgatcccatttaaggctttgaatcaatgctcatgcctgtggcttcagatgtgactgataatcttaaaaagaggtattatcccagcctccttggtgttgtagtttgccaggtccaaggtaatcatactgtttagataccacacttgagtatatgcattacgggtagtaaagctgacatataaggagttaagaagaaagaaatctgccagtgccagttcctagtgtgccattggcactcagtgctcttagatggcccctcgattgtcccagccagagaaccagccttagctgctcacttcccatgacttgttctagccctcttgacacataaactctcttgtcttctgttctcatgtccctagagcttaggatcctgctcatatcataaagaatacagaaagaaggacactctcaactgccagctaccaaggagaccccacactgccacttctcaatttataccaaccacatcatcttcattagcacccacccttaccctcttctcttttataattaatgaagcatatgtcttctggccataagcaagattctctccacctaagtcttagagtcgggaatgacattggcatactcatggcttgtatctctttgccaggttttcatatctggcctgtcaattcagtcagtcctctacagctgcatttatttttatttttatttttattttattttgagatggagtgtcgctctgtcgcccaagctggagtacagtggtgtgatctcggctcactgcaacctccatctcctgggttcaagcgattctcctgcctcagcctcccaagtagctgggattacatgtgcctgccaccatgcccggctaatgttttgtatttttagtagagacagggtttcaccatgttagccaggatggtctcaatctcctgatctcgtgatctgctcacctcggcctcccaaagtgctgggattacaggcatgagccactcgtgcccagccacagctgcatttattaatgctacaagagacctacctctagttgctaaactattaggccctcttcagtcaattgatcacatcctcaattatacagctttttttttctttcccacacctttcttgcttccacagattaaatttaattgtccttttagagctgttaaaatagaaggatcatttccacctaacccccctgcccagttctgtgcaggataaatagcttaagaaaactcagcctgctgcatccaaatccccacactgcaccagcctggtcactatcacatggaccccattctagtgtgtcagtatctttccttaagggggccacacaataaaataaatgtttggttccatgagtggccccaccagtgccatggaggtcagtgctgtctcctccttgggaatttgtgttgctgtccccaagtgacaaccatccagcaggttcactctcagagctccaacctggccatggctacatttggaaaagaaattaaacatttctctaaatattggaaaagcagagcccgattgcccttttctcaactttgtttcttttaatctaaactgcaaacacaggtcacactttgtgaagagaaatctcatttgtgtctctgggcactgctttgggattcagaacttaggttcttaagatttatgacagactgatgctgtgaaatcagttgttcctggctgcaaatcatgaaatcagcaccgagttggccataaaaaatgaaagttttatggtaagtggtttaagaaaaatgcagaatatgagtcctttgtgatgtatatgttttagagcagcaattccctatttttaattttttttgaaaacattctccattgccatagtaggaaaacatcatgaagtaacttcattgaaaacagctatgtatatagaatagcatataatggttctgtcagacttattttcctactagctgaagcataaatgtaggatgatgattttttttcctgaggaattagattttattaaaatagttgctttgtatctcattcagccttgaagtcaaagcaatgggatcctacataaatgaaatttgttgatctagtgcaagctaatacagaaatcaatttcaatttcctttggatgtactattagtgtttatctgatggtggatttgtgttgttttaagtgatagctataacaaccaaaaatactgattagatactaggagccattcttgatctcaattcagaaagagtgtggcattatcctttttgtgtataatgaattggttctgtatcacagtttttaattgatcattcccaatattaagttcctccaaaagtttaataatctttttttctgtggcattcattatcagatgaggattgagataatccatccttatgatggccttccatgacttcagctaatgggactatgtgttttgtggaacatacctaaattgctagggttaaaacagctcatttggataattacagttggtctctcttaataggcctgtgatttcattctatgttcaattagacgaatacttaactatgacttcatgatgaagggataaaggcatggttttaaaccgaactcctctgagggactggaggccttttccctatgactagatcttgagagtgttaccagaggttcaaggtcacacagctgccctgaaacttgggatgttggctgttcaaatgtgtttgttcgtggcaggtgccacatcggcacaggtgacttagagtgtcactgacaatttgtggggcttctgcctatggtggtgtacatctctcggatccaactcactgcggcactggcatcactctgatttgactggtccccctggagtgaggcagtgcgtggcttatatgctgtacacagacagccatgctttcttgtcttcatatctccctccaccctactttttccctcgagcttgaatttgggaagccttttcgtacaggaaggacctgatggaggtcctgagtgacaaattccccaaacctacttcatgactctgggggccaaagggacctgaaattcagactaaaatacttgacatagaaacatctccctctttctcatatcccatctcacacctctccttgggccccttcccctccagctcatctccaggatgcagtgcatttgttctgccctgccccgagtgtcaccccccttcacttttatttcatttccctaaaatcaactctaggttcctcctgcttatagaagcatgggtatgttatcatggatgctaaacttgggttaacaacagctttaggatatatcatgtagcaaattcattcgcaggattgcatgggcacagctgttgtaaatgccaccttcattttaggatgatacggagtatttgaatacacagatcatccatttcaaacctccgcttagggttccctttattatatcttattgcttagtggatataaattagtgtatttttgccactgtggatgaattttcatgggcctgtgtttccaagaagggacaccaccttaggcattatttcatgaaataataataagcactactgttttttgaatacttaccaagtgtcaggtgctgaatgataagtttacaaaatattttctgacttatttttgcctcacatactaatataaggagggggtgatataatcttcatttatagatgaagcactggaagcttgtccacgtttgttctgacttctgcgtttagggtcttttgtctcacgttacaatccacgcccagcccttactgatatttccaggcattcagccatctatttgataattatccttctccatagaagcacagacaggagctgcttcttgactttgctgatggctctttctgtccatggatgtgagcccgagttgtgcctgtggcgtgatgacccacaaatgttggcctaggtcctcatgatgtgcacagggcagcctcccatgctttctagctgtcctgctgtggttttgcttcacttggttacagatgtcaaccagattgactgatgaagaaacatagtgaagatgacatttatgacttgtctgagagatccaggagaaaggtgggtgtttagcagcttactgatgtataaagacaaaattcgaaaaaaacaaaaaacaaaaaaaaacaactattaaaggaccccagtggagaataaccacatgcttaagttattgtgtgatctagatatggggaagtgtggacaaatttgagaaagggaagttgcccaggcagcattttttttttcctaaaatatgccctttgatatgtggctggtgggttcagtggttagtgtacagtgtgtactgtgtttgagtcctatgtagaccaagctgcttttctgtatcaagaccaaacttggacaaactctccatgagtgcacatggtcaggatctgtgttcagcaaaattttgttgtcagtaagactggccattgcctaagtccatttgggctgccataataaaatatctttgaccaggcgatttataaacaacagaagtttattgctcacagttccggaatctggtaggttcaaaatcaagggaccagcagatttgttgtctgatgagggctcattctctgcttcatagatagtgtcttctggctgtgttttcatatggtggaaggagtgaacaagctccctcaggcctcttttacatgggcactaataccattcatgaggtctctgcctttatgacctaatcatcttccaaaagcctgacctcccaaaaccactgcaccaagaattatgtttcaacatatgaatctgatgatgggggtgagcacaaatattcaggccatagcagctatcgtatctcataagattataataccctatttttactgtcccctctcctttaacttccctttgaggtgtttcttcatttggtgtcacaagaaacagatccactcacctattggggaggactcattacaggggattctgaggtcactgtctgaatctgaaatagtagtgttattgttcagtgcacattgaggacaattaaaaagaagcacataagacaaaatagaggggtaaagctggttgtaggagagcttacgtcaccatttacagtttgtgtactgcttattcccttatgattggactagccttgaatatattacttcactcttcttcttatgttctttctcattttgtaacagcaaacataaaccctgagctttatgttagtcattcataccttttatgcatgcattttagattcaaatgcccagccctattttctaagagtagatagacattatttcttccttgatatctaatggatgacagagaattattttttaaaggtagcttctccctttcgtaaacaaatagatttttccatgtcacaattacctgaggaatcagatgggcaagtgtgtataatagaaatgaaactcttttttcctgtctgtgaaattcatgccagtactacactctatacttcatttctgacatcagatatggagtatttttcataccaggtatttcttcagtttcctgcaattaaactcaattctggtgctagctaactggtgacaacatcagatcctgtaggttaagggctccgtctgaaaaggctgcccctatttcagatgccagttccaagtccagtgctgtctgattgactgtctatcagaggtccacataatcttctccccaggtttaataattgttagaatggctcacatcacgcaagaaaagtttacttaccagattactggtttattataaaaggatacaactcaggaacagccagatggaagagatgccaaggcaagatatgagggatgggtgcagagctgtcatgccctctctaggtgcaccatcctcccagcacctctaagtgttcagcaacctggcagctccctgaactccatcctttgggttttatggaggtctcattacataggcatgataggttaaatccctggccattggtgatgggacaggggattgaaagttccaaccctctaatcaaatgtgttcaaatacttgattcccatggcaaccagtctctatccttagagaccttccaaaagttactcattaacataaactcaggtaaggatgaaagggacttattataaacagcaaaagacactcctttcacttttattgtttgtattacttaggaaattctgggcgctttaggggttctctatataatgttttggccaatgagggactccatatatgatagcggtggtcctataagattacaataccctatttttactgtatctttttatttttagatataaaagtactactgttttacaactgcctacaattttcagttgaataacatgctagacatgtttgtagcctacaagcagtaggctacaccatagagcctaggcaagtagtaggctgtaccatctaggtttgtgtaagtacactctatgatgttcacacaaaaacaaaataacctaacaacagatttcttagaacttattccccattgttaagcaatgcatgcctgtatatatttctttgtctctctctctctttttttttctttgtttttttttttttttttaagagatagagtcttgctttgttgttcaggctggtcttgaactcctggcctcaagcaatcttcctgccttggtctcccaaagtggtaggattgtaggtgtaagccactgcactggtctatattcattattataaatcagtattacaataatcaacattgtgggtgttttttcatcatcactttctatgccctcatgtctctggattcatctaggaatccaggtgtaagccaaacagtttgtggcatttatcagtttctcatcaaacaaatgagaacctgttcccatttgaaaaagcagacggaaaagggaaagttttctgggccatgatgaaaagtgttctctttcttcagagaaagccacaagaagagatgttttcactcttctcctgggcattgtcatgtggccacaaggcttggaaccactgcagctattttgttgttatccagaggaagatgaagctcacataaggaaatcacagagaattccagggatccaaaactggagctactaggtagagttcattcccaaagcttgctctacctttgtactttttattctgtcagccaataaagattctcattctttatgctaggttgaattggacattatcttacttttagccaaattcctctcagttaacacagtgcagaagcagacgtagaatgattgtgttcctggtgtttgttttgttttgttttgttttgtttttatgggccagaatctcgctctgtcgtccaggctggagtgcagtggtatgatctcggctcactgaaacctccatctcccaggttcaagtgattctcctgcctcggcctcccaagtagctgggatgacaggcatgcactaccatcccccgctaatttttttgtatttttagtagagacagggtttcaccatgttggccaggctggtctcttgatctcagtctgaagtcctgacctcaggtgatccaccctcctcagtctcccagagtattatgattacaggtgtgagccaccacacccggcctgttcctggtgtttgaatccattctgatcatccagctcagtcacagtggttcagagcgtcacctctgagactgcctgtgatggtacggcattcatacatacatgcctcaggtcatcttcccactgatcaggcaaggcactgtccttcttaggcaatttctactgtccagtgtaaaccaaatataaaattataagtttctcaatcagctgggtggacccctcttcaggtcccagagaacccaaagaaaacttgagaaactattttaggcaatgatgggaaggaggggtcagacatgtttcattatactttcctcctcttggaggttagacacaattgaccaacattaacattaaaagagagaccttaagaatgacaaaagaggctctttgtggcaataagatcccaaattccaacctgacactggtatagcatcacatgacagacagcaggccccgcaggaaatcaaagtattttaccccaaaatatatttctttgacatattttagaaaggccctgcacagctgtctcttatggaagaaatttgcattctgtagagaatctccttcccttactagttttttttccagagagtctggcaccttttaaaggtctaaatagaaatcatctgccatctattgcctctaagggtggccacctatgagattttatctacataataagacccttggtctccacaaccccttatcttaagccagacagtcatttctatcaattccaggtctttagataataacttaactctttcaaccaattgcaaatcttggcaagaaaatctttgactctacctgtgaactgtaagccctcacttcaagttgtcctacctttctggaccaaaccaatgtatacgtcacatgtattgattaacatcgtaagtctctctaaaacatgtaaaaccaagctgtaacccaaccactttgccacatgttcccaggacctcctgaggctatgttacaggtcatcgtcctcatatttgacttggaataaatctcttcaaatattttacagaatttgggttttgtttgtttgtttgtttgtttgtttttttttttttttttttttttttttttttttttttttttttgttaacactagttttggcagctctacttagaaattgtaacctctttccccacccttctccttcttcatctcccatacccagtcctgacttgggccaggagtgagtggctgacttagaggtaatctgggctgagcaatcagattatctgattgtgaatctgatacagaaattatcagtgagcatgttaactggaatgttggatggattgcaagcttggagtggccatttttgtgccatgtgcagagtaaagaaaacttctgggcagaaacaaagtgggacacagtcttggagtccaaagcatcccggaaagccagaccttctgcccttggttcaggtctcacatgaggaatggcccctaccttcctgcccttgagttccaatgtcacttcgttagatagcttgggatggcttctacttcctataaccaaacaaccttgactgacccaaaaaggggtcgtgttcatctcaacttacacatgatgcaatcaaagatgagaaaggttcaccaaagctgatttgtagccagctgggattcagcctagtttttctaactttatcatgtttattttttccatttcacttgctggttaagtgaccaagaaagatcaattcatctactttattcctaaaatattctgtgactgttgcctgtcagatatcagagaaaagagaattactctttagttgcttcgtgacatccttgatggattatgaactgccaccctgaaaattcagtaggaacctgggtaatggtaactgtaggtctgcatacctaagtaataaaatacagagtatcttctttaaattattgaggactctggccttggtagtgttgcaaaaattgtgaattattgtgaaataaatgtctgctgaggtgcacagcagagtgctcttccacaaagttgcccatgtgagaagcaatcccaccgaaaaagagcagatgccccctggaagtgtcgatttgagactcatttgaagacactacttgttttctctgtcatggcattttaatacttatggcctgtctcttctacatgcaaagcttctaaaccttccatcttatctcaattgcagctgctctggagaataactgccctcttttgtggcattcccccttctatcagtcccccaaattaattttagcatatgacacatagcctccaaatttaatgaaaatccactcagccattatctgtgatgtgacagacagactaaaacttaattatattgacatggatttgaggtaatgctatcatattttgctagaaaaggcatctctttatgagtgatgacaattagcagtcagattttggaaacacagccatggagaaatatctgcacagcaaaatatcatccatacctttaggacacccactaagttagggattgaatgccatattcattcactcaggcaatcccacctagactttgggttaatagctttgaagaagtatttcattacatgtcagaacaaggaaagatttctcataatattaagtgttgtccttgtaggaggctatatctagttcttttgatcttcaaagtactatagaagtggtaaataaaatatgtgttagctagtatcactactttgactaagtagatttttacaatcttcctgcaccctcatgcccaaataaaggatactaatagactcactatttgtttttttttttgagatggcatctcactctgtcgcccaggctggaatgcagtggcaccatcttggctcactgcaacctccacctccctggttcaagcaattctcctgcctcagcctcccaaggtacgcaccagcatgcccagctaatttttgtatttttagtagacacagggttttgccatgttggccaggctggtctcaaactcctgacctcaagtgatccacctgccttggcctcccaaactacagggattacaggtctcactatactttaagggaaatattgcatatagaggaagcacaaatgttagaaggtattaatcttcgtagaacctttcccccaccctaacacctctaattctttttggtggcttctaggaaaagtgctttagttaatatttcactaatctttcattatactcttataatcttcctttgggaagggttcttttactcatgacctctcaaaggtaaagcagggatcttgtcattttgaatgctggattgatgctatcaagagtttttcggctgataaagtcttacagaagagattaccacaggcaaagtctcaggcaagagggtgaggaatggatgataggagttgaattggaggatactgctgcagttgagaggagcaggattgagtatgtagatcagaggggaaataaaaggaatgaagaaagacgacacagtactgagaaatattatgaagacaggggaatggttaatataatatttcttctattccaaaagttggcagatttttttttttttggtatgtgctagcttgtaaatatttttagttttgtaggccagtttcagtcacaactatttaactcagccataaagatccataaacaataacaaataaatgggtgtggctgtgtctgataaatatttacttaccaaagaaaggtgattgctgatttggcctgcaggctatctaatcacttgtttataaaatttgcactacattcgttgatatatggtatgcctgatgccaaacccaattcttatgtttattaaaatttagaatgaactagtattctgaagattagtaactccctttttaagctttgtgatttttttcatatttgtccattgttactttaataatattttaaatgttcaaatatgcatatatgaaagtaagtttgtttagtacatagagttaagcttaacacacttcttccccataaaagagggatttccataattaactctaggaaccataaaccctgaaaacaacactgcaattctgtgtgaatggagagcctgacactgtactaaacactctaggagatttttccaagtattcgggctgtttctgctcttgaaggaactatcaatcactgcaaacactaataacagtagatgccagtcaaggccaagtgtggggctgcctggctggtgagtggcacagatactgactgaggaagttgtgggaagcaggagagaacaagtggctgctggctcctttgtgtcagttgggagagtcctttggttgcaggaaacagagactcacacaggttaattcagggagtgaaagtttattagaagaagattgggatcactcccatttgcctgagcctcatgaaaacccagaggagccctgcccccaccttaggggagaattacagacacagtccagtgaagaatcaagtacctggtgttagtctcttgatcaccccacttaccttagggtcgcaccataaatgcacatcagtggcttcctgtgtttctactgcttctctgattttttcaaaatttttattttaagttcaggggtacgtgaggtttgttacataagtaaacttgtgtcatgggggtttgttatacagattatttcatcacccaggtatgaagcccagtactcaatagttattttgtctgctgctctcccttttcccaccctccaccctccagtagaccccaatgtctgttgtttccttctttgtgttcatgagttcttatcatttagctcccacttataagtgagaacatgcagtatttggttttctgttcctgcattagtttgctagggataatggcctccagctctatccatgttctctcaaaagacatgatcttgttcttttttatggctgtgtagtattccatggtttatatgtaccacattttctttatctggtctgtcactgatgggcatataggttgattccatgtctgtgctattgtgaatagtacttcactgaacatttgtgtgcaagtgtctttatggtagagtgatttgtattcctctgagtatatacccattaatgggattgctcgttcggatgatggcaatcccactttctgtatcttgcactgaagttctcaagagagttgacgttattggtcaaatcagtgcagtgcagtgagggagatgggtggtctcttccaaagagtcatactgttacttagccttttttccatcttgtgccttctcattacttagtgccttgtagtcctccctatcctgcttgcaaatgaagactcaggcagcagtctgtcacaagggatactgggaaatgtaatctactagtgtgtgcaggaggaaaggaaaatggattcagtgaacaactagtcagtctaaaaatacagtaaagtaggcctatagattattgtctgtttgcacaagtgaacttgaacttgcttttatttatctgtcaaggagccttatgtctgtgaaatcactaggataagtgaaatagttttcctgggctcattcccaaaaaggaaaacattgtggctaatcagacacagagaatccacaatggtggtaggcttctcctcactattaaatgtgagatggcaccaatttataggctccatggactttttcactacaaaagagaaggaagctttttcaaacctctgttttaagagggaaagcaaagagaaggaagctttttcaaacctctgttttaagagagaaagcagtaacatattgaaagaaatgcacagttttcatttgtgtcatctcaacagctggtactaccctgaaatttcaaggatcccttcccattgtcagtccatgtaacctcatccttagatcagaaaacacagccacaaagacatgagttcagaataagtgtcttacaagtcatacaagagaaggaatattctatatgattgagtcaagcatatggagacactggtcccagccctgctaatatccaatgtggttaccttggatatgttactaaatgtctgcatttttgctaaaaaattgaataatgtgtttgttcaaaatacatacagtacccaaattacaatggttcaatgcatgatattttgactttaggatgggtttatcagggtattaaatgtattttcaatgtagaatattttcaacttacgatgggtgtattaggatgtgtctcattgtaagttgaggagcatctatacataggtgtaaggaaacctaaagactgactgttgtgttttctcagtggtggttcttggcaatagtagtaggagaggtactcttgttccttttttgttaccattgttaactccaaaatgtgccaggccttcacagtggaaggggctagtgagactggatgccagaggaagcacctgtggaacagacacctgcatagccctaccctgggcaacaagactttaaatacctcctccaactacaaggttctaaggatctgcattgatgtttcataggcatgagttcttaaaattctgtcctgaatatgaaactcaggattgggaaatgaagcaagaaaatgaaaggatttgctttatgaagactctatatcctgggcaaagtggtggtgggttgagttggtcttcaacctgcccttcattgaagggctgcctggaccctctcctaaggtgctcattctggatacccagttggtgacaactcttcttggtccagcaccttctctaagttgacacttctttttcttgctccccctagccactcccctgacgtgtctcttaaagctacatttaggtatctgtgccgtccaaggacaagctttaaggaatgagcatacctcatctagaggaaggaactggtaagactccctcccctggctccagcactgttctggactgtaatagtgcattctcacaaggagaatccagaaataaaagtccatttatgactctgtgacctcaaggaatgactttactcaagatcatttgaggctccagggcaaggggaatggcggcatggcaggcaaggaggggctgacagcacgttgtgcagtcgagttcatgtagccacttcctgcacagaaagacttccactctgcagttgtaaagagctggccttgacagggagttgctggttccccaggagttaattgatataagaaataacattacaaggaattaattagaagcccttgagtcttgacaagagtttgttacaggctgatgtgcctttttattatgaagctgggaaagggaatgaggaggagaagtacggaggatgttaaccatgcagatgtgaaagagattttgtagacagcctgcagagaggcccctgcataatgatagctcactcagagaaaataagaacatgaaacagttcctgacaagtcccatagcttaactggaagaaagtgaacctctttgcttatgaaacatcctgaagctagcgtaaaagttaaagagcactttgctctgaaagagaaatagagggatggaatgggggaagggacatagtcattagggtaagtaaagtaaaactggcttccccacaggacatcaacacggtagaaacatccggaattgtctctaagtctcactcctgggaattcacgccacagggataaatcagatcaattactaccggccacctagtggcagaatggggaacaacatgctgatctgtcggctgggaggcttaatatagtccgtattcacaatagaagctaattgttataaaaatgttaagagggggcgtaaaatatttcagagcaggggaagatttttagcctgaagacaacataatttttcacttaaacaattcatccagctcaggattagatgaagttgagtatgaggataattgaatatagtaaccaattctacgtcttccatccatgtgtgtatttaaagattacaattattatgctatttttaagacgtctgttctagataaagttcttccatgagatactacttttgatgtactctgaagagtgctctcatgctgggagaatttcagtgctgaaaatagcttttggcctagagttgagacctgggtaaccacccccagcttagctatgcgaaacttgggtgattgtcagaaagtcatttacgtatcatgtggggatgtttgtgtatgtgtgtggggagtgtgtttgtgattgtatgtagtgtgtgggcatatgtataaatatatttgttaagttgaagcaaatacaatagcccccctcttatccacggggaatacgttccaagccccgcagtggaggtctaatagtacactgttttttttctatacactatttttttctatacatacctatgacaaagtttaatttataaatcgggtacagtaaaagatgaacaacaataactaataataaaatagaatagttatggcctggcgtggtggctcacatctgtaatcccagcactttgggaggctgaggtgggtggatcacctgaggtcaggagttcgagaccagcctggccaacatggtgaaaccccgtctttactaaaaatacaaaaattagccaggcgtgatggcatgtgcctgtaattccagctactcgggaggctgaggcaggagaatcgtttgaacctgggaggcagaagttgcagtgagccgagatcgctccattgcactccagcctgggcaacaagagcaagactccatctcaaaaaaaaaaacaaaaaacaaaacaaaacaaaacaaagtcataacaatatactgtaataaaagctgtgtgaatgtttatttctgaaattttccatttcatgtcattgaaccatggttgcccacagttagctgaaactctggaaagtgaaagcgtgcataagtggggactaccatatgggcatcctacatacctcttaggtggtactcagagaacccagcaatgagtattgaacaccctcagtgagctgagttctggttcatcccaatggaaggtattagagaaggatgaacaaagtccctgtccaatctaagtggtgactctaagacacacatgaaataatgatcaacaacataagtcatcacttggccttggctttaggatatcttagagaatacacaaaataacttgaactcaacccagatttgagaacttctatggtgttaatgctagtaccctgtgtttcccctgcaacactcaatctttaatgtttccacggaaattgcttgctattcctgcctccagccatctccacagatatgtgcaccgtagtcccactccttctcaccagattacttgctcaaattatctctcgagtatagccctgtgaaacccacccaatctctttggctcccatggtacattaacatatattcgtactcattttgtgtccaaatctttgtttctctttccttcccacacagcattaataaccccgggaaaaaaattctctctgttacatgattctgttttttttgctccttcatcattaataccatagtgtaatttataggtatagaggcaagaagatctcatatgggaatgtaagatcattaaaatcttcactgtggagccaaggttcaacctgggtttttaggaagagacaggatttaactgtttgagggagttaacatataatgtaaaacatggatgtgttgggtacattttctgaagtagcatcagggtatgtatattcaggaatttgccctttactttacatgtgaatatagttagaactctgaggctgggtggcattttaggagccagacaggtccatgaatgcccttcccactgccctaaattccctgagttcaattgacaaggttggaaaaatggggaagttagcatggaagtcggctgccaattcaggcaggtgaaggagttctaattcggtcaggacacccactttgtcctattcaatctgccttcacatttaaagggccagttgtaaaagtatcccatcttcacaaattcatatctaaccaactggaaattattttcactgcaaatgtgattgattttatggagtccttttttttttaatcaggagtacttctaatgcactgcagtatttgtttactcagtgaccaggaaaattgagacatataggttaaacaaaaacttcatcaaacaattttggaagtttctttgtaaatggtaagtagagtcagttgagggaggaaggaggaggagctactagatggcacagtgattctattactttaaagcattttaggaacatttctgttttataaattaagattcatctggggcctagatatatatattcattatgagctatacaggtccatgaacacccttcttacattcctgtatataaaatgccatatatatctatacatctgtatctccatctatctatcaatgcatctattatatctatctatctatctatctatctatctatctatctatcatctttgttatatttaggcctatacataatttctattttataagataaattcatctgtatagggcatttaactaactctaggttaatgatattctgagattatctgattatatggcagttggatctagaagtcagtcccaagcactgagcctaaggataaggttaactttgctgtagattaatgccagatattcttcaagaatcaaaactactttagtataatctattgatgatagttaaatattttgctattcaagtcctattagttaccgactcaagactcctttttttccaagagaggttgttgatttaataactgtcagccaaagaagttcatcagcagctgaaatccacagcaagttaactcataatgaatcttaaattttagaaagaatgttttagcaatattgagtgacaaaagaaaaacagttgaaaacaaaatcaccgtgaaacttccgtcagctcattagattctctgaattccataaaagagagaaataataccaagtacaactgagactggagaagattttatggtggaaatctctcagattcctttattccaggaaaataattctgaacttgagaattgagtgttttctctcatggacattggattgaaaggctattgtatccaaggatgttcactgtggcataactcttgctgtttgcacaacctgaaaatgatccaaagctcagagttataattaaggaccttgttacaccataaaagattttcaaattttaatctatgacaacccacacagcactcagggcttaaatactttattgaccaggctggcaggctgactcctctgttggagctgggagagtcctgcttcaatttatctctcccacactacatatttgtagtcataaatcttttgctaggctctttgagcattaaaaatagcctggcattgctggctttccttgtggtactgtaagagccaaatcaaaggtgccagcctcctgtgatctttccattttgcgctgcagcaggaaacgtttacatctgtcccagccctcactgtctaagtgtcaactcaaacaatggcatttcccactcagagtttggctccatctccccagatgcctcccttatccagatagggcagctgaacagcagtctggcccgagctgttcctctgccagcctgggtctgttctctcttcttgatggtaactctgggtggtgtgttttcttcattctgcagggatcctgctagatggagcagaatagctatgctgccaccagggtccaggctatgggttttcactaggaccactggaggagagaggcggagggagcagcaaagggccagaaacagtttctggaggtgcaaaacagaagtcatttgaacacaggcccaaatgcagatcagaactaggtcaagagctagagggtgactccacaagtatcggtcaggttgtttagagaagagaccaacatgttcagatagaatgctattttatgaatttccttcttcagacatgagcatgttatttggtttaaatttttatttcagtagtgagtagtaagaaacattatgggggtcatcccacagacactaagggggaattcctgtgtcttcctttttcttctaagctgtttttcacatcttttgtaaaatcagctttattgggatataattgttatctaataaactgcacatatttaaaataaacaatttgataagctttttatttgatggtttccacgagataatcatttccatcaagatgatgaaaagatccatgacgccctaatatttccttgggctatttgcacccccttcacatcccactctcatctccaggcaacgactgatctgttttctgttagtatatattagtttgtattttctagacttttatataaatggcatcaaacaatatgcactctttttgttttagcttctttctgtcaacaggattattttgggatttatctacattgcatcgtgtatcgatggtgatggatgctgagcagcattccattgtgtggatatactacagtttgtttatccattcacctggataatggacatttgagttgtttccagcttggaactataacaaataaagttgctaggggcatttgtgtacaagtttttgcatgccttcatttcccttggttaaatatgtaggagtagaatagctactcttgggtaggtacctagaataggtttatatgaaagagtatgtttgactttttaaggaacaaccaaacccttttccaaagaggctgtaccattttatattcccactgactgagagtcccaattcctccacatcctggctggcttttgctgcagtttctactaggggacatcaatgcagcagcctgcagggccatctgcatcaaacgtggcctcatctctggccacacatcaaagagtcaaggttttggctggacgaagaagaaaaacacagaccaagggatattaatgacctaacatgaagagaaactatctattttgtgagcttacaaataactaaagaagaacttttgcagtatagtgtttgtcagaaccgtggtgtaataaattaatgtggatcaaaatttctggccattattataaaggaagaaaggaaagtacatatgctttgtctttctttttacagaatccagtacatgttatttgtagattgactaacatgtgatgttcagagatagaaaaatctaccttagacgattcttaacaaagagaaaagtggttctgaccatagtcatttagcccaaatgcctagagcagaattcccttctaccttttctcagaacacaagtgcccataggctcactacctcctggggaagcctggttctagtcaagcgttttgttcatggagcagatttttatttaaggaattcataactactggcctgggcacgtgaagtaacttagactcagatggtccacataacactgctcaaacagaacaagtccacagtataaggaagctaagtcaggcttcagacaatagcacctcttttgttaggttagtgcaaaagtaattgtgggttttgccattaaaagtaacgtcaagaaaccacaattatttttgcatcaaccgaatacttctctcatttcgtacatcttaaaatcatataaccaggcagtatcttagggtcattgggatctcggctctggggcttacttatcccagatctaaccatcctcagcatggtgctcagagagaaatattgtgagtttctgtagtcatttccatatcacacatctcaacagagaaatacgaaaatccacatggaaaatctagcagacctacaagcgagagccaggtgggagactcttcacctgccccaaaaactagtttatgtgcatgtgacaaagcgggcgtttttattgttcagacactaaaacaaacagaaaattatgaagtgcacaaaaggattttccacgctgctgaaccttgcaaagtgttcacagtcgagttcccctttttgaattcattatctcaaggcagcatttggtttggaaagccggggcagctgagctgaaaatgtgtattgttattacttgaagtttctgagaataacctgcacaggctgcagtgttcagaaccagctttgttctttgcaaattctttgtcagtgaactctctcttattcgagtcattggcaaacatgagagcctatgtaaaatattgatttagggcatattcctaatcatttgttttactagcatgtattttggaaagctacctgtagctgaagtggttattagtactttccctaaaattgtatcactttcattttcacattctttgctttgaaatattttaaccagggggtgaatatttagatcacattcacaacgagtctttatataaccagtcttctattaggttattttccttatagtcccacagatacatcaatttcacttctgccttctatgcctttcctcacatatttttcttgctttttcccatcccattcctgcttgtcattcagtgtgtacattcctgccccttctctaagactcatgaaaccatcaaagcctatagggacctctctttcccctgactccctatgacaactgttttctgtcctattaatctgacagctaatgaggtggtacttcatgacatctcttttatttttaattttgaacaaccatttaaaactgtgattatgatttaactttttttttttttttttttttttttttttgcactctgtagcccaggctggagtgcagtggctcaatctcggctcactgcaagctctgccttccggattcacgccattctcctgcctcagccttccgagtagctgggactacaggtgcccaccaccacacccggctaattttttgtatttttagtagagacggggtgtcaccgtgttagccaggacggtctcgatctcctgacctcgtgatccgcccgcctgggcctcctgaagtgctgggattataggcgagatccaccatgcttggcctatgatttaactttttacctgtttatatcttgcctctctaagtagattgggcactccttcagatagagggctacctgtttcccacatttagtgcccatcccagcatcaaatgcttgctgatttcaagacccagtttgtgaatggtctcacaagaatttatttaatggggctgggaagtgagggagttattgaaagcagaaataaattgctgttaattgctactgtttgcaatttgctattggaagtagcaaggtaaatgttagtgcacatacaattgtattgattggattgtctttttcaaggttattgttgcaattaaattgaccttttgctggtacagaaataacttgtttaatgaaaactgaacaaatgaattgggcataacttgaatatagaaaataatcagagcattggatgtaggtctttgtcaaatcactacaaaggccaagtatggacctgttcagtagttgcgctcaaatgaataaatagctcttaggaagccaaaaccaaaaactagatggtggtgatgatgtcataataccacaaacaggacatgtcataaatttgatgttgctctctacagctcactgagcattgaaggatcctcttgggtgcattaggcatgatgctagatctagaatcactttgcaagaagtaagcactgtgcaaaggaaaggattactcaggcaccacttctggcatctgcacatattccctagccttagctccaggccacttacattaactggttaattgcagaacctctgagaccctgagacactagattgtctaagataagaatcaaggcctatggtaccttagtatgtccttggaaatacaattccacttatctctgcccaggatcttacattccaaatgggaaatatttcactgaatacttcggatctttggtgaccatctcctccttgatagaatgtcgtttagtgagttttatactgtgcccagcaccataaggcaatgaagaagtagtaaaaatgagaaagaaccaatataaaggggcacattgcaagggaaggatggagaaagctttaagatcttgatgacattcgaaagctcttctaaagctgcagacagttcaaataatgaagatgagaatgaggtgcataagctgatccctgctgatgtccaataggcacaagaacattaaattgggaagctttggactccctgttgccaatagcactcataataactgtgtttgctgtaccgctttgaccagtacttttaaacctctctttcctggcctatgaaaggagaagattggagcaattaacctctcagacatcttaaagccttaccattctctgtaatcaattattccagacctcctgtgtgaacctccccaacctgactaacttggaactgactgctgaccaccacttacagaccttaaaggatgtcagtgagccagaccggtagcttatctccaacaagtctatccttttggatggaggagatagtgccacgtcttctgcttttctctctctctcttttgtttacttttcctaatcagaatcttctacctcctcaaaccttgtttttccattcttcctttttagaattctctgtgctatctttcttgggttgtttacgtccaactttcagatcccttctgaatgaatttttttttggcacgtacaaaacactcacccataagcatctgtaacttagattatgtaggtggatatccaggatttaataaggcctgaagtctgaaggaaaatgaaattagaggaactaaatagattcttatattggttggataccagaaacccagaataaatatcccaagtggccttagtctgcaggttattgaaatctagaatttcttactgaagcaatctgcatgttagaattctaaaagcctttaaaattggtacctctatcatttgtcttttctttatttttttttttttgtgggggcaggggactcatttttctggactttgaactacataatcgaaactgtggctatgcttgtgccctatctctttgaggtttggactaactaatgggtgtccctgtctgcctttattatttaagaaactctctcaccattcctgtcatagcctcttttatgcctggcctactgagcagaggttcatccttcagtcggttagcaagcttttgtcaagatagatggaattttagacttagtctgaagtgcggtccctctccatctgctttggaaacagctcacaaattcttcttgttgtttcagatgtgatcatcaatctcctgccagaggaaattaagaactgttatttgtctgttgggcaggagagattccagagttttgacccctaattcattccctactctttgtgctttggctgtaacatctaactaagggtttgcagggtcttcttttatttctccagattcgttgcattaaaaattgttttatcccattagtgtgtcatttcatcatagttattaaaaacaaactcagccactttgtagcccagttttgtctgccgtcttccaaccactgtgctgcttccccggagagtctgtctctcagcagctgctggttggatcattgaggccttaacccaggagaggtgccatctctctcagaggtgctggctgtaattggctggtccctttgccactgtgggtggtagcaaatatgtctctaggacataaaatattggtcctcagaatgtagagagagaaatggctaaaggcccagtttagtagtgaagcaatgaactttaattattttttaattattcagtaagttaagaaaatgtttgaactttggatcttactaccattgctactgatgaggaataagggaggtgaaggaatattgtttgataaaagtggaaatccatatcatttacatgctgaacatggtgattgcacggtcaggtggcagagcctgatttacttttctaatcagggttttagtagaaagagcctgcagtgcccttctctcctccatcatcagcaggctcttccagaagaaaaggtgatgatgtggtttcatttccacagcatgcttttatttctacagagagtaacctggaaggcaaggcaaaccaaaacacaaagaaagggccagagtccatgtttgacactgtttttctccttttatttatccttcctctgaccattatgatagagttctaaagaacctgcaggagcattgagaccagctcctcgtcgcatagggcattcaggtggattactcaacatcactgagctttttattgatagttggagagccaggattcaggcctccttacttcccttccaagctttgtccccaatattgctttgcgaagggagctcttagggaatgaatcaaagacactggcatactgtttaccaagctgttaatagtgtaatcattgtaaccacttattgagcatgtactttgtgcctggaactttcctaaagctggaagatagttttaacttaatcttcaccaacaaactactattattatattaattaaaaaagaagaagacattgaggcacagtgggtttgataggtggctcacggtcacacagttggtgcttcgtggattaggaactcaagtcctgttctgcgggattctaagatacatatttaaaactattacattcagctgcctgtcaacatcctggcatgttacacattgttgtgatccatatgcgtgcaatttcatagcctgctttatttcactaagcatcccatgttatgaaaaaccatagcatacctgttattaaaaattcttcatcattattatgtttatagcttaataatgttacttctgatatcttgcttcatgttatttgttttttatattttcttaatgttttctttctgttctttttctattattttctgaagcaatttgcaacttacatttaactgattatgagtcgaaagaattgaaccatgttccagcccctcctcccatatatacaagatggaatcatttgcttcttgtttctttgcctcgccccctttcttaggccctgtgtctttaacttgaagctcaaagcactttttacaactatattatttctgacacgatacacacacacatttgtagatagatacatggatggggggagagagagagagagagagagagtgtgtgtgtgtgtgtgtgtgtgtgtgtgtcttgaaataagttggtgacatgttaatttgaatgactatagggaatccacatggagatgcccaggagatcagcagctcaggggtcaagtctggctcacagatattcctttaggagttattagcatataaccaggaattattagcatatgatccatataagtctgcagagatgtttcagggagtaaacgcaaagatagaagagaagcaggctgaggatgggagtccagtgaagaccaacattttagagacctgtgatagtgaatgagaaaaaggagtcagagaagtcagaagaaaattaagagaaaggggctccattcaatggagcagagggttccaggaaggtggaatgttttagagaacacacttggagactgccctctggatctgatgctatgggccagtggagaggttagtaagtgtcattccattgggataatgagcatgcaggacacagggctgtggctgaggagaaaataaaaggttcagaggcagcctgcttcctctgtctatgctgaacttctagttctggctctagcactaacatttagtgactttgggcaatactttatcttctgaacctaagtttcctaagctatacaatttagggaaatggattacagttgtctaaatacactccaattctagtgctatgcatactatgatattggtaggtattaaactctccccagacacccaatacaaatacttcaaggggaaaaattaactctagagtagtcatcaacttatgggctaaatgagtcttaagggagtcttaagggaggtctgaccttctgaatattgctgttgttatctgtaccatttttatactttaattttagtcatgagtgattagtgtacccttttaatatctcctcaatggtgtttcttcccacacgtttatggacaattttaagtaagtccttagtagcactgatgcagggcttattagaacccacatcttggtgtccatctagtccatgtgccaactacgtccggcacccggcatgttccttaaactttacatattgttttctccttctttgagatgccatttgttaaataatgatattgaaagcaataatcaaattggtaccatatagtgagtttgctcaaataatcagtcttgacattcattcttggtttggtgttctaccactgcaatcactggcctctgttcagaggcccccaccaacttcccagtttgaaaaatggaaatccatacgaagagggggacctgaatgaaaccctcttaaactgtgtaatgaaaaagaaggctctagcaggctcccatggaaccagtaagggtgatgactcccattacattataaagaaagccaaccaaaccaaagatcctaactttctacaggtgatataacttctcctaagtctagccacgatctgatccatttggctctggctctctttgttattggatgattgctcatttctgaattgttggaaggctagaaacaaaaataggaaaaagaaaatggcagacagcaaaacctgctttgggccccatattaatccagttacctgagaagtactacctacaaatacttaattaagagtcattggagctaacgccttttcctctttctggtggagtctagccaacttttaccagaaaattgccttcacattttgaaatccctgttctagtaataaacttgtagacaaaatgtcagcgttttaaatggctgcagttttagttattttaattaattttcagtcaaaagaagttgatttaatccacattattgcttgcaaattgttaaattttgtttgtataataaacttttaaaactttctagagtcaattcctctgggcaagcttcagcatgttgcttagacctctattataatacttaaaacatcctattagatattacggtaagttatttacatctctctgtgcctcactattttgggagctcttgaaggaaaaggatgaagtcttatttatttatttactgaccctcttaatatctggaacagaaccttgcacatagttactgctcaataaatattttctggattactaaactctgaggagggcttagaattaagaagataatttaaatacttacccgtttggttatatgcctaattctttatgcctttacttttctgtttagtggcaccatttattccttgctttgtgaggtgttagctagaatctttgctgtgtaatgcttagttctttagaaattcaaagttcttggctcagcctcttgggttgtcctgccttttatagatgcagtaaatttgatcaccatcaagggctgttaaacaacatgcagtgataaaaatagttccctttgctgacattaggtgttttctaaaacagctcgataaattctggtcaacagaaactctttgtgatttcaaaagtcagaaagtgaactgttgacatggatctgggcagatggaaaataaattgccctgtagttgctcagaaatatgtcctaggtgctttttaccatgactagtggttgactgtgccttcactcgatgatgttataatagaagttatgcaagctcacgaggttacaagaggacttgtaggcggcgacttgtttgcaaggtgatgtatctgcaggaggcgtaatgggtagggtgagtgggagtggtaagttggtgagttttgcaaagagcattgattttaaatttcatttatcaggttcttgggaagggggatggtgatattggtaactgcaacaaagaaaccctggctctaaagtaaggccaggaagcagtagtagcagatgtagatctgttttcccccttactttctactccagtccttcctgcatttagcaaacttcactcctcaaactatactttcacatcaccattatctttattgcctattatattaaccctaacccaaaacaagtggaaaagtacaccaaactggaagtacagaggccaggtacctggttcctttctgtgtctacccagccaggtaaagttgagcaagtttcataacctttctggagccattgtctcttcttgagaagaatcagtttgcactatatgatatctaagtacattttactaagacatctcaattaattttcaagcccttctatttctcatgaccaccctgactttttagacttgtttcctattagttctaaaacagggtatgtccagatacacaactttgtacctgcataatagttcttaaaataacttttgaacctttgtggtggagcctcgactctctagttctatgctctctcatcttgcctgtcctcatcttccttaccttgcaggccctaggaaggattgagctgcattccaatctacctgctgttcttttgcactggcttggttttaatgtgtatctccttcacctctcatgctccccaatctgctctcttcaacctttctttttttgcaaacttcctcaatcaaaatctcttctttcaagatttgattcattatcatctctttgaggacacagtataagagtgatagattctggaagcatcattgtagattgaatttactaaagcactttaatgataatcaagaattataggattctagtcccagatctgccacaaacaacaaggccattagccactttgggcctctttctcctacttttgaataatggcatggagatagggttgggggttgaagtttatcagagaatgtatattctcaaacattttcatgggaaggtagagcatataaataagtaagataggtctggggtaagatcatagagagtgctgaagaaaagaggcattccattatttttttaagtaatttgcatgccaagccaaacatgcttgccagttgaattcaaatcctaggcctctggtatacaggttatgaatttaggggccattgtagtgccttttcaatccaatatgcatatttgttcttcaactctatctatatctctattagattacattacaatattgtatgttaacagcaattctttataagtttttttcttaacctgtttcatctgttttgactcttgactcatatattatgtgcattctttattcattttataagcccctataacacctaccacatgcttctgcccacattgattctcagaaaaagcttgctgaaatttgcattgaagagggctagaaactaaaagttgggaagactgtagaaaaaataagaaagaaaggatggaggaaaagtatttgaaacagaataagaaaccactgtaaaagtgtagccaaggtatggggggagctggttcaggaactctgcacaggtctggccctttgaaccacatcagaacacaggtttccagagctaagctgagctaagggtcgactgacctagtgtttcccaaattgtgcagcctaggaagaagacagatgagcacctttatattatcatagctggtcgttttgatatacattggaaaagttgctttgtattttaattactgttagcaaaatactgatttcctatttacagaaacaatgggtttttcttactaaatttagaaaagcattaaataataggtagtgtatatatttaataaagtcatgaaaattgtatttaaattactaagtttgaggaaattcctttgtttttcaaaagaagaaattgatctggccaagatcacacagtgagtaactggtagagttgggctacatctcaaatggaagagacagaacctgggtactgggtgctctcactctccctatgagttggatgggtttcatattcctcctcttactctgctattcatgcagaaattgaacataatgagctcaagcttctagggttatcctgagcaggtctagggggatgaatgggtcctgacatggcaggagtcccagaaatgcatgtctcttccacatgttacccaccagccttcctgtgtcgatagatgttcgtctttccactgatctgtgtttgagcaaattgatttcctaatcctttcatggttagcagaaattttagatacatcttacatctgtgttattctttcaaaataatttcacccacagtatctgtttgaatcctcatatgaacccagggggttaagaacagaacgtgtgattatccccattttccacatgaagaaagccagtgccccatggtaatacagtgattccatacgggctctggtgcctttctcacagctcactgctgtttcctctttttcctttcagaaagaatgaaagaaaaaaaaaatgcacagtgatctaaatgagctgtaattgctgggcttcagtcccatatttatattttataatgctgatttctttcaaatagatttgtgagccttgtctgtaatgaattctcccaggagataaatgactaacttgtttcaaagagaaaatttgtccatcaaactcgcgggccttgtcttgagattcagtacttctctcctaccgcaactttgtttatgccatgtctgaataaaagatcccacatttccctgagataaaaataagttgaaagaaagctatattggtgacctaagagtttcctattgttccaggaaaggatgaaaggacagatttgtttagctgaaatgtgtgtgtgtatccttaccccaaagtggtattttacatttatgaactctgttggcttcacaggaatcacgtgctgttgccattgtcttttagtatccgggaaaataaatacaggcctatttaggactgcaccttcctgccacccttccctctggcaggtggaatattcccaagagctttagactactgcttatgcgaactttttaatgcatttgtgtcagcagtaatactgctttattaaatgaagctttttcattgtggataggggatgtattaaatgcagcaagccttctaatcacagacagccagcacagccccactctcagtagcaggttaccagccactctccctttattaatgggcttcctttgtcaaaggagggaatgcagcatcttcagaaacccgttaaaaggcacagccttttgttgctgccctcagccataccatgtgaattcagttttcccctgtgtcaggggaaattcatcacaaaaatatatacacgggctctatctagccagcaacactccctcataggctctgtattttcagtctcacactgaagtccactcactgatgggtgtgttagtagctcctctgtgctgctttcatctccctggatgttgagacagctgcggcacatctgaatacaaaatcagtagaaactgtgacaacatggcaagaaaataacctctcttttccagaaacatccaggatccttctagaaatcctttggaactttgttgctaactcatttgttgcaccatctagggaaaaaaaatccctacttctggataaaaatatgtcatcaattcaagtttcctccacttgggggagtgactcacaccagccctagaaagcggtcatccagccttccacttgaacaacttcagtaaagcagaatcccacagatcttgaggaacaccagttcatcattgcggcgatctggaatgtttcatacatgcttttttatgaagcagaaacttcaaaatttcgctgaagccagacgtaggacagattctagcaaagttgtaggtgaatgagaatttcacagcttgaacaacaagaactattaatacatgaagcagcaactgaatgaataacaccattggttcatctcttctgggcacttagtagaagctgctgtgtctagaacactcacttgattcaagaggagttcagttccccattttactggggcttcattttgtaggaaggatgacctcactttaaccgtatctgtgaatatgacccagtgtttcctctttagttaaaatcgacgtatcatgtttaaagactgtcttttcactctggaaagttctgaggatccagatgcaccattacaagggcattttatagtcttcagtgcagcactatcttgcctctttttgcttctaattcttcttacctaccatttctccttcttattaattttgagctacgtggttataattttaaaatatgtaaaatatatgtatataaatacatacatataaatatatagtatataatcatttagagtcatgtatcttaattgttagacccaaagtcactctatattggctgtgttgcactcagcaaatcattttgctggtttttaaagtgagaataataatgagaccaaccctagagcattaccacagggaacaaattttcagatgacacatgtagtaaaaggacttttgaaaatataaagaaccctgtgaatgttaatgattgtctctgctgtgagaaagggcagacagaataaaggacttttcatcatattctgtggcctgggtgtagccaccctgatgaatgcagtgctggagagaggctggaaggtagatctccaaggagagttccaatgaatgtgggattcatcaatccatggatggtgtgttagtgtgcacagtgcagctcagtcctaaaccattcatgtggatgtgattattttctcctcaagcactcgcgctctggtatatattgcaactctgccttcggcattctgtcaggaataagcaataattgaacaaggaggccagatattagtgtccatgaatacagagatgctcatagggaagtctacacccgggcaatcatcagtgcagtcgattatactgccacttgctttctgaattttatttgtattcaaaaggcaagacaagcatcccaagagtgaggaatcctatctgtggtcaaatttaaaattgtcacatacagttgtgaaggttgcacactgcgcaaagtaagggtgcatcacacacaccctggacgttagagagttgtatatttattatgacaaattcctgaagtgtgtggttttaacaatctaacatttcacaatatgtttctaacagatggatgtaaagtaaggtactgtatgggctagctaaaaggataaatttttcttgctttgaagcattttattgttctttatgtcagctctatgtgtgagcttttcctatcttgggcagaatgacagtcaattcttctcagactgaagtgagcaaaacttccttttaaaaatcttccaatcttaagaatctcaggttatttttttgcacttaggaagcttgcagctgttcctaaatcaaagtaaatttgttatctgaaaagtcaacttaatttgtgcaacactttttctgcggatccttgtcctaagggaagtagaagacagcgtcctggaacacacaacagtgcaaagtagaagctttatttatgtcgcacactgtgaggggcatggcaaagtgtggagatgggagtgagattatggtattgcactggagtcgagacatatagtcaagctagggaatgttccactgagccattgatgataaacagaccatctccctgtttccagaggcaacagggaaattgaatatttttcacatgcaattctgcatgtttgagaactgcttcagtggaagtatctttagggagcatttcacaggcatcaaaaccataaccggcagggaaggcagaaggaactcacatgttagacacaaccctggtcggaaggcagttgctgattgaacctggattcctctactggacaaagggacacatattgagtttggcaggactaccaggattggcaggacctttggtggaaaggactctgctcttaccgcctcacttcccagagacatggtacctctcctaaacgttactgacattatgattaagtctacttctacagagaaggaggcccccatttaaaaaggagaagtgctttggataatgtcgagttagtagaattatcagtgtcaaggtcagaactggatagaattcagggtttctgaaaccctgtcccagcctttatgttgttcgttccaggagtgattgactcatggccctaattagatcctctctatttgggcaagaacactgactcttgattttgcggttcaacagtgtctagatactgggtagctgctatgagtagcattatgtaattagacagcccatttggggacatttcccaactcagacatgatccctaacattgaccccatttattccactgttcactgaatgtcagggttttgagaggatgcaagcagagcaccaaggtgaggagacggaactgcacagaataactggggtttttgacatctgcaaggccaaacctcctgcagggccttcaattccacctggttgcttgtccagcccctgatgatgtacagtactgagggaggtcacaggagcccctgagctgcctccagtagtgagctgtcatatatccctcttcacaatgaccttccttcctggcactgcgcctctcccgcagtcctaagtggcctgttctgaagtgtgtggttttaacccttttccagaagtctcagttcactcaccagagtctctgtggatctcacaaggtgttcctgggacataaagcaactcaagaattttctttactacaatgttgtctcaatcaagacatctaatctgttattttcagcctttgtgtggcagaaagattaattaagctatgatgtagaagatataggtttcagcctttgttttctcattcttcaactaagttactaagtaataatggacaaaggatttacttctttccctttacgaatacttcccctgtctaagttacaaagctgatgggagcattaaatgagattgtggctgcgcaaagggtttgaaaattaaaaggtgtgttttataatcttggaccacaatgtggccaataagaataagaataactgccacctcgtgagcccttaactatgttccaggtactgtgttgattagttttcacactttatctcttttaatcgtcacagtaatccaatgagcttggtaccattattactccattattttccgacattattgtgaagacttccaaaagttaaaaattttcctagtatctcaattatgtggcaaatccagtattgaaatcttgactcagccctgagcctgcactctcaaccatcattgctacatcctcagtaatgtagcaattagtaataacaataataagcaacgacctggaagattgatgttcttccattaatctgacagtgaagaaagatggcagagggtcagctaaagtgtatattttgtagaagttgctcatggagccatggcactatttctgaaggacattaatatccaaaaatatctcatttactggtatctacaactctgtctttgcctggagggtctgggatggtttgactgaaatggtaagatcctttctagtcctaattcttggtgcttgcccaaagtagaggctacatctgtttatttgcacaaattgaaggaacctctcttcttatttggttatttcgttgttttgtttttcaacgcgaggctttcaggtaacagctatgacctcactcacataaaccaatggaagaatgcagagacaccaagatgcatggataggccagagactgagaaatcgtcaagttctcagagcagaaaagataagccaagtttgtaaaatagcaaagagcagagccaacccacgtcacatgttaaaataagctccattttatctatttttggtgggaatacaaagggttaagaaagaagtcagctgataattcgtaattgaattaagcatttgaggatgtattctttgagttgtacatttttttttccaccaaagcaatcattgtaaaatatttaggtaacatttgttacctgccaggccgagtgcaagtgctgggaaccacatgtggaaggatagacctagtctctgcccttatggtgctgacagtgtagcgatccacctaagtacctggtggcaccacaatgatagtcagactctgcacggttctaaacatttccagtgcttgcattttgatccttggttgaattgcttgactttaggtaaattgttcaaaacagcatgcaatagttgcttcccggttcatacataaatatggctctcctcagatgacacatatacctattgagttagtagaaaatttagatgtgtatttgctaactttatttttttagtgtgtgctgcaaatgtcagttcaaattttgctggtcaaacaccccttgtaataggctttgataatttagctcctaggaatggcttggttacagaaccccgtaaaagtttattgacttctgcttgctggcttaggttgtaggttagaatgtacctcagaaattagcttcatccagtttaatgacttcattacagagcagtttgcgtgctctcaagcactgcgtaatatattttttaacaccagtttgtagctatcttgagctatttctatgtaataggagaggcgggtttcacttgtttaaatggccaaaataaaaaatgtcgctgaaatgggaccccgtagggtccacgtggttggggactttcactaccaatatggtctgaggtaataattgaatacccaattgaatctcagctaactccagtgttataaagagatcacttgtagtagccattgcttttcctaagggcaaataaatagtgatttgaaaattatatttaggctttacataaaaccaaaggcaatagaggttgatgaatatttgtagccatttattagtctaaatccaacatgaaatgaatttggttttctccctatgcctaaatagagtgttttaggaggactattatcccttctatgttaccctaagacatgttattacacattgctaatgaacctctcagttcactgtacataaatgtggtgacatctgcaaagctgactacttgctagtctgttactgtgttgaagtgtattctgttagtgcaataagaagttaaatttaagaaagattttaaaatatgattaataacaattgtaaatacatgataattttagaaaaactagaataaatatataaaggacattaagtcacacaagatcctaccacctggaaagacctactattaacattttggtgcctgttcatatgtatatgaagatctccagatgtatctggagattctacatctatatagctggagatcatattgctcaatattttcactcattttataataactataaagtaaattttgataatctttccatttgttaatataaattttattggctgcagagtgttctgttctatagattatcctctaaccagtaccctattgctaggaatatggatagtttccaggatttcattattgcaacaatgcttgtgtataaacaaattggtgtatatatatttttgtacaattttaagcttatttcctaatgggaattctttcgaaatgtaactgctgagtagaagtgcttcgctgctgcttctcctttcactcctgactttctctgaggattgcccatgtggctgtgccctgcagggttgcttaggcctgtaatgtggtccttcacacctctctccccttttctccttggatctacacatatgcattccggggtcctatggccttggggctgttttcttgtttgtgagggaggcctttgaaaggtttagacagataagggttagcaatgccttaattaacaacatagaaatatcattgtcatccctgctgtcttgttggctagttcctatattatgcctacaaattatcaacatgtcctcagcttccatctccagaaggttcttaagaactaaaaatcaggaccctttcaaaatttccagattctaataagactgtctattccatcaacaacaatattgacaaaaataataaaaacaacaatattgacaaaaataataaaaacaacaataacaatacctaatacaaattctaacgtgccagaacggaattatgtaatctggccctcggaaatggaatttctttagactaattttagaatattcttttaactgagtgtatgtgatggggcatggggggtagggtgtggagtggggagagtttgtacataattgcttaactgggtttttggtcctaggaggatgtccttactgatttttatttgttttctgtttcacttgatggattggcggcagattgggtatgagaacaattaaaaatctataaatccacagaatattagattttgttaaaactattctgcacacgaggaaactgaggactagagaggtgaagagacaaaattttgtgaagtgaatttatatatttatttatttattagatagagtttcactctgttgcccaggctggagtgccagtggcacagtcttggctcactgaaacctccgcctcctgggttcaagtaattcttctgcctcagcttctcgagtagatgggattacaggcacgtgccaccatgcctggctaattttctgtctttttagtacagatggggtttcaccatgttggcccagctgttgtcgaactcctaacctcaagtgatccacctgcctcggcctcccaaagtgcagggattacaggcgtgagccactgcacccggccatgtgtagcaaatttaaattcagttccttagccactctcgccacataagtgttgtgtttgacagtcacatgttcctaacggctaccatataggacaatacagatatacaacatttttattatcatagaagtttctactagccaactctgctttttaacctctagtctaacacttgaatattggttccactgttccactgaaacattttttacagccactgaatgtcttccagagcaaccctgaatattgtaactttatgtggagaccttttgaaagcaatgcattattgcatttcaaagccatacttaggcttattaaagcatattgtaatgtcactgtatttaaattatccacactggttgcctaattaccactttaagtcttttaatacacacgtcccttaattttgcatttttcttaaacatatcaatttgcacttaaccataaataatagagtgcttagctcatacatatcaatgagaatcccctttagaagtgaaagattgcttgcttaataccaaggagtattttggagaacatcaaatcccttgacagatgcatgttgccacaacgatttattttcttctgcttgtagctaaaatagcatcattttgctatttaacgatattggaggagaaggttatagcaaaatgatttacaaatagtaattgcattttccagcttacttatttccataaacgagcccaaaaatttaatctggacttgtatgtcagactcaacagtatcaatatttgtgtcttcaccaatcacacaagaaggtgtttgcttttgtttcaggtaaaaatgtattagaagttatttcatgcccaatattcatatatttctccatttgattttgactgcattattcattggtgaaagaggtaactgtttacagactgggatttcagtggcttcaatgctcaccaacatcctcctcattgctggttgatgcctagaatcccaggcttagcttagcctaaaatcccttagcttttctccctattaaaatgaaaatatcaaatatctctagggtgggatactattaatattaggagataacatttcaactatgacttgaagaatatgtgtcatacaagtagaaactgagaaagaaaggatcgaggtggtgatactgatacacaaagatagcaatattaatgggggcagcaaatatttcttcttatgtggagctcaaggtttgtaggaacagattgaaaatgaagccaaacagataatcaatgaccagattagagattaggaaggatcctgaaagcatttctaatgctttttgactttagtttatcaatgagaaaggatagggaaggatagggaagaggtgtttttttttttttttgaggtggagtcttgctctgtcacccacactggagtgcagttgtgcaatcttggctcactgcaacctccgcctcctgggttcaagcaattctcctggctcagcctcctgagtagctgggattacaggcgcccaccaccacacccagctaatttttgtatttttggtagagacagggtttcaccatgttggccagactggtctcgaactcctgacctcaggagatctgcctgccttggcctcctaaaatgttggaattacaggcgtgagccactcctcccggccaggaagagttctaggcagaagagcacaacagctttgtatttgtgaaacgttttttgagcaacaatacggagggtaggttagaggagagtggttctcaagcaggggacatgagttgggaggctgttggtaaaactaaggaatttcaaatgtcagaacaaagatggtggcagtggcattgggaatggaaagatgcatagggattctggagacatttggaatttccccagtcttccctccttcacctatttcaatgtaaatgatcagagtatagtcttgagacccttcccaaacctgagaggtgacatagaccaccccttgtctgcttactggccttacattgattgctgcttctgcatcccttattgagccaaaacatttcctatttttctgtgttgacatgtaacttctgtcctctatgtgcctgatctactcagctaatatataagctcctagaagtcacagaccttggttaccttccttttgcatcctctgtggacacagataacaactgagaagagaagagaagtgtctgggatagtgtttcccatatctgacccattcattacctgggaacttggaaaactaaagattcttttgtcccaacatggaacatctgattaagtagttctagaatgagatccaggaatgtacgttctttaacttcagctgattctggtggccatttggatgtgttaaactgtcggcagagtttctgattctgacttttggtcatattggactctgtggtcttatcgaggcactaaaaattgagggcttcaatttccccatttgagaaattacagcattgaagtagttggagtcagaggtcacttctgccatgggatttgcctagatgaggttgctttctaggtcataactaatttcccaccttaagagtagagtctgtcctgggagtagactaggtaattccccaaacgtattagagtgcatccttatgctaatgttctgtgtcactctccctggtgggatcttcttgcctaagggacctccatgtgaggaggctgggtgggcacacagagagagctcatggccaatgccatcgcccacagggaagtgtggtcgagagtcctatgtagagcaccagatggtggtaggtggctaagagagtgtgtgggggctcccttcagacgcctgtgggccagcatcagctgtgcccctgcctcttgccagcttttcgcctacagggccttcttgatgcctgagccacacctcaggtgcgctgaaagcttgctgatttgttatacaatttttctatgccctcttcttccatggagagctagtaggaattttcctatgctaggctgacagcaagctcctccttgtttaaccggtatggataaagagtaattgatgtgcagtattaaaaaagataagtttgatctatttttgccttcttggctgtacttcatcagaagaagttacttgtgaagttgtcagtactgagctggactgcaaagtataccgagggaatgagccgcttatgcagaatgagagatctgtgtgtgcccaggtccttacacatgcacccagcacagagcaggcatcttcctaaaactctctggatgttctgcctccagatgggcccctgtcatcccagattctgcaagtggatcaagtcctaataccttaaggcatccattgtatgtaaggaattaatttcttctgcatctagaatggtgttatttttgtagcatcccttggagaattgagaaaaagtcactttctatgttgtgaggatcaaggaagaaccccagctgaaaaacacctatgtcaggctccccagtctccagagggacaccgcctcaagacatccttccctgagggctatattaggctttcactcacattcatggactgctccttccgatggcttcctctccctctcctcttcattctcacttcccccacatcttcccactagttctcagaggatatacagtgtatgtggtggtgaagggggtggggacacaactttgataaatatgtctatgaacagcattcagagaatagaatagatatagcatggtggaaagtaataagtaagagaaatgaaaatgaaaaagaaagggttgagaaagagagagttgggaataagactggcatttgctgacagcaaaatcttggacccagtacctgatgcactgctcaccaatagcctaattggattttcttctatccatgcattcctgggatcccggactatagtgctgaggcaaacatacttcccctgccatcatggagcttccagtctgggagggaaacagatggaatgaaattgccacctggatgggaaactacaaatgacaatacaagctgggaaggagacgattcgctctaaatgagaacataaaaaaagggttcctgggctggtctggggacctggaaaagtttttccggaggaaagcatatttgaggagacatctgtagaatgaatacatgcaatctaagtgaccggagccaaaggatgagctgacaattgttctcagatgagtggacagaggctgtgttagtggatttttcagtgaggatgagagtctaaggggagtaggaggaagggcaagactgttcctatgtttccttttgtgaccagaaggaatttaccagaggaggctgccttagtcctaaagatgtcttcctttctgcttcccagctactgccctagaggcgtcttaagaaaactaggtagatatggaactgactttatacttggaagtggctgcagtctgctctggtaaacaggaagtaggccaggggctatgcaggggctgtaagcccacagagttcagctcttgcttttctggaaacttctaccagcctgagagttggaatggcagctgctgccctaaaggttgtgctcatgccagacatggctgtgctcatagccctggaccccagatgcaagcacaggctggcactattttaaagcaaaattataacccgagaatagaaagggggtgggtaccggctggacgggtgtagagtgctatcagacctaaagaggtctctgcttccttttgtagtgttttgaaatttgcaaacctgtcctacatctatttttatttcatttgatatccacaggacatctctattttacaggtgacaaaaccatattacagagaagttaaatgattgcccaagttcacagaccatattcttttttagttttccttattggttttcatttaggagtaaccctctaattagagccctcatttttcatttggagacaaatgacaagaaaactgagaccagaaattcttgaaagataaatctcagacaacatttagtctttctcacacataactttactacctcagctcctatataatgaaaatttatatcccccaagaataatctcaagctgccttgtaaatcatcaaagaaagatttaatttagttcagtcctattaggtgtatttatggtgctctgaatcattggtatgggatacatatgacgactctgaggagaccacaacattacaataaaaggaaaaattcattttttccaaggtttttatagaaacaggtgaccactatatagtccaaggccagaaactgataaacacacccagaatcagtcaggatgctggaagtgctgggggctccatactctcctgcaacccttttctgaaaatgataacttttcaaaaacctcttaaaagtagcaaagttcatgcaagtgagaagagatctatgtatttcaatgcagtagtcaaagaaatagctgtctgctcaagaaagcaagcaagttttcatgaccataacataaagtcaaggcttaacaaattgtatcatcccatttgttgtgttacaacttgaatttttatattaaaaggtgatatagtttggctgtgttcccacccaaatctcatcttgaatggtagttcccataatccccacgtgtggtggcaggggtcttgtgggaggtaattgcatcacagaggtggtttcccccttgctattctcgtgatagtaaatgctcacaagattggatggttttataaggggcttccccctttgctcagcaatcattcttctctctcctgatgccttgtgaagaaggacgtgtttgcttcgccttccaccatgatcataagtttcttgaggcctccccagcccttcagaactgtgagtcaattaaacctcttttctttgtaagtctcgggtatatccttatagcaatgtgagaacagactgatgcaaaaggataccttaattttaattcatcggtgctcttgcaatttagatattcctgaagaaagtgttagtattgtcctatatcattcagaaaaaaaaatgctgttatatgtttctatcaatcccaagcccagcagattcaactatgaattttttttcaatatcagaaacatgtttacatataagaactatacaatctgaatgctattaagtggtccttctgcttaaaacagaaaattctgagtactattttccatcagataatatggcaaatatgagtagtcttcccactcattttcttagtactaatatattacaattaaaacattttaaaactaaataactgtgttatttatgaattattttttatattgagttgaaatagaaacacctctagcgttttcttaaagtgttatgagcgccatttgagaaaagctgccagcaacctaagcagctctggccaacctagcaggagtctcacctaataaaccaggggctgtaaacaagaggctataatcagcgccataaaccaggagttgtaaaactgactgtaagcaggccaaatccaggtgtgtttatttggctaatataatttgtatttacatatgaaggtgaattcgttccgatgagaaagatgttgtcccttagccacaggctcccccattccataatgatacactttaccctatgcactcatttatgcttcctgcttagcccctgtgggtacctgagtttgtgattcctccgttttctttgctcagcccaaactgtactaaatcctctatttttttagggatttttttcccaatttctttccaatattttgtaacttaaaaacagcctatgaagatggaaaagacaagccttagaggtttcttgatgtactaaaaggctttctttgccactgatggggtgcagagcttaaccattgctcttactcagcagggaactcattgtcttaagtgtgatagattatggacctacagcattcaaaataactggttcaaacccaaaccacagtcttaatttaaggaagaaaaatttttagacacaattcagtgaaagtttacctgatgtcttcatagagccctttatggtttgtgttctcactatatgatagtctcttcaaatcactgtttctgagtctgacaaaaattggcataccagaggtagtactataattttttgagtgatatcattttcaactcagtaataccagtcataggcagttcaacacctatcaggtaaacatgtctgagacttcagaagaagatttttaaagaaaatataatttataataaattgaacaaagtttggagaggttatttacaataacaattcattctgcttattaaaatatttaataattaaatgctagccaccctggtatattcagatgattgtttatgggactggcaatttgagagtaagtgtgaatgggtaagtggatggcaaagaaacacaattggcagctactgccaagaaaagttatctttgatcatataaggtccccacccccaagaagacacaagatcagtttgacctgcaatttctcaatcccaatcctgtaatgtgagatgcccctctagcagatgtggactattttgctgttagtgaaatgacagaaagtttcaatgtggtgccaagacacaaatctaggaaaaataagtttatatctaatagcaataaagagagtctgtctttatcccccccttgggtcatataagactgagaaatatatttgtaacatatgtagtggtggtgatagtgatattaggttggggtatgtatgtgtatgtttacactgagagtgtgcaatgtgcccagttggctagctccattaacataatatggtgggtaagaagaaggatcttccagtcttccagtcacaaattataccacattgaccaagcttctttatcctcagtcttttttttttttttttctgagatggagtctcgctctttagctcaggctggagtgcagtggcgcgatctcggctcactgcaagctccacctcccgtgttcacgccattctcctgcctcagcctcccgagtagctgggactacaggcgcaagccaccacgccaggctaatttttttatatttttagtagagacggggtttcaccgtgttagccaggatggtctcgatctcctgacctcgtgatctacctgcctcggcctcccaaagtgctgggattacaggtgtgagccaccgtgcccagcctatcctcagtcttactgtactttttcatgacagtggatataagaaatacttcagagggctgcctctagtgataaataacacaggcatatatggtaaacactaaaaatatatctgggagaaaattccatataaggatcatattaaaacaagacaatttaaagccttagaggatttcatctggccattgtttcatatcagactgatccataagagagtcttttagtgagtgctttctgccttgtaggtggaaggccaccccggttaggttggattccactggaatatgaatcacagtggaccataggaggaaacactttttgaaacagagcttcttaaatcctatcagcaagtagtatgtggctgtataattacttatgattactgcaatacatcattttagaaagtacttttcaactgcttcttttccccttataaatgtattattcatatctacataaataacagttcactaaattcgtttaaagaaatccattgattctagtaaattattagacacttgtaactgtcactcaggcaataatctagaaatgccccactcaggatttctggaaactcactccggggatgaaggaggaacaaaaataccgttccatctgttagccaaaccgactataccaaataatttggaacttaattacagagttggctacattttcaaaatgtgatttccaaaggctgaaagttttatttaaatctttctatgtttatttcctctaaggaccatcagtggtgtttgcacatttcacttttagaaccattggctctaaagaaccttcagattagcagtcagacccagggaaaagagggaaacagggaaaactacattctctctcttctcccctacttttttatgccccttcttcatctctagcatagctgagaacaactccatatattttcacctacaaatagagctgtcagaaaaaatacaggacacctagttaaattttaatttcagatagttgtttattatattttagtataagtatgtcccatgcaatatttgagacctacttatgctaaaaataatttatcttttatctgaaactggtcattctgtatttgtgtttattaaatctagcaacccaagctgcgagacaactattttgccaagatatttgcttgaaaaagtagggtcaaagtttatctttctgaaggcataattttgattagaaaatctgaaagaccaaactcttctttgatcccccaaatgaatctctgttggtagaactttgggcgtgcgtgaaaggtggtttataaagattattctgttgggaaagcctttctgttgtacctaaatttagaacatataggtggcatttgttccctgtactcacacgcctggcagaaggagagaaggaaggaggaaagcagtaggatcaaaatgcagtcactgttttattttattttattatttttaaaatttttaaccataaatcttgcactgggtggagaggggagaagaaggttgaaacctgacaacttcacccttttggttactcaagccaaaaatcatggaatcgatttttcttacattccaaatccaatccaacaataagtgttgtcagctttaccttcaaaatataagctgaatctgtccatttcctaccacatcctttgctaacaagctggtccaggacaccatcatttctcacctgaaatatcgtagtagcctcagtctctctccattttcaccattgccctttcagtttactccccacacagcattttgattggatcatgtttaaatctaaatctgagatgtcacttaaagcccttaaatgactgccatttcactcatgtcaagccctaacaatgacctgtaaggccagctccactcctctccattctgcttctctgagtttatctcctgcagtgcctccccatcacccttctcctgccacactggcccccttgcaaatctctcactgtatcacagacacactcctgcctcaggagctttgcaatagtctcctctgcttgcaataggtatctgtttgctttgcttctttggttccttcaaagttccgttcagatgtctcaacctcagcaattgcagtcctcctctactccctctttcttatgctaccttttttctgcctggcctgtgtctttgtaaacactctacctttcccctgtttatcttgttattgcatttctctcccactagaatgaaagctctgtggagatgcgagatgtgttgtggctcttgcttattctggttattactgtatcccagtgcttagtgcctggcacatggaaagtgctccataaatatttgtcgaatgaatacatcagcaacagtttttaaacaaattgcttttggagttagacacttatttggaaatagcagtcttaaaagaatggacataggacagggtagctgtaatgtcagggtcacattttgcagaatattcagagtgtggtagcaggagatgaaaaaggccgagacaatagggaacagttggataggcaggtcattatgaggcctttggttgtctgaagacgtattggggatgctttataattcagccagagactgtccttttgcaaaatcagactctagaagtatttgtttatcatctcgctatgaaagtaatactccgtatagcaatagtcttcgtgctggagctcccacgttattcccaggatctgggaagacattaagataattaaaagcccagttcgctctgggctgtggggatcatatacacagtgtattatgacaactgatctttctgccactcttctctgcttctattcttctcttctgctctatgctgtagtctcaattcgaagacccttataacattgcttccagaaatatcttcctaaagaactaatcaagccgtattattgtctagcttctcaattagcatttttccctactgggaataaactccacctccccctgttttcccatgcttgttttccttctgtcctttctacaggctagctacactgagcttctgcacattttcatattgttcttgttttttcccactctctagaatcacctccattgcctggagaagttctcagctctcacaactcaacttacatgtcagctctttggagaattttcttcatttctcttgaaggcatttactggtccctcttctaggatttcgtaatgccttgcacatacctttgttgcgactgaccttatcataccataatgatttgttgacttatctgtcaccctcagaagatagagcatttgtgtatctccaccatcaattatagcatatagaaggtatgtaataattagatgattattaagtcacattagataatttagtttgtaaagttcagagaaatttattattgctcctttacatatagttctctggagatattggttttgtttttctttgttcttcataataacctcccttaagtcaaacccccgtgacctcttggtcacatgaagatgtgttagttgaaccctgttccaaaactagagagaacaaaatgtctaacagtagctcttttgttgatcataccaaaaggcaaggcaatcatcaacctgcttactctcaggatctcccacattggtcaaaccatgtcattacatgttgtcaggctttgagaaaaagcattcttcattttaattctttgcatgattaaagtcattcaattaccatttgatttaattaaatggcttttatgatttaattttagtgagaggaaaaatgatcagtcattaaaatgatgattgaatgatgatttttttattattgcagtagataacaggaaagagcctttgagataagttttgtaataaagaatccttctggtagtcactaaaatgtgttatcagtaatgaaaaaggagttgttgatattgttaattaataagtgatgaattagtgtggaacctgacacttcatttaccccagtaacattatctcaggaaattacagagaatattattctgtcactcttaagaatttttcagagagagagagaaagagagagagagagagaataaatgtgtgtaaacttccaaacggaaaaataatctaaattgtagtttagcactcaagcaaaactaattgcttaaagaaaatgcatggtgtatattatggcatgttgtaaaaatatcagaatttacttaatgacatattattttctctcttttttaaaattaataactgatactttaagttatatgtcataatattttccttgttgtgaatttcattaggagatttttttttattcccatcaatgacatcctttgggatgctaaatatcaactttataatggagggaaataatttaggcaattaatgttgggaatttaaagaaagctactctaagtgcatatatatttaatataacttgttggaattatttttctgatacaggaagagatagtcggatattcaataagtgattgattatttggttttaggttctgacatcagtcattccatatgaactggatattccacaattcagaactattgagtagttctgaaactaactacctgaagttagcacacaccccacagataaaagcaaagtccttcacaagagtgtccccacttcagatgccagacataagttttgggtgtttgtcctcaagccacttggatttctgcccggctggatacaaattccaagctgcttcatctctacctcaatagtatggactgtaacccagttctgacactacctagagtgtctttgtccatttgcgttgctataaaggaaatacctgaggctggggaatatataaagaaaagaggtttatttggcttatgattctgcagactctataagaagcatggtgccagcacctgcttctgatgaaggcttcaatgtactttcactaatagcagaagatgaaggagagaaggcatcacatggcaaggggaaggaaatgagagaaagagaggaggagaaggaggaggaggaggaggaagaagaagaagaggaggaggaggagggatgtgccagactctttttaacaaccagatctcacaggaactaagaatgagaactcactcaattccatgagaatggcaccaacccattcataagggatccacccccatgacccaaacacccccagttaggcccagactccaaaattggggatcaaatttcaacatgagatttagagaggacaaatatccaaaccacatcacaaagttagcccagaccccacaggttgaagacaaagtcctttacaagactattgctactttagacacctctctagaggggacagttgtaggtctcagggccacccaagcttctgacaaactgaagaaaaatttggaggttctgacaacttccttggttcaaaaatttactagaataattcacagaattcacagaaaaagctaaatttaagattatagattccttataaaaggtatacctcaggaacaaccaaatggggaaactgtgtaggacaaggtcagggaggggtgggggtgaaaagcttttctgtattctcactgtggaatctggccacatcattctttcagcagatcaatgtgtttgtcagtcaggaagctccacagatccttgagttcagagtttttactgaggtctcattacataggcaggattgattaagtcctaatctctagtcccttttcccttcctgaaggttgggctggcccaaagttttaatcctctgattgcatgattgctctttctatgactggccaccatcttgaagctacctatgaatcccaccatgaattgagaggtagagagaatgaacattgtcagtacaagttcagggaaaaagagctcagtggggaaggagagactcagggaaggatttctgaaaaaaaaaaaaaaaaaaaatggacttcaaccaaaccttgaagcatgtgtagaaactggatcctaaaaggagaaaatagggaccttctggtgagaggaacaaaatgagaaaatgtgagacaggaataagtttatggtatttgtggatggtttatatttccttacttgaatatttggttatagggaattctttttcccttgagtagacctgttctattcttcatcactccttctgctagaaggttcttctttgtcatcaaccacgtcaaccttctggtaatttctcctcagagccctgttctgcccttcatgaaacagttactagaagagtgagagtttatttcatggcctctgagtgtctactttccccgggttaagccaacctaattcttgcccccatccttcagtccatgtggttttgagttccccattcattgattttgtctttctggattgggtagtggttaacagtgtgttttgtgacatcagagagattgtggcttgacacctgccgttgtccaggtgtatacattaattaaccactttgaaactcagtttcctcttctatgaagtagggatattaataattccctcatagagtatggtaaaaattctgtgaagtaatgtaggcaaagcacttaagacagcgccccaaatatagtaaatatttgatgtatatgatgtattattaagggaccgtgtctgttagatttagctataaaaaataataacaaaaagctcccagattttaatatcttaaaattaaaataactcatgattctatgtgctggcaacttgagctaggctcagctggagagttctgctgatcttgggtgggctctttcatgtatttgccacctactggtggttgaagttctcacccatggtctggtggttgattggctgcatctgtgattccagacaagtgttcttatcatcatccagtcagcctgggctagttcacatggtaggggggcaggattcccaggagcagccagaaggcatatcctgctgcacaagtgttttccaagtatccatttgtgtcatatttactaccatcctattggtgaaagaaagtctagagttgctgtggggcagcaactcctaaggtcatggattaaaggagagagaaagaatggcgtggctcatctggcagtctgcctcggactaaaattctctttctaaaatagtattttaaaggtgctagttttcatgactagcctgagtagtatagtgagaccccatctctactaaaaattaaaaaaatatatatatatcagttgggcacacctggggttctagctacttggaaagctgaggcaggaggatcacttgaacccagggggttaaggctgcagtgagccattgtaccactgcactctagcctgggtgacaaagtgagactctgtctcttacaaaaaaattgccagtggagaatggattattctattggagactgaatttggttttgttccctggtacattaatgacttttacgtgtgtgtgtgtgtgtgtgtgtgtgtgtgtgtgtgtgaaacagagagagagagagagaagtgaagaaatgaagaagacagaataatgaagggaaactaggagggacagcctggagaaacattcctgaggcaagagaccttgatagcctcatgccatctgggcaagagaactggaggaggtcctgcagctctggccagcccacctttccagcactccaggctctggtgatataatagagagaagggccactagactagttctagagagttatatttctttcatttgttcctttatggtgcaaagacacgttgagtgtcttctccaggattggtactggcctggacacagcgtctagtgctgccactatgattttccaagtgatcatagaaaaaccgtttttcttttacatctgtttaatgagggcattagttttgatgatttcaaaggcatcttccagttgtgatattgtacaattatacaatattatactatttatttttttcgcttttaaagcttactcattttctgtcctggctcttcagctctcagcttattgctttgatggcacccaccaatgggcagaatgaaatactgaccacaaaaaagattgtatcaatagagtcaatttctgtggcagaggacttttcatgatccctgcatggtattacatagaaagccttgaaatgttccttgcccaagtgagaggcagtggtcaatgcatggagatttctatgtcatggcctgggctcctgggagatttccctgataaaaataggtgattgtctcaccctgaggtgggaatcaggcttttttaaaaaaatttatatctcttctaaaatgacaatattggttaaatttggaataggaagaacagcattagctatgggatgttgtgcatttcctcaccctccgtgagtctcagttttctctccagttcagcaacactcacctaacagtgctgttgtaagaaggaaatgacataaagctcaatacatgctaaggtcagggcctccgtccttgtatgacttcaagtaatatttgttttccttttgtccctttacccctttgctgagctgaccaaataggatcttgtgtgctggttgcagcactttgtaaagtacaaaacaaaaaaatgaattattattattggcaccagcacatactccaggatttgagcaatgagaatcttctggtatttctcaaatcctggagtatgtgctggtgctgatagtaataattcattatttcttttgccaactgctgccttctgctgactgttgacccacttccctggggacgtcaacccataagttggtctatacatatcaacttaaattctggagccttagataggtaatacagcaaaaacataggcacctacccttgatttgagccctttagagaatggtacatttcaatcaaatatttcaggccagtggcactcagcttatgggtgggatggctaaccttggacctcatacaatcttgcgctgatcttacacaccttttattttttacagcctgatatagatctgcaaaggactctcagataatcatccacccttatccaaggctttgctttgtgcagtttctgttacccacagtcaagggtggtccaaaaatgttccatggacaattccagaaataaacaacgcataagttttaaattgtatgctattctgaggaacatgatgaaatcttgcactgtcctgctcagtcctgtctgagacataaattacccttttgcccagcatatccacattgtatatgctccctgcctgttattgtataagaaaaaaaaccatgatgcatatagggtttgacactatctattgtttcgggcatctactgggggtcttagaatatactcctgccaataagggagagagtatttctgaaaggcattcagtgaacacaaaatattatttcctttggtgagttgattttccccctcggtttatttttgaaatgctgcagggaaacgccatcatttctctctgccttctcaagagagccataaaatgctattggctattagctaaaatgctgcctcttggtttcattgatctgaagggatttgagatccccagggtgaccagagattaactacacacaaattatattcagaaatgtccctggatacttgctcaggatctgtgttgttagggtggtgcattgtcaaggctcaggccagggttatgaggtcattggaaatttaaagactaggtctgtgcagcctgtggcgtgcagaagtgactcacttctggaggtgaagtccttagagctcataaaaaggtcagcttctgagggtttaatctgggatgcacaagttagctttaaagggggagaacttgagaataagggatttaatcactgaaacaggccattaaatgcttttaagaagttattttctaaagagcgtacattagtgtctgtgggtatagtcaaagggcaatttctccttatgtcctccaaaccttcatacaaaagcacctcctttcactgtgcatctgtctttattccctctctatttagggcccttggttcttacttttttttcccttcattatcttcagctggactgactgagaacttgcatatgtggtgttaaattcatgcaacttcagaagatatattgaaacaaatcaacactatgaattttgcagttgtatagttaattatagtttaaaaattactattaatgaaattacttaaatataatactaataagtgaatacaaaattattattgataaaggctatatagtttttaaaatattctctagtatatatggttagtgtaatataatgcattaaattctcttatcttttcaacatttgaatggaataaaaagaagtaatgctaaagttggaagataataggtttttggaaagttttttttttttaattttcaccttggaataatagaacctgcatgttgatccggcattgtagtaggaaaagcatgtaagtgcagccttcataatgatgctagcaactgtttcttatgaagtgatccagtggatcttgctgtctctttccttctgggagtcttctatcagctagtgataggtcacagggaaatgccaatgggttctgccacagtagagtcttaagaaaggcagcttagacaaatcccaaaacctatgaaccacatctacatgagttatattttcattcacttcaaaccatttccctgttatttaaatgttatttatttgctgttttttttttaagtttaaaacttacttttcttgggcaaatcagatttgtagaatgagaaaagcgagtacatttttctttagacatgattttttgatggcccttggcaaaaaatatgacaatgtaggcctctcaagtgaaatgtctcattacttagttttggtaacatagtacaactcacatttacttctcatggtgtgaaatttcaaatttaaacagaagtagatagaataatacaatcagctctcctataggtattatccagctgcaacaatatcaaccatgggcaatcttactacatctaaaccactgctccctctctcctattattttaaagcaaatctcagatatataatctcatagtaaatatgtatgtgtttaatcagtaatagaaatgtacttttaaaatatgtatgtgtttaatcagtaatagaaatgtacttttaaaatgtagtcatgtggcacaattgttaatcaaaacaacacctgttgcttactagttatgtcttgcaatcttagagctgagcaagcttctctagatgagtagaccagtatccattttaaaacctgatttaaagggcactccagatggttcaagtttttttttcagaaagaagtaataggtaaataatggatattaaaaggagaagatattggtcaaaatcaggcaaaatatgggctagtggatcctcaaggtaataagcaaaggaatgacaagttgcaatttttctttaaaagggaagcaatcttataagaattaaattaaagaaggcagaattttggagattgagggtgacatttaaaaagtcatgtaaatcaataaaatttaggatataggtaattctttaggacaaataactagttttaatcatcaaataaattgcaagaggggagaaaaagagatgagttgtgattgaaagacacttaaaagacattatcaaccaatgagagtatgaaccctgtttggattttgactcaaacaaactaaaggtcagggtgcagggaggggagagaatatcagagatgtttgaacactacctggatatttgataatattaaggaaatgctggtttgaggtgatggatatgctaattacactgattcgatcattacaaattgtatatatgtattgaaatacctttctgtacaattactaaatgtcaatttaaaatataaatttaaaaaataatcaaaggacaaataacaagatagtattggtgtgtgagacctacataaaaaggcagtaacctcatatttaaaaatgcagcctctgagatagaacctgaatgtgtttaagttttcagtgagtattgcttgataggctagggacttacccatttttctggcattatttcaatgggaagatgtctcatgagttacaatagatgataacaggttggatatgcctctggttcaccctaatgcagctgagagaagctggaaagagtgcccctgtgctctcttagagctggaaggacagctagtcatgcaggaagaagggcagttctccagccactgcatatgctgaacatacagggagtggaagaatggaagatgggagggcaaaagaagggtaaggaaaggaagagataagaaagaaaggggataggaggagagggagaaggaggagggaaagaaaagggggctgaccactaataattattgaatggttaattctaggcatcatgccaagtatttgacttgtattatctcaattcccttgaccatgaacaattagtgtgagtagaatgatcccattcatggcaatccaagtggaagagattctgccttctttcttcagcagcagtggcagcaagaagcattatacatttagcgggactacacaagttctcactggattattttaatgtcttaatacagatttcatgttttaaaagatgaggatagtgaattaacaattgaatggaattactagctaattttttggaggataaggggccctaactctggatgataaaataccaccagataacactctactccaaaggcagaagtagtcccaactttctcaggccaatcaattttaaagtagtcagtaaaggagtaagataaacaactgtcaagattttggttgtagttttcagctctgagccctatccagagcagttcttccaacctttccttcccttgactgagcccaaaaaggacagaagtggtggccttttctctctccatcctgatacacagtggttcaaaccagtttcctcttcagtgctcttaatgaagagcattgaatgtggttcaatgcagttttctcttcattactgggtttttcctctactatgaatccaccagttccatccctcccatgatctctgacattcaatcacacatttttttttgcatcatctctgagaattcctcaaattcctaatagaggcagggcaggatttgaacctgttcccagggaaatgtcattttccttttctccttggatattcatttgcctcatcctttgagctttccacacattcctgtctctatcccactccatttagaattttgtcatattggttaagatgattatggttgcatagatagataattcactttccaatggttgaataatagttgtttattactccacatggcaataggtctagaggtggatccccccagctagactgtggagcacagtggagtctctttccattttctgctctgctatctcacttagtcctagtgtttgttcattgcaagaatcaggaaggttgtctgtaggccaaaaaggaggggctctttcttctagacatcactttctttttttttctggaagtgaaatattactctgaggtttccaagtagatgtccgtccagctggtcagccatgacctggcttcatggaaactggcaaaaccagaccatgatgattttagcctttatcatggcagcagactgccatcatggatgaagaaggtggggaatggcaattgagtagattgccagtagcatctaccacactggtatctctcttattgaattttcattctcattcattctctaaggaagagattctgccctctttcttcagcagcagtggcagcaagaagcattatacattcggtgggactacccacattctcactggattattttaatgtcttaataaaagtcagtgtcatactcaaatgtgtccatccctgatgacagtcaactaacactttaagatcaagcctgggtgtcttgacattcttacctcagagtgatttctgttttcttccaggggatccatggagaggtgaatggtcatcttgcttctggtctttgtacaagggtcatagtctggggaccaagtcattattcccaaaatgtccctttattttgtcccagtgagcccactggataaatagataaaactcagagaagccaggactcccagtgggaatgcaaatgaatgtcccttcagagatgttcatcagataatcaaagtctgatgtagaattaaatggtctcctgacagatgagccttcaaatatgaattgatacagaataccagcaacatttcagccactgctattcacatgttgttagacaggcatgacttgtatgataatagtcactgtaacggatataaaattccctatacaacaaaggtaaaaacatttcacttgcctttttattttttcttttcaaaattgcatctaatccacttgatgcttcctcttaccagggaaattgactgtcaatttccataaagattttcttacagtgccaacccatcttgattatgcagtggtccaggtggcctaatattggtccagaactctcaggaatggtgctctgatcttcaggccacctgatttccacttacctgctcattgtctatgtccacatggtcccttgaatgcaggcagaattgctgctttatgccgtgtttggttattgaagtctcttctgtggatagacccactggtggccatgacccagcctcctaaggagccctccgtacccattcccctatggagtctgcatgtccagcaacctccttcaagtactttcttcttttccccccgccccaccgtgagatgatattctcctcagagggccttaggaaacactagtctggactctgttctttgtatgatgagtgtaggggaaggatataagagtggtgagttgttttctcactaactcatcctgttatagataggatacattccatattgaaatggaataaaattagattctggattgtcctggtgatgaagtagctacttataaaatatcaaatcatcacatgctgttgagcattttgctggtgcgcttagccagtgtttccctttcatttgctgggctgcctccatgctctttcacatcgtggattgtgctcttaggagacccttttcttccattctgcatgtcaaatcccacccacctaactagacacagtgtatagtccaccttcttcatcaagccctacgaaacttctcacacattccctgaattgaggaaaccgtttccttttgctgtatcattggaagactttgctacacctgtgttatagtattcatcctattctacctttggttgtcattatgtatgtggatgttgtacccattgtattggtatgtaaaccctttgagaggagggctatgttttcttctttgtgattcatcttcagtccctagaaactaactgaattgaactgatacaaattagttgtcccctgaccataaatagtatataacaggacacaaaatatatagacatggtacataagtaaattaatgatatgaacaatgaaaagagatgtcctgaacagtccagagttgattgctaaggacaatgactgttctaacaccttctgatggtaagagggaggaccatggtgagctgagggcgtcaagaaaagcctcatagctgtctttacaacttgagatggatattgtgtcatcatgaaaattttactgagtagaaagaaaaggagaggacagggaaggcatggaaatagagagaatgatagaaatgacttaagcatcttttggttattttgggtacatcagaaagactaccatcttcccccctcccgtgataccttatgttttcatcaaactttaaaacttagaaactgctgtcacatatactactttatatgattcatctagtgaggtccatagactgaatttcattccattgcaaataacattgtaaaggagattcactgtgtatagtcaaaatggactccattggtaatagatatgcttggtaccaaaagtaatgatgacgaggatgacactgatggtgacgatactgacgatagtaataacacttactgaatactcactatgtgcccagcatgtgcaaaatgttttgcatatattaatactaaacctcccaacaccttgaaagtcgaatttttaagccatctctagattaataggggttgagtcgtttgctctgcatcacacagctgttgttcggtagaactggggctcatattgaagtctattttattccaaagtccagtcatttttcattccctagagccctaacggctgacaaacatgacaaagggaagagcacaagtgtcatctcatgatatgtgcttaactcacaccttcgatagggtacaaatgtaatctgcattaacctgctcaaagttcagcaccaggtaaaggcattgcatttacttagtgcttcatcttatttgcgaatacagatatgtgggcttaggcaattacctccttagttaatgacttaattgcctcttcaaggtttgatcttgatactcaaatcatctccccgctaccaaccctatttttgttgacacctcaaaacccatttttgggcctttgtccttagttgctgcccagggtcctctggtgatagcattccaagtgggggacattcaactgaaagtgaggcaaacagttgaaaccccacggcctccttaacacagggattgaaaacctccaagcgatcaccagaaatttatgtttgctgttagaaaattgctttgggaaatgacgtggatcaaagaagtaaattttatgtcaagattaactttagtagtgagcaaagcagaatttggggggagaaaaaaaaatatccctaggtgtttcattacacttgtattaacattctttaatatttaccacactcatactttttgagccaaactgtcagtgaaggcattgaactacagagaagattcaggaatttctctggagaggataacttcagtctcattttacaaacagaagctgtttattacagatgtgcttcaaacagctggcagttgttgaaagaattaaggtgaaaaataaaattcctaaaaaccccaccacacataaaccaggaatccactgcctctggactggcccagattcttcagcctgtttccagaaattgctgttatgcagtctgcacagacggtggagtgcttggactaggaagggaggggaggaagcttggcagggcaccagcttggagctcgatttttcttcttttttattccccccacaaagagctgggcctggtagaaaataaaacaaaaacagatccttttcctctctcacatctgctttcatcccagttctttggggttggtggccccggataaaccagtggagctcagcaggctgctcgctgctgaatgtgttgctggattttgctgcagttcagtgctgcttggctgtgaggtccaagaacactgtttctcatgggccgacagatatgggaccacagtagtagcctttgtgtgagggttcagaaaaacaacgcgtgcacttttaagatgggagtaatatgatgcgataaatggttaattaagccgagatggatttctttcccaccttcttccagaagtctccatttcagctcttagaagatctagcagatatatgctgcggatgagaggtctgctcagagaaggaggactggggactgaatctgttgacagaactgggaagaaccataatattaaaataaataaataaataaaaggcagtcacctgaggcaagtgtcaaagcatctgtagtggctaagggatctttgtaacttccctcttaacattccagttgccattgactaacagagagggtgctattcttcatcctgtttactaattattctgcaatattacttgccctactaatctctaccccagttctcgcctctttagagataatttttatattactgatttagtgttctcattaaagaaacctcttaaatcctcttcttagcttctgcttctaggagccaattgctcctaatgccatccacatttcccctgaggctatttttataaacataacatgtcactctactgtggtgatggggcaggagtgggactaatgctgattgagaatctactattggccagcaatttggccaactcaatgcacatgctctctgataatcttcctaaaaaccagcaaggcagccactgatatgaccattttacaggtgtggacacccaggttcacagagtcacactagtgactgtctaaggccacttagcccacttgggtcagactgtgttatacggtagggaaaaaagtcaactgacaggagggacttcttcctaataagaagtcaaaagtgtacttgcctccctgctccctgctacggatgatggagtaatgaaggacttaattcacagcagtgaccaagagcaggaatttaaatccctgtggaggagagtttgaaggatatgggcctcaaaagtcactgtgtgtgaggggccaaccacagagcttgggttctcatcactctcctcccactgccttaaatctttgcataggacctcacagtttttgaagttctgtcactcacatgatctcatttgatccttaccagatccttgtgaagcaggctgagcaaggattgttttctgaattttatagacaagggaattgaggtacagaaaagtgctgatttatctaagccagcaaatggcagaagctctgtctaattaattccatgccagatagttttttagtacatcatgaggcctccaaataaagacaactctgggatgtgttgaatgcagaaggagctgataagacaaagtccttcacatgaacctgtccaaatagtctcagtcctggttttgaatactgaagtacccaaacttccttgaccttctcatttcttccccagtgattaccgtgggtaagaaaaaaaacagcagaaagtaaaagcgtcatgaaacctcaccatggtgaggttggtgaggctcccgtgatgcttttactttttgctgtttttttctcccacatggtaatcattatctagctcagtgtttcccagccattttttttcattctcccactgcccccttgaaaatactatttagacattttttttcctaattactccccctccctgaaatcttaataccacagatatgttgtatatctttttatgtactatatgtatatctgtggtttaccccaaaaattagtacaatttatttcacccacataagaaacaatgtttgctccctcagtgccattttgctcttgttgtgaatgcctggtgtagctcataactatgaattcggtaaaaagaaaagaaggaaggaaggatggagggagggaaagaaaaaatgaagggagagtagaaaacaaacaaacaataaaacaagccagcaatgacgtaaaacactaaactgacgatgtcctcaatttcccaacagctctagcattccctgctagtatagattcaagtattgaggtttcactatggccaaagcattgccaatatttctgtccaaagctgggacagagcatgctttaatcattctgtgagtgaatcccaaagaacaaggtgtggcttgaaacacactcaacttttggaatctcaattccctagttgcaaacgagaatgttccctctgaccaaagatagtttttcctcgtgggatttagtagatctctaaagacgttggagtctttcccttgggggaagttcatcgctttgcctgttgataagcgatagcaaaggagaatgcatagaaagttactcttacttttattttctcctccttaacttcataccctgcctaacaaattggagaactagaaggaaagccagaattcaccactacagacctaagaaagaaaggtctggacaggtggaaccaacttgctcaagggccaggagcaaattagtgtcaaagctgggacatggagtttgtctcttgatacaggacctcctctgccagaagaaagggtcaacctcagatgtgtacttcatcatttgttaaatttccttgagcagcatccaactatggctgtgattacacaaagaaaaagcttctttaaataaacaccagcaaatctgcttcagctgaagatgtatgcttagtgtcccaggggccagtatgatttaatattgccaatattaaataagagtttggggcttggataacaattgcaagctgggtagcagtttttcacctccaggaattgactatagatagcaaacagctcagatgtggaaacagtttttccacatcaccagaaggcccttgtagctggctgctagccttcagctcctatgaaaactggaagatgtgtgtgcacatggccacgtgtattccaggatcaggttcaccagggctgccagaccacagtggtaaaggcaagccactaaagaaccagaacaaagtcagtgagtggtgtatgggctaaggcctggccagttagaaagctgggaaggaagccatgtgtagtctttgcaactccagacttcactgcctccatatccctcttttaggcccagtgctttcaggaattcaggtttttgagtctcatcctatcacagaagaaaatggtgacagcctagctttgcaggatgacaatcctggttacaccctgattcaaccccttcctggctatgtgaccttgttttgttcatcttttatttagaaaacacttatctagtacttgccacatgccagacaccattctaagcactttataaggaataactctttcattctcagtaacaatgggcttaattcttataacaaccctatgtccattttatagatgaaggaactgaggatcagaaaggttaattgccttgccaaagtcactcagccagaatttgaacccaaggaatgtgtctcccttgacacatcctaccatggtaagtgaccttgggcaagttgttgacccaccccaacctcagtttacctgtttgtaaagggaggatgctaatactactctgaacgaggagggatgaaggctttttgcagggcttaaatgagaaaatcttaaggattttgcaggttgccaggcacctagcaagtaaaatatatgattaacactcctataggtggaggtcatgtttcataaatggatcaagaagaagtggaggcctcttctgcatactctcatggtgagtctgataggcctatgccagcatagtcctcttgagaatgcctcaccttcgcaggtgcaatcatttataagttaaatggttctattgttcactccacaaatgttgacttaagctctgaacaagaaatgttgtgctactttgattgaatgagttgagcaatataatcggaagttaaaagcatctgagtgatatgttatgtttagtggcatttcagttataatgtggtttctccttttctttcctacagcatgtttgctcttttttttgtacctttatgatttttgaaataatatgcaaaaaagatcagtatgaaacactcagacaaaaaatggcctggacagcaaagcagtgctgctgcattctgaaaagtcccattatttttaaaataaaaatttaataaaataaaagaaacacagtctcagtttcagggaaatatagatttcaccataaatgcaatcactatggagcagagacagtgaggcaaaataacagagtgagtggttgttctgcagctgagggacaaatgacagaattgccttggccagctgaagacagattgttgcattgttccattaattgtgtgtaacttggcttttccagacctttctgtggcagactaatccagctctgtgtgctgctgagccatctcacttatactgaaggctgcctacaatatctctaagatagagagccctgctacacatagtttgcaatattgagagttcttcactgaggataaatatgctgatggtgaacacctaaaaatatgtgatttttaaagaggactttggtttaaggaggtaaaatatgacagaagatccaatctttatcctggctttactttaagccccataaactgttgactaatctgctcttgtaagagagcattcacttgtgttgtttcatttaaggggaacaaggtgggatgtcctggccaaatgtatgctacccgtctgtttaagtgcctgaaattccagcattagagtgatttcctttggttatttcccccaaagatccttgtttaagttgcaaaaatccccggagtagaattatcaccactccaccgatcagtgtcctactaggatttatgtttacattcttggaagagctggtggcaaatctgcggatgcagtggactgagtggaaagggaatattttggtgttaggggtatttggaaagaattgatgcctatttggttgtctcttgggtgtcgtggagtctcctttggcaaagaaaagagtgtcaggcttgggattggggtggagacacagaggggcagtggtgaaactatgatgtcaaactttgtaactgcaggacttcagtgggaggaggtgtaggagcctgtgtgcaatgggttttccaggaatcctcctaaagaagttattgatttgtatattttgagcaggactagctttacctcataatgacacaaccaatcagagaaggaaaggaaggtggtagcgggagaaggactcagaatttagaagagacatttctcagtgccagcccagcagtaacaatgaccttgggcaagctactgaaccttttcagatttgagtcttcttgccttaaaaatgggacaagtttatgtctgccttgtgaaattattgggagagtaaaaacaaatataagaataattctaaacagcgctttgtaaactagagtgctcagagactaattctaagtacaccgatgcttgcacgtctttcttctatcagtgccaccagatggagtcaatggcaggaggtgggaaggtgactcccttctccctgccatgtagcccacgtaacctgaccccatggagccctgaccccatggagccctgaccccatggagcccaggcaccagccaaccatgtctttttaaagagctgcagtcagacttttggatcttgtagattgctgagttgtccatgctgtgagtaggcaacccgctagctcagtgcttctcagccttagctgaactatggaatcacctgggaagcttaaaaaaaataataataataataaaaataattctcctcaccaaggccacaccccagaccagttaactcacaatctgttgagggtggggtccaggagtcagtatttattgaggctcccaagtggttccagtgtgcagccagggttgacaagcactctgctagctgagcaatagagaaataagatgcagctagagaacgaattccttcttctcataacacgagggaaaataactttacaacattacattgagaacagacaaatagctaacctggtggaccagaataaagaaatgattgaaaaggattgaggagtcagtgtaatcacagctacttatgttaacttgagtagcataaaacacagatcttgaaactctctcctcttcctctctttttcttttttctttctgttttgttttgttctctcttctcctctcatctccttctcccaccttgcctttttttcttctcaatctctctttctctctctttccctcccatcccataccccattttactagaaaggtctctcaattcctaatatccattgtggccacttacaatgtagtatgtcattttgagagtcctgaacaaattttttttttttttgtgggtagggggctacctcacaccacatccctgtgtctcaggtctcatgtgcgggtgagtgtgtgtgtcctctctaggattccctttcatctcttctgcacattctaaaaacccaattctcccacccatacatgcctgagctttctcatcttctcctctgttttccagcatgtccacctacctctctgaagcccctgactctcagtgaatttttttttaacctatatctgctcattaatattcaggcaagcctgatgaatcagaatgtctggaggaataggaattcaggggaattttaattttctggttaagtgacactctcttgaaaaccacttttgtttcaagttttattgtggggaaaaaatggtaaaatagaagccccaaactggaaaggttcttagggaatacctagaagaatccttctaaaagtagacacagagaccaattgcagtaagatgattaacagatgatcccaggcatgtaaatgacagtactatgtctaaagatgataactcctgacttctagaccctatttcttccagagcgcttacttgacctgccctgcagaaatgttatgattaaccagaaccaaatgtgaattatattcttttaagtgaattctctagttccttataatttcatctgcccatgaacctcactcatctgtgttgcctgtctgtccccagatgaatttcagtttgcagttcttgtatctctagactatcctgtttctaaggactgagatcatttccctaaatatgtgcaccctactcaccagactgagcacattgatttttttctagcttatttttttttagttttttacgattattgcgggtacatagtagatgcataaatttatggggtacatgagatattttgatagaggcatgcaatgtgtaacaattgcatcatggaaaatgaggtatctatcacctcaagcatttatttttttagcacactgatttttaaaatagaggttcatcaccacctcacatacattacagttttggttggggaagaagaaggcacaggctggtgggttggatttgttcagactgcagaacccctcctggaaggaatatcaagtttctcattttccttcttgttaattaaatctccactgttaacttgatttttttttcctgtttcctaaatgaggtattgctaaagaaaaagtgggtcaattgagggttctgactagttttgtcctagttaatttaagttttgccatatgttctttgagaagcatgtgttaactatgtgttaacttttgctgattatcagtgaacctaagggcttttaatttagatttccagttacctggcaagagaaagacttaaaaggaataagtctaggtaaatctaaaactaactcagaagtaagaccattccttgtaaagctgaagcacagcatgatgctttagatagcaccattactttctgtcgtggagcagggtttttcaacttcagcactcttgacattttaggtcaaataattatttgatgtgggggatgtcctttgcttgtaggatgtttcacagtatccagacatctacctactggataccagtagcaccatctcacccatgcataaaaattttaactgtctccagacacaaacaagtaaatgtctactgggtggcaaatttgcccctggttgagaaccagtaccatagacacatgatccatttaatcactaaggaagaaatgcagataaatccctgacaataacatatggatgtctctactttactctctctgagtctaaaatcctattttaaggggtcggactgaatgtactggccatttcttctcctggaaccccggagaagtctcctctattggcagagtcctgcattgcccaattaccagtgaccagagcaaacaagtcatggtcagaattcctggatttcaccactgtgcccatggcattcaacaagaatgtgttgagcatgtatcctgttcccagtctagttctaggctctttgttaggtgtaggagtggaggggcaaccattcaaggaataaagaaacagtgtgtagtgaaaaggccaccaagtcaattagcacatcccagtgcttccaatcactagctgggtgactttgcacaatgtacctgacttctgtaagcctcaggttcttcatgtgaagataaggttgctagcacctccctcacttattgtgatctagataaaggcaccataccagcgactgctcagtaaattgtatttctccatctcatttatatctttgtctaaattgtaagaatgcaattgccaggcccttcactttgagtaaaaaaagcaaaagtcttcagaaattgtgtccagttgagcaaggccaggagatggtgcccaatcagaagtaagaattttgcctcctgaatcccagaaaaacaaaaaaatcagagtagagcatactttaatggaaaaatactgaggtggaaaatactctcaaaaaatatattcccatttgctggctcttcccactagacagcaggttacactctgctgtggcataaggagcccagaagttccccagcctgcaaagcgtctacctactcattaactaatgcctgaaaataccatcagccatatcagtcatttatatcttaactgtcactgattttatcagatcctttcctgaataaaagtttgattatgaagaagaaagtattaggatgattagtgctagaaggtagttacataatggtcacctgcctgcgcgtgtatgggtgtgtgtgtgtggttatatatgtgtgtgtgtgtggtactatgtggttttatatattatatattatatatatatatacacacacacacatgtgtgcatatttgtgtgtgtgctgttatatatacagagatagattgagaggtaggagtgtgtgtgtatatttcagaagcacatttaatggtcatattctagctaattccttttttttgacattctaaacctatctcaaaatatatttcagaagcacatttaatggtcatattctagctaattcctttttatttgacattctgtcaatggcagacccaaatcagccaacatcgccactcatctagaggagataatttatgtttattttgactaccctgaaacattatgacactcttgctccaaaacagatataatttctggttctttgataattttctctgtgagaggggtatgtgatgatgttccttctaccatctcatgtgatccatcaatgccctgttctactgggccatgtcagatagactaggcatcaaacttgctgacaagtcgactaaaataagccggaaacacaagtggcccctaatcctaccagagatctgtgtgtacttgcttggaaaacttgggaggaataacaagtggcatttgcccctctgattacttacatatactcataaatgtgttgttgatgctaaatcataccaaatgtctgccttcttgaaggcagagagaaaaggttgggggctcttctactttgatgagttcagaagaatatttttaaatggttgagaaaactatttccttttactggaataacctttcctttgcgatggtaactttgtagtcttgggagtataggctgcattgtgggtaggtggtctcaactattaatatcaaggctaagatctgagcatcagggactgcctattttttctgagtgcagcagaggacaggtctcatttaacctgcttcctctggtccaacctaaaaaactactagggctaagactggtgtgagagtgtcatttgtcatgtgaaaagactttttttctatataaatattcgaaaaacctcaataccactgctgaactttaatcagctgggaaggtactgcaaatggagggtcaatccatcacaatgcccaggacgagacgtgaattgtggccttaagttcttttcagatagcacagcataatgagattagcaccctctgtgggaagaataaaaaaaaggtgctacacctttaaaaattagattctcttttaaatgcttagtagtttgcttagaggggtcagagcaagtttcttgaagcttaaagattaattaatttgagaaagaaaagatttcaagtgttacaaaaccttagttaaaactaccactttcccttattcctgccgtttccccccacctccccccaccaatctccagagctagaggcacaggggcatgaaatgatgtgagctaaattcccgtttgtgtagacaacgtttgcttgcctacaaagacacacaacgcagaaacatacagacacacacacaaagtaagaacatagctttctatggtcatcatttgctcttaagctcccagattgcagattcctctttccaatggttcttcatgaaatgcgtatggacttaagatcttctacatacatgatgtttaatcatgggcagggtgggaggagtagcataaaacaaagcacgattattctctctctgtcttatggccaccttgaaacaagaagagtgaaagataaaaatgtcttggggataggagataaactacagtttccaatattcagatttctagagggtaggaggggacttgtggttctgatgcttgccagaaaggttttgcttctgaaagctttccctgtaagcacacccacacagctctttaatgcaccaagccaaagcagctttgggcgctggattcctgtagccttcctatgagatggttaagttcacggaatccaaggagccctccttcagttgctacattttttgttttctaaaaaaggtatgccgtcttctagaggaggtcgctttagtagggttttaggtaaggcacatccctgagagaatctttttcctgctacccctgctcttggagtggtatgctatttagaaaggcaaacccaaatgattatgcttaaattcaaaaccccctcctcaaagttatcaaacaaagcacctctcttctagaacactaatagtctgaatgggtgtcatgtgcatgatgtgtgtcataatgtcatgttttaattataaataaagcaagatgaagtttcctggccaggaaaaatgagctggggtgttggggtgtgtgtgtgtgtgtgtgtgtgtgtgtgtgtgtgtgtgtgtgtgtgtgtgtaagaagctgtctcccagggcttaacatcttaaaagacatttgcaaaatatttctcttgaaagagactcttagaaatactatttttaggcatactggtttctccataggtaaaagagaaacctaccaccaacccttagcttaaggaaaccttctggtgataccattctgcatttcaaaaagctgattttgcctcctaagattggtagctggagacatttgcatgttgggggatggtagtgtgtggttccccatccccccattccctcttcctgctatttggacttctctctctcaaaaaaaaggaaaaataaaaacagaaagatgcaactctttagtgtccgttagagagggaagagaaagacttagggacatgggctacattggttcagcatctgtcatccatgacagtttatttcaatcatacatttgcttaaattgtcatctgatgaaggagccctccgtccaatgcacacagccttccccttcccttctctgcacccaccaactgccactaccaccacctcctcactctttagttcaatagaaactgaaatctcaatgatggacctggaaacctatgaggggtgagaaggagcaatcatcactctcaacacagaaaaaaaaaaaagggaaagcaagcattacacaaaagggccatctgagaagaggcagcttttctgtcctgggttaacaaattattcccatctcagaaatatgcaaacacaggatcaaatgagtatcttctcccactctccccaccccatcactgctctgtcacctctgcccctaaagtctcttgctacaagtcattaccctgcaggcattcatcctaaggtaggtttttctcctcattccccatagaaactaggaatgtgctgtcactgtttgggagcctaagcttgctgcagtcttagcaatgtgctccagaagcacagctttcagccctaaacatcgggattctgcctccttcccctcagccagaccaaagagagcagtgagctgaggggctccctttaacagggggtacaagaagggcacaaatgctactaagtctggtgaatcaaagactcaggagaattaagaacaggtggcatttggggatgagattttgaggtgatttgaaagatggttacattaagtgcaaaaatgtttcgtgttcctaggagaaactgtctggcattgctttttaaaaaccatttgcaatgctctctgctttaaaggctgagtaagggtgcccagtcctcagtccacctctcagttgcctgaaggtggttagattgcactgtccctgccccagtaatataaagggtcttgcagtttttctttttctagtccttacacatgtggagtaaattaacataaatcattaatctgataagctttctttgcccttctttaaaatttcaaattgaatctgactacgttgctcctggattttccttctggcccctggacaactccctccccacccaccaaggaaattttaactgttgcttttcttgtaacacaggtaacaattcatttaggttacaccagtctgtaaaaactgtaaatgctattttattttaaacattttagtttacaaaaaaaaaaaaaatcaatgattggtaccttttttacactctcagattcctgaatatggacagatcttcaaagggaggaaggagttctcatatgaaatttaagatagactgtcctgaaggttgtggggtggggttttttgttgtgttttaattcgcttttgtttttaagacacaataaagctaaaatgtcaagtctctgggagagatccccttaaagtttcagtcaaggagcatatcagagcacagacaaggagaccccagcctggtgcccgccggcccgtcccggctgcccaggcgtatttggtagcgcatgggttgagagccactgggacaatcacacctcgcattccctcgcgggctgctggtggcaggtacacgagccatactcgttgatgatcaccagggctccctcaatgtggttcggtttgtaatcaacgtagtattcctgggcagacatggcagccatctgatgcatggtctgtttctgcttttgcttcctgcgctgcgtgacaaagcactgtctgagctgcctgaggctggctgggaaacacttccaggacacgtagagcaccaggaccacgatgaggaaggagaagatgagggccatggtgcccgtgaccaccttgtggatctgcacggcgttctcggcgtgctcgccgcctggaagagccacggtggcaggctcgaatgtgccgtcgtgctgcccctccccgccgtccgcgagcgtggtggccgagctggcagggggccccagatcactgcggttggtgacggccgagagcaggtggccgctggtgggctcggccccatcctcgcacaggtggaaggcgtacacggcgtccaggacgtcctcgccctgtgcgtactccgggctggcgcactgcaagttgccatcgtagcgcccctggaagttgttgagccacgaggctagggcacacacgttgcgcccgcaatcccacaggttcccggccagggtgatgcttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgcgggaagtgggcgaagttcaccttgaccaagtcgttgtgctcgaggtgcagctcggtgagcttaaacaagccggcgaaagagttgcgcgccagactcttgagctgattgtatccgatgtcgagaaacttgaggctgcggcagtcctggaagatgcgcacgggcacaaactggatggcgttggcccgcatatgcagcgtggtgagcttccgcagcccgtggaagaggtcgggcgcgagcgcctgcagcttgttgtacgagaggtccacgctgcgcaggttgggcatgggccggaaggtggtgttgggcagttgggtgatctggttggaactcagcgtgagttccttaactcggcgcagtttctgaaaggcgtccccctgcacggagcagatgtgattgtgatccagatagagccacgtgagctgcattaaccccgtgaactggccggcgcgcagctccgagaggctgttgtagcgcagggacaagcccagcaggccggacaggttgtggggcgcctcggtgaggttgagcgcctcgcagtacagcagccgcccctcgcaccggcacagctgcgggcacccgctgggggcggcgggcagcatctgaaagcaggcccccagcagacacaagaccacccccgagggcctcctcagcagccagtatagacagagaccgagcagcaggaaatccattagcgagaatctttccagagagactggagaatgtccattggaagcgctcggtcagaaatctacatcatattttattccgagggaggggaagcgggggagggggagaaaagggcaaaaaatcaaataaatacatagaaataaagaaggacccccctccccaaaaaccacacgttcacctctaagcatgcagaaagctgggcagcatagaaagttcacagccacggaaagatcaaagagatggtgatttggtccatgttagatgctgcagcaaagaaaagggaggaaaaaaaaaatcttcgggaaagaatttaattaaaaagtgtcttacccacccttttccagagagtgacaacctccattcagctgctccctttgtgtgcaggctaattatatgcagggcgagagaagacccctctgtgtttccgaggcagccccggtccgcggccggcggatctggcaggcgcacaatgtctcactttgctgctcggctcggggctgcaagggcggccggcaaggcggggaggcgacttctaggacccgcaagtttcccaactacgtgccggagcccgagcttcgccttcctgccgccttcctttccctctgcagttcggactgtgacgttgtggggggaaaaaactccaaactcggggctcgcgactccccaggatctgacagtctggttaatgtccgtcattggaaacgaccactgaccggcgccaccttttactccgcggaaacagcctgccattcgcgccccgggcagctgcagagagcgggctcactcatgctttgcgggcggcgggcggcgggcggcgggcggtggggaggtgcggacggcggcgcggggagcggcgagcggcgcccgggctccttccctccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttcagcttttttgtccatatttcaaaaaaaaaaaaaaaaaaaaaaaggaggggggagggaggtggaggtaggggtagcatcatccacgacaagatatttccaagtgggaaactgaaatgttctgtgctctcccccttgccttttggggatatattcttttcccctttaaaactgtctacgtgtaagagatacgtaggaatctgtagagaaatcaacgtttggacctttgctttagaaaagcaacttgagagaagacacaggaaggcaatgatttggggcttggctaagatttttggggttttttccccctcttgcgggtactggaattctgcagtcagccagcccttttttgaggtggagaggggaaatgctttccaaacccacctagtttgggaagccatccaagtcccggtggtgtgagatccagtgtggcaaaaaggtatgtctgtgtgcagggagacttgactgagatccctccggggcttcatcaggctccacagatacatatggggtacagagtggattaaagaacgattgtactgtctgacatggggagggcttaccctgacttgtgctgttcatggtgattactgggccctgcagtgcaccccactccaagagagtgtgaatgtgtagggacgtgatagtttaagccataatgaagcctacccgtctccatacacacatcctaattaatctttgagactgcactaagttgtgccactttttcctctgagtatgacgagaagcctttgcctcattatttctattcataatcatttatagataggagtccttacaatgagctctccccccacctccccacacacacaccttgtgcctactggtctgtagagggtctgccctggggagggtcagttggtcatctgtttaaacaaagtcctccaagatggctgagaaagcctgcgggaagtgagtgtgggcaagccttccttcttgacaaagatgcccagggagatggtagggagagtcaaatgtgagtctccagctccactgtttgaattcccatcgtttctgcctctaaggaagtcaaaatcagtaggcattatatgtagtggcacttactttgataggaatgagggtggattaccagagccagggtagatagactggacaagtaactggattggtccttagcatctaagctgaagaggccaaccaatggaatcaaagtcaccaaagactggtggtacttttcaggaaaagtcatatgaacaggggcatgaatcattccattttgtattcatctgagctctgccctggtcattcatctctgagatgtatcatttaattggaaggaacacaaatctgaaatgtcctagacatcacatgctgtcttaggagttagaagagacattagaaaatcaacccccttaattttgcacgtgactaaactgaggccaagagacatcatggtttatccaaggtcatacagcttgcaactggcacagatggttttttctttctttctttcttttcttttcttttcttttcttttctttctttctttctttctttctttctttctttctttctttctttctttctctctctctctttctttctttcttaatttgccattcttgatgattgcctctctgtcactcttgctgcctacctaactctggatcaggcatttgcatgtttcatcctggcacctccaaggtgctgcggaacactttaacagacagacaaacaaattcaccatcaagtggtttcacctcttgccaagacaattattcgtgacagcaggccagctgatggagccataaactctaaagggttgggaggtgggggaggggtgttgaggaggcacccgcagggttaaacagcggccagccattcagcgagtactgtgagtacacaccacccaatccctagggttgctaggaaaaaaaaaaatcctcctaatgctggctgcttggcaaagtggtgacagaggctgccaaatgggcaagaagaggtcccactttggatgtcacttgatttgtagagctggtgcagagaggcagaagagttgagtgttggcaagaaagaaagggaataaaattaaattcactgatttatatgtgagttttcttctaagtgtgctactcaaaacttacaagatgctcctaggctgtaattaaaataaataaattatatatatatattatatataaatatatattttctatatattgctttttgcattattatcctgcaaatcatttcatctatatggtatctttaagcctttcccacctctaatgtggcaagtttgcatcttttctacagttttaaaccccttggcagaaccgtatacattaacagattgaaatgagctttattgaaatttagctattctaagtcatctaagttgcagaatcccaatttattatgtatttaaagcataccagcactgattaaatcaatgcaaattaggttaaataagaacaacatgaatcgagtgtttcagcaaagttgaatcgagaaacgacaacttttgagtcaccacagcaagtcgatatggctgtttttcatgagttttaatttcatgcctgtaagtgtccaatgaactaaaaaaggaaaaaaagaaaaaaaaagctcacctgaagttttttttctttcctcctgcttattctctcatatgtctgtacctgtcttttgaaaatatctgattcaccaggttacaatgtagctattgcatgtactggatcaatctcttcttcccgggtgaccatagatttctgttggcaaacttcttcttcaaatgttgtatattggataagagatgctttatatgctttgaaaatacccttgacattttccatgtttgtcaggggaaggaacctgagctcatctagctgaaccgctatagctgcaagtctagtactaatagttgggcatcaagaataccatcccaagccatcatgccaacatgtgattgggcactgaggccagacctccagtttggggtaagaaatgataagaatcttgaaaatatggattcagcaaatgggaaggaagtctgggttatatgagttatgaatctgatggccaaacataatctggaactaaggggaggtagaagagagaagctcatggagcaaattcgttgtagttagagaggccagaagtatagcttgacggagggaagagtcgattaattccttctctcttcaaccttgtaaattagcctttgcctaatgagccctcctgtttttcgtggtactctatgttgtgaagtggagtgggggagtaacatacaattttttttttggtatgtcattacttctgttttatctcaacacttccaatttgttcattttagtcaaaataatttgtgaacacagaggtgcaagtgcagaaagtctgaaatgaatctgcattctggggattggctttccattagcaatctttgtcaatgttcaaggaaggaaatttgagtgattattttaatgttctgtcatcgctagcaccagcctggaccttgatctttatgctgttgtctttaattttcagtggcagcgaaccatggcttttctttaaaaggaaacctttagaagaattggcggagagtgggagtcacaatttcaaaaagagagaattaactttgttgtttctgtgggcacataccatacagctggcattttacagaatgctcaaaaggtgcatggagaggctgagggtgggggccccaaggctgctctcaggagatccacttaggagaaacaaattagaaattgaggtcattctacttatcaaactttgtccaactcttaaagcaacgtggtaacatggatagcaataagaaactaactgccatgctctatgaatgatgtaaatgatgagaataaataataaaagaaataataaatgaattaataataataaatagaaatgcaagttctcctgggcatggtgactcatgcctgtaatcccagcactttgggaggctgaggtgggcagatcatctgaggtcaggagtttgaggccagcctggccaacatggtgaaacctgtgaaaccccctctctactaaaactacaaaaattagccaggcgtggtggtgggtgcctgtaatcccagctactcaggaggctgaggcaggagaatcacttgaacctgggaggtggaggttgcagtgagccgagatcacgccactgcattccagcctggacaacagagtgagactctgtctcagaaaaaggaaaaaagaaaaaaaagagagagagagagagaaagaaaagaaagaaatgccagttcatgaggcctgtcctccctctccacaggttttctctatactggtgtagagaacatactggtgctctgattatgccatgttatgcttacctatgtttttatattctctccatctttgcttaccttcattttaactatccttcaaggttgatggcaaatctcctctatgatttcttaactgactccgaggcccctgccctctataaagcaatccctttttcttcttctgaactccattagcagcttacttttatcaatcttgtggtcctgttcactttatatgagtgtggcaataatttctaatgatagtattttaaaactgaaagggacattaaacatcttggagataaagaataaaaagaccttgttgggatttctgctttgccactttttaatcggtataaccctatacaagtcacttcttggtcagtgaaatagggctaaggatggctatctcagaggatacttggggtaattaaatgaaatcatgtaaactctatagagtttgttcatttaatttttgtcacttctgtgtttctctatttacatttttttttgtttttgagacggagtctcgcacggtcacccaggctggagtgcagtggcatgatctcgggtcactgcaacctccttctcccgggttcaagtgattatcctgcctcagcctcccaagtagctgggattacaggcgcccgccaccacacccagctaccacatctcaaaaaaaaaaaaatgtaaatagagaaacacagaagtcacaaagattaaatgaacaaactctaatagagtttggccactcaaaagtgtaggcctgagaccacaaaccttggagcttattagaaatgtagattctcaggcctctccccagacccatggaatcaaatctgcatttaaccattagccccaggtaattaaattttgagatgcattattggaacattcacaaattttaacctgaaataaaaacccagatatcattgattccctagttttgtaattgagaagctaaagggacagaaatgttaagtgattgcccacccttgctagtggaattgggtccaaaaaaataaaactttctgaataatgtgttttctctcctattagattttaaacacttagaatggaaagtctatgtgtaccacaggcctgagcacttagcagggctcttaaagtttgattttgtaattggtacagcaggcagtgtagagccttcataggtgctagctttaggtatctttcagctggtttattcccatattatcctaggagataatggtattctgacatctggcataagactttgattgcagtcttccaaggcaggcagagttgcatggtaattgatcccatggggcagcccaacatgttgccccttcacacatacaattttggaagagtcaagacagcagggacaagtgaggggaggtaagttggaggtgcattagggttgtctttctgggaaaagctttgatgttaacagagtttgcttacattactcctcagttttcttatcactgccaatctgctactatggcatgtgtgtatttctcatgaatactttattataaaaaatgtactttgggaggccgaggcgggtggatcacttgaggtcaggagttctagaccagcctgaccaacatgatgaaaccctgtctctactgaaaatacaaaaaattagctgggcctggtgacgggcgcctgtaatcccagctacttgggaagctgaggcaggagaatcacttgaacccgggaggcggatgttgcagtgatctgagatcgcgctactgcactccagcctgggtgacagtgcgagactccatctcaaaaaaaaaaaaaaaaaatgtaaatagagaaacacagaagtgacaaaaattaaatgaacatgaagtcacctaaaattcaatcaccagagatgaactattaagttttgggtatacattctttcagaatttgtctgctcttatttattaattaggttgtttctggtttttagtcattataaaatttactgtgattaatatccttatacctttgaatatatgggcgcccatgcctttaaatgtttattctagaagtggaattggtgttcaaaggatgaggattttaaaaaaactattaatacataatgccaaattgtcatcctgaaagatttcacacttttcatcctcaatagttgctttgctgctttctctttgccttgagaaacccccatgataccataaattaaaacatgttttggggcccctctccttcatctggctggggccccgacctgtatttctgtctgcctttgtttattatgccttggaatcattcttcctcttcacacccatttcctcattccatcctatgaaggcaattcccacttcagaaagagggctggcttggggccttcaagattccttctgggagtttacgtggacttaattcctgcatcttattaagtagctggccagccaaattattttcacaaagccattaatatctgaaaatggattaatccagcattacttaaaatgctctacgagggtaaaagtatttaaatgcatttgtgaaatgcacaaggctttgttctgttgttcctgtttcactctcataagaaatctcagtctcacaatctcagttgtaagaaatcttgtttttcatggtttcagccatttatttgggatttctattaacactaaaccagaacagttttgaaaacttatttaattgcagtttatattgcatttgactttaaactggctatcactttaccaagacattccaaggttcagatttcaagcattatagaagaatgctggtgcaggaacctgttttatgtcataattttatcaattatgggggatacctagacaactacagttcttctacttgctattagcaaatttcaccttctcatcctagccataaataaaggaactgttagaaatgcttgttcctcattgccacaaagaaatagcattcgaacataaatttgattctctcagcaaggcagtttttactttcttcagaaagggtgctcatcgcagatggaacaatggccagagcacacctggacagaggaggggcaggagttcttactccttacgcaggtagcccctactgctgtgtggttcccctattggctagggttggaccgcacagtctaagctaattctgatgggctatttaaagagggcgggggtatgagccagagtagcggggtgagtagttggtggggacaacggttagaaacaggtaactaaaagtgacttaggtcagagcaggtgaccaagggtgactcaggtcaaagcaggtgaccagaatgagtcaggacagagcagatgaccaggggaacagatgtgaactactgattaggactagtgggaaagttgtttactgaaactagaagcaagtgggcaaagagaaccaggaagttaaactttaaaatggagaatcaaagaataagagagctgaacctactgacgtactgattttgtgaagagaaacttggggttcaatatatttaacagaaccaatttaattctatagtaagttctgtctgctctgtctctgatattccttgacacttaattatcttgttttatagaattttacagatgttggaaattttgtcctcacagataaaatgaaactctctaagaacagacatattactttctctgtgttttagaccttctaatatctacctttaaagggagaagaagatcagatgtgagagaccagatatagagacatgagaattgccacatagcactagtaaatatgttttctcttctcttagtgcagtctgcgtagttctgggtttgtaaacactctcattgaattgagtttattaactagtttgaatgcttgcctaatcaatagcctgtggaatctaaattaaatataaaaacctctatattacattgacatatagacacaagccattagcccagcaaagccaaaactcttgagttgaagtcacacagattaatgcctttatgtgtggcctcctgttgcagatctattagttgtaggaaatccctcaccatccataagcaacaggtcttcagtggtaaactaacctgcctagttagatgcatttatctcttcattcaagctgtctcactcctcaatctctgacaagaatcttgaaaatgcctttctaattatttaacatacgtgtttgctgctattcttgtttttgttcatttgttgtaagtcagatggaattttacccgatgagaagcagagttagataaaatgtggtgcctaccctgtgtgttcacagttctggagtggagatgatgagtaacaaaccaatattattcatgctatggcagagatgtaaacaagagctgtggttgaagagatttttctagctaattgagcaagaccaggtagaggaaggaagacgaattgaccagatggatggatggagaaggccactccagtcagtaggcaaagtctgtgaaaaaaatatgaagacttctgagatgcataccatgtctggagcacaggtatgcaggagaagggggtaagaaaggagtgtgaatttagtgccagattggaaagactttcaactagaaatatgatttccaaaatgtgagtacaaggaatataattctgatgactcccttgaacatgaatggaggagaaaggatactgaaagcaatgagagcagttggcagactaccatatcttcccaaatgagatactatgtgggctatgttcacattacaaatgggcagggcagcaggtgcaataatagctctgcagtggattgacaaacttttaagtggtactctttccaagaaaggtgatttcaatagatggattgctctaggggagaagggaggcaaggaagagtaggatgtaaaagccagctaagctcacacttggagccaggagtgagcagttgaagatctgaacagacattagagctgcacatatagatcagggagtccctggaatgtgcttggtggctatagtggtggcagtagatgcaaattccagaaagaaagattagaataccagctgatgcacaatcaaaagttttcacagtccagtaaggtaatatctggggtagcagttagatgaggaataacaggaccttgtgttacctacaaagtgcagattttgattaaaagcattcaaattctaatttattacaactgaattttgttagtgagcaaatgatattgtgaactgtattcagcttaaggaataccagtttgcagagcctctaagtgatgattctcaacaagaaagaataggatggggcggaagaagtagagatcgcctcaataggaaggacagtttagtaaaattaggaaacactcccctagtccatagcaagcagcctttaacatatagggatggccatgggactgtcattattatgaacttcatgtggctgtggaagagataaaatatggttgatcctgatagatttggagaggacattggatggtcaagatcaccaacaatgggggaggatgcctgaccatgagtgaagctgcaaaggaaacgtgtaaggatgatgctgtctgcctcatggttctatgtcaatgtctagctggtgttgagtgtatcatttctgaagagggtttgccattggcatatcacatcaatgtaagattattcctttgcggatagaccttatattccttcctcaaacatggaacaaggtgatggctggaggtcatgtccttcagaggcaaatctatatttgcattttagcagaagaatttgagacatctaataacattgtgaaaagcattttcaaatttctgacttcgtattagcctgaaaactgttctgccatttagaagctgtgtgatctgggcaagtgacttaacccctgagcagaaacattcaacatagtaaaacaaaggaaaaatgagttgaattataaaaacagaaaatagttaaaatgctattgcaataactacctatatcaatttctactatgccagggcaaaaatcacaccctatagattgaagaaaaggagggaaaataatcataagcacaaattgcattgtgcccagtatctcagacttttgactgctccctctttagatatctgttcctactttagaggctgcataaaaagcaaaatcaaaatgaaaaaggcagcaacaaacactccaaaacatggtggttaaaacaacaatcactttatttagtttctggcaatatgtgttggctgagtataacttctgtggggaccaggttgactgaaagctgtggtgctcgctcaagtgtccatgatcaactggaaaattagcagaagactggacaatccaggatggcttcactcacagggatggcaattggcagcctgttggctgggactcaactaactttaggttagggtacctgagttctctcccgcatgtcgtctcatcctccagtaggctagctctggtgcaatcaggtggtgattgtagggttccaagagcagcaaaggagaagtcccagtgcgcaaacacttttcaagtctcaccatttggcaaattgctgttgtctgttaactaaagccaatcacatggtcagtctgaatcaaggagtggagaaataggctccacctcttgatgggacgggaagaatttatagttgtttttgcagtttaagtacagcagcagtggtggcttaatattattacaactctaagtatgaaatgctttaaagtgatttttatttctcaagccatgtgactctaacagtatcatccataaacactgaggaccagcagtgcaggtatcacctatggcttgttagaaatgcagaatctcaggccccacccaagacccactgtaacaaatcggaatctacatttttccaagatctccaagtgattcataagcccgctaaggttttagaagcactgtatctttttgctgtttctcctaagtccctttcttagaattgctatcttctcttgttgagtgatagatctttgatttttaaaggtgccagaactgtttccttctgcacaactgaaacagaacaaacacaggtttatacagtaaaacaggttgcttcacagcgtgaatagctagagagagaggatataacatttttatgctcaattgtcctgtgccttttttttaatggaaattgaaaaattaagataacagtacataaatatttaaaaatactgtatttaaccaggcagcaccattcagatattagagcaatttttaaagaagtagaaacagctaggcatgtacttaaactgaccttttccatttctgaaccattacttaactggaccttgattttctgaaggttcaaagattgattctccaacctttagtctgcagtttaaatatctctagaacatgtgcaagtctcgggatactctttaagattttatacaattaataagaccaacacaatttaagcatctggcatgtgccggctgctggtctcccctagtttgtttttaccttaagtctgaacagagagagagaggaaaaagcaattttgcattaaaaccgaatgctgttgttttgtgtgatgtttgcttgccatattctcttctcaaaatgggacaacttctttgaagctataactgatgttcttttaactatatatgctttgaggtcctgttcttgtcaatcagttagccagccaatcaatagttaacaaatatctattgagtacttcacatatgcaggcatattctaggtctggggatacagtggggaacaaaactgagcaacttggtaagcaaatagattaataagataattttaggtactgataaagggaaaattaaagaagaccatctggaagagagaaattgagggactggacctgctttatctacgggtaggcaaggcttccttgaggtggtggtatttgagttgacacctgaatgatgagcaaggggaagccatttaaagtgccatgagatatgcataccaagcagagagaacagaaggtgccaaggcccagacactaaaccagacctggtccaagagactgtaaaatggctagtgtgctcaagtgagtgagacggggatgaagagatgggaaggaggattttgaacacaggatatgctttcttaaagaatccatgcacatttttataaatgttgacaaacattcaccagcatcctcataacctccactagaccttataaagtgattgattgctctgtctcaggcactaaattaaagcactttaatatattaattccatttattcatcaaaattctgtgagatccttccactttcagaatatacaaaggaaatcaaggcacagtaaacttaagctacgtgccttaacacagctggtattgatgatataaagtgatttttctgcattccctacacccttttatggaacaattaagagggctggataccaatcaactttttaactctgtaaaagccaaacttgacccttttaaaatcttcctttccccaggtttagacccaacaagaggcaggatggggcaattcaaactttcctcctggattcccactcctctcggcccccttctaccatctgttgctgtttgcgtagaaaaagaacagaacagaataccgacaaccacacacattcagaaatctcgttttgtatgtgggagtctggcttcattaacaagtttctcaaactctccctgcactacaacaccaatctaaacataactcattgaagtcatgggaataggcaatcatcagcttcatgatgctcagatgtcagtgtccagatacatcacctgctacttccttgtaacctgcttcaagcaggttgtttttctcaagaacctctaaataaatgatgcctatttccatattctctagcctctgcattgtcactctgattctaactcctattaaatttccaccttctttctaaggggtcccattctcactccagactacccctcaccccatctacccctacaaatccgtatgtccacgtattcacccatccattcctcaatcatgtagtgggtacttactctgttttcttaactgtgctaagtgctaagctatataaaatattttagataatagtcttttctttgaagagttcactcactagtaggagaatcatactcccagaagtccatattaatcccctccttctttgagatgttacttatctaaaattaagagagcattttaagtaaatttaaatttactgtattaaattgctctgtgtttgtttctgtgtgcccctcctcccctgttttcctttatgccttctagtttgaaatttctcaagagcaaagtccaggttgtattcctggtgtagtgaagatagagttgggatagttatgtttaggtttgggttttgccacttactagtaatttagggggtaaattccttctctatataaagagtgggagttgggtttgagaatttctaagatcccgttgagctttgacattcatgggtttcatggattcgtgaattctaaaatacctaacaaggtctggaaagtgaaggaaacatgcaatacaaaacttgtttcaaaggcgtttatttttaacttatttatgtggtgggtggttttctaactgaaatgtaacattgtccctggcttatagactgagacagagtaaatttaaaaacaaactattgaaaaatcagattggaccttttttgtgaagctgggcctttcaacagagtgttaggttaggattctttccaagcccgtagagcaatgcagacaagagatagtcccttggtaagccaattctctatttcagccttcttagggtgctaccccttacactagacagtcaacattggcagtatcagaatgatcctagaagaggttttagtgtatgttggaataatccataactgataattttaaaaagataatatgctagtggcttatctctgtgctttagaaggtattatcaaataaagattctcaccctttatcaaaccccatcacagatgggagcctggcctggttgcaactctattcaaatggtcttctgaattcctttgaccatatgcacaggttaactatgttcagacagtaataaccctatatgggtaagtactcattttagaaaaacataattttctaaaagaatttaaattcatcaactacttttaatataattggtatttgaaggatgtctaccaatttggaatataattacctagcaagggctgatggataccaaccagtttttttttgttgttgttgtttttatttcaaacaattaaatagttgttcaacaaaacgagactggcatattgccaaactggccacatctccagacccaaacaggatttgtttcattacataatatggcgaacagtatatttcttctgtagttgttgtgaacattgcaaaggctttagaaatctttctgagatccaagtataccactcaggatattattcaaccaacatggagaacaaagtactgtttactttgatggtttttctctttcagaatctctaagggctgaaaatgaaaagcaatactttgtgactttggtgatgtggatgtagtgagactgtatctgggtctccagttccacaattctgcttttcactctgattctgttcccacctagcaccccatcccaggtgtaataagaattcttgagtcataaagtaaactagatggcatttaccacccacctaaatgaagtggtgtcaggagggttaaaataagacatattcaaaagtcctccagaaatatttgatgttctgtataaagacggtaaccattcacagactgagcctttctgtaaaagtgagagtgtctcttcctgcagcctgctggtaggaaatgaggcaaggttttttatccaactattttgggagcagataagagaggaatggaatgttataaagtaataataagaatgtcagagaataatcttgttctgattctgacatttggcgattgccttcattctggacattatttttcatccaggtaatatttttaaacaactcaacaataaatgtaaagttactgttagaacctaaatttcttcatctaaaaaacaggattaatagtcttgcctcatagcacaacttttaagaaaataaacataaagtgatacatacacagttggtttcacaggtacattctgcagctatgagataattttattgtttttgtcacttttgtaaggaccacttctaaaatagtagatctgcttatagcattgccatttctccttctatttggccaaataagcacattttcccaaagtggggatctatattagaaaaagccttaatgtttaacccacctctgcttttctcttctgacttcagcagctcttgtacctatctctaggattgagccttcaccttctccgaattgtgatacagtcagctgctcgcctcatagagtaattgggtgaggaacagaccatttgaattcaccccccgatgattgccatgtggagaaacccttactttcatttcttgttaaatatcaagtgtgggatgaagagaggcaaccttaaaaatttacttgattagacttagacttaattattaatattagactgagtgattaatatcttgccactttagcattatcatttttaaagtaaatcacagatctcatacataatattttacgcttaaatattttatgtatatattttaaaaagctgtttttacataaccacaatgctgtcattgcagcctagcaaattaatgacattatttaatgttatctgtatatatagtccatatttagatgtgtccaattatttctcaatttttttaaagttgaatgagttttaatgtgtaaccaaaatatgtctccacatttcattagggtggtgatgtctttaagtggggacagagaagaagaataactctattcagttaagcaaatcagtccaccatagtgtgccaatattaatgtttattcacataatcaaatatttactaaagtttttaaaatatgctagatggcacagatatttggatataacttttttgacatgataggttctctgacatgcccacctgtaaaaatgactgaaagaaatgatataagaaaagttaattatggatataacatggaagaacttgataaaccctcaagtaaatatttagtgtatagattataatagaaaggcctcctggaaaaaaaaaggaaattggagaggctttggaggtttcattgggagggtttagagattttctatcgtagggagatggcactaggaaaagggtattaagatccaggcttgactggtggtgaggatgttctggacgaagtctaactggtaggaacagaaacactcccagtacagtgtatattgaacggagtacagatgctgggggaagtacgcattgagatgaagtgaaagaagtaggttagagctagtgatttgtcttgaatctgttatttctttattgaacagcatattttaaaataatttgtggtgtatgaattcataaaatgtatgcaaatgaactacaaccaggaaaattgtggaataaatcttttttttaaaagcctaccatggtgggcttaaacaatctgtcttttctgatatatcaaaaaagtctgtatatgctacaaccagttagttgtggcaaggtttcgtttttgtgaatgcatgcacgcatgtacttgtgggctctgatgaatgagaaatgctaaatcaccagtaatgggaaatgttaatgtaaattgagtttttactgtgactatgtttaatcaataccttatttctgctaacatgttttgcgaggctggctctggcatggtaggtaatctatactctaggaaaagctatagcccttctgaagattctctgtattttatttatttatttatttatttattttaaaaaggtgtattaggtttcagggtagagtggttattcctcctgctgaggaagcaacaacagaacaaaacatcattttaaatgtgggtgtattttttaagatgaggtttgagacattcctggtatgtgtagaatttcatagaactactttatcaaaacatttagctcactttttttctttctagagagcaaattaattaccatctgataagcatgcttaactttcttctttctagtctactaccaggcttttattagttggagccactaaagcaaactcaatatacgtcactgtcaataaaatgcccagtgattaaaactaggtaatacagtgtcttccctaagcccctcattttatgtagcgtgaaaacagacccatgaatgggtgtagatgtgctgaactggagagaaattgtgccttcctcagctcactctgcacggagccacttccctgaaagccagtgaacctatttaccattgtcatagtaacacacaattcgggcccacgtagacttaatcccgagaggcaattgttcccttgcttgggcggctacgctccccgcggggctgcctgcagcccccgggcccttgcagctccgggacggcgcgcggcggcggaggccgcggggccccaagcgccagcctggccccggcgcagatgcgctgccccggccgcagcccagccgccgcgtgtgttgtcaggacgatcggaaacgcgtgtgtggggagatgggtgccagtgtcgccttgtccattatccaaaacccagtcgcttttgctggttcctcactcagcatgtgagagagattgtcttctcactcggtgccactcgggggccatactccaaaatcaaccaggggctgcctcggcatccaagacgtttcgggccaggcgaggctgtttccctaacctgtgccatgggcaaaagagaacgccgccttcccatgcagttccctttgtagcccaccccttgccattccaggcatcactgaagggtatgtaatttgggaacaggcaaaagggagaacgggtattaaccggagaggaactctagttcttgaagatgagccatattcttgaagagaagtgcgtgccctgtcgtggtcccccaggtgccctgtctctgaggagtgaccagggtcagtgctggcaccggctctgtcactgcacactggtcgcacctttcttctcttctgcttttcgtgtagctcagtggggttcccaaatcacagcacatagcagccgctggcgagagcttttggttttgacttgttagacacgggttagaactccaagcttctgatgtaatagggctccgaacaggcctgggaatctgcgttttgaggcggtctccctaggtggttctgatatgcatccagatgtgagaatcatcgccaagatctcctttctttcttccccttcatttctagcttttcctcttctctctttcctccttgcttgcctgctgtctcacaaatacaactcctcttttattttcccatgtattttcctccctcccccaacgttttaagcatctgttgtgtgtcaggcactgtcctagatgcttggaaggttatgatctctgcctctatgcagcatctgtggtttcttattgaccttctctcttgccagctcctcttctctttctctctgtactttcatcctctcattttcttaatcacgttctttgtgtttcttcttttctttctttttctcctcctcctcctcctccttctttttctattagtgaatccatatgtatttttagcaccatgaatatcaggatttaaaagtttctagcatctgcctgggtttcaagccacaaattcctcccatcatagcttacaggactcctagaccactaggggtgggtggagcaggatattccaccctaactctttacaaggaatttgccttttctagagttcagtatgaaaaaacaagtcaggttactctcagctaacattagtggtatttcagttttcataatgtttaatgacctctttaagcttcccttaaagctgcaattaaagattgcccttcagtcaaaagaaaagcatgtaaaaatggggcttgcatcaagagagaaaaaaacaaataacctctctgaattaatcctccccctaccccccattattcaggctgctgttttacacaaagacactcttttgagcatgaaaaatatgaattgttacaaatttacctgttctaaagtttcaattaaagctaagtgacacatgaatatgaagactgtcagaacctctccaaagttaggtgatttgctttgctttgaagggggtcgacaaaggggctctcttggatcctcgtgggccgctgctcgcagtgtgaggcactttcacgactctcagagtcaagtcataggcgaagtcaggacattctgcttccatgctgagctcatttcttcagctttcctgtggatttgaggtcgagggctgcaatcatcatgacctctgatcgtctcggggttaagcccctacttaaactattaactaacttaaagatttcatgtacaacacaatcagccagcagctatttattaaaaagcctttcatgtaaaaaggtttggaggacctaggaattgtgagaaatgtttaaaaggtgagatgttaattcttggatgtgggggagactgatttacatgaaaagagaactaaattcttagcttcaagtgatttcccagaatgcttggaataaaatactccttttttggcgtgaccttgagactccaaatcatctggaccttgaccacctccctcccctcatcttgctgttactatgtctcttattggttttattccagacacactctttcctttgatctcccccatgcgggatctgttttatgaatgcccttcctcccatctttgcatagccatctccttttcgtcactcaagtttcaatttagaatcactgcctcagagaactcttccctgaccactccatctaaagaaggcatcagatcattatcatagcacctgctttcatgttctgccatggcacatattactactggatattatgttcctatgtatgtatatttctctctcttccccactaaaatataagcttcatgagaacaggggtttcaatgcttctgtcccacctagaagaatgcaaggcattaaaaatatgttcattaaatatatgtcaaatgaataaatgaatgaaagactatgtcacttgccaagtgaggtttttcagacattgaacactagtgtttctagaagagggaagaatcactctaggctgaaggggagaagaattgattagagaggaggagatacctgacttggatactgtagatttgcaggatttatagctatggaaagaaggatgatgagtttctttcaggtaaggaagtatttggcaattaaatgatctaatccattttggcaccaaaccagacattcaagtataggtgaatcctttaaccttagtctccacttttggtcttggaggcaaaactacttgccattctaaagtagaggtaaatctacttgccattctaaatctgtggttcttaaagctgttttttgttttgtatttttcctgatcagagaactttgttatgtcactcaccataacaaaagcagcatcagagaaatcttgtttaaataactgcctctttctctacaatatgagaagggggaaaacattttttcccttcactggcaaagaagatggttatggctgattaatcaggccattagatacagttttgctgcattcagtagaagccatgatgagaatttagcttgaatattcatgttataagtgctacatgagtttggaatgcttatagatttgcaaaatttgagagctaaaaaggaccttagagatcactgagattctgcagcccatcctccctagcatttatcattttacagcttaaaatgccaggacccagagtagtaaagtgattggtttatggttacattggtagctggtgggcaaacagattatcaaccccacccttgtgattctccgtccagcggtctttttattgaaccttagtgagcttcatgcatttggtcatgttacataagcagaaagaaaatctggaagcaatgactaggcatactcatagaagaaaccccatcatcattttcaaagtcgcagtggtgaaagtgagaaatacatattgagggaacttgctggcatttgaaagggaataaagcagtatttgtaagcccttctaagagtaggtagagtacaaattagggaaagtggatgctattgttttactacctctatatattttctacattatccaaaaactgccatgctgaaataataacacactgctataattttgtatcatttaactggcagtacacagtacatggagatttattatttttactaatgagtttagctttgctgttgcaaatagtgtcaaatgtcattcttttcatcctccagcagatggcaactctagtcttcttgtcattttatctatttctatacttagaagatgttgtcctctgccatccctgccccccttgcctctccctgagaagttcatctttatgtactgctcagggtgatatgggtaagtggatccatccctctgccaatggaatcaactccattagcatctgactgtgaaggccaatctaagtgtgcctagaaataacaaaatcacaaattagccaatagttctaatttttttttaaaaaaagagagggggagaagatagagattctaaaataagatgtaccacagaaaactttccatttaaggaaaaaaatcttcaaaagaaacaaaatgtcagtttctccagctctagctttaaaggaagatgggtttgattagattatctgagttactggctaaaaaaaaagagcagtgtcagatttctcatacactgtgatttttggtctctctgctgtctcttctcttccatccctccttcccttttacacactttttctcagttgtcaaaagtactgtgcctagccccctaatttatttgctttttagaaacctggtttctctctctaggtgtgttcctaaggcactaccgctgatgacatttattttctctcctcccagtctttgctcccaccactcccaccccttctcctaccagctagatcctcataactcctacaggattgcagaagttcaaacacatgctgttctctgagtgtaactctgagggcagctgtaagaaatcaacagaaaagaatagctgctactcttttattaaaggaaaagttaatgatcacaggcatgagcaagtggattctgtcaccaattcctcattgtaaggcttcctacagatttgcaaacagatctcctgcctagaggcacttgcttgcatcaggaaggcctgagcagggacatgggacggacacaggatgggaatggatttggtggtctgcaaatgctacgtggagggaactcttgctaactcatcctgttccaaagaacctaaccatcatgtcttcttcaaagttgaagagctgttaccttgatataccaacaactagacagaggctaaagtgtggagcaaggaaacagtaacagtaacatacctcttatttaagacaaaaaaaaaagcaaagttggctttagtgagtatgagtttcttgattattactgtcatcatgtgaaaatgtgagctgacgctgcaaatacaatccttggaaacaacgaggacgtgtggaaatctaagtatgttatcattcactgacaaccactaatgaagacaggggagcttacttcaaacccacaaataattagcactgacaatagaagtataaacagagctttatttaattaattccctaattgttctttcctgctttactatctgcacccctgctttgactttagatataacatatgcccaagacttccttctttcaactttgtgataatcatgtatccgtttgctcagtgtgggaaaccatctgagctagaattcctttccctgctttatatgtataaatgtttttttattttttatgttactttctctgttttcccacaattcggatgcctggaaatgttgacttattaacatggatggcttatctagcactctgttagatgtatttcacagttaatatgaaatgagaagtgaacagttgatgattctggagtgatgaggagagctctctggattctccattctgttctttacagcaacaaactctttgtccctgtctcctcgctcacccacattctaatcccagcaatcagagagcagatggactgcttttttgggttttgtcattatctgtctttgtcagggaagcatgatcagttcctcattaaagggccgataacaactccttctttgctctgtcctgaatgaggaagctgcattggaacctttcatgtggtgacttcaagttgtgtgaggtaaaaaggcatgtttgtgtgtggcaggaaagtgactctccataggggaatggctaggctgaggggccagactgagggacctactgagaggaaggacagtgtagaggggaatagatttggagcagtcatctggagcagcaggtagtccagagagtcagccctagtggctggagtgggtcagccctgatcctcttacagagactgtagactctttctcaagtggctttgctggttatgggcagcctcagctcacaaaagttgattacagccagaagttaaatcagaggctgcttaggaatcttgcctgtgaaaagggctaaatggtgtgtgaatgtatttgtgcatgttgtgtatgtttgatgacagtcatgcttccattattgacaggatatgttctgagaaatgcgttttcattgttggtcgaacatcgtagaatgtacttatacaaacctagatggtatgtatttttttatttatatacatttttcatatggaaaactaaatgtcccagcaccattacggaatataagtcattttcgctacttgatctgcaatgccaatatgaaggaccatgtatcaggtttctatatatgttccattacagtcttatgggattatggtcatatatgcagtccaccattggccaaaatgccattatggagtgtcattatgactgtataagtttatatgtaagtttgtacagtgcagttggtattccttttgattactttttgtataatatttactaaaaatatttgcagaaagttcccgagaatcacacaaactctgtttgcccctgtccatgtgatgtgaagcaggtatcagctgacttcctttcaacctttatttgattggtatttgctggatcatttgggtgaataaccagcctggtgttcatggaaaaatatgcaacaaggagttcctgcttggagaagtaatgttttgtttgaggaaacaagatgtctgttataaacacttagagaaaattctcatattatgtagaagtaaatgaaacagtgtggtaaagactgagaggagatggagaatgatcccattgcaccaggttgctctcattttctctctcttaatgaatggaaaggttgtatagattatttcagacttaaagaatgtgtagttttggtcaaagagcagacacatgggaataaggaagtcatcctgtggtcacagaggatgtagggaacaggttggccagactgaaacggaagggctgtgttaggatgcggtgggaagtaaggagaatacctaccttaacaagtcaggacagggtgtgcctccagatacatttgcacttccctcctgagagcttttctttgtcctgaatgaggaagcaacattggaacctttgatgtggtgacttcaagttgtgtgaggtaaaagggcatgtttgtgtgcggcaggaaagtgactgtccataggggaatggctcagtatgtatgttccctagccacaagcttcggttttgtattcgactgtacctgcctagatatagatccactctggaaacccagggaaacttttcaatcttcttgttaaagctgaggattgattagcaagcatgacctcccacctgttataactggcttatggctcttccgaagtacccactggcattttcaaggtgccctgcaccccttcctgccatgtccttctatggaacacttccttcaactccttgagtctggtcccttcctaccagaaccaaataattgtcaaacttcttcatttgtttggattttccactctaagctcttcttctggcctttccaccagtggtcttacactagcagttaatttgctcggaattcattgtggagctatcttgtgccaagcaaggtgccaaaggttttacatatgttcactttcttagtcttcctaataatcctttaaagtggatctacttaacagtacctgctgagcgtcaattacatgacaaagcatttggggataaaacaggaaaaaataaaggcagaggccatgcccacagataacttgtacttagctaagagactacttctagtgggagagattaagccctgaggaggttataagatttgtcctggatctgaaatttgaatctaggtctttctgaccccaaagtcattaatttcccaactgcatctacttttttctttttttttttttgcaattgaaattaatttaaaataaattattcttagccattgttcatttgaaggcaagctgacaatcaggccgtttaagccagagtgagtcttatgtgacaaattatcacataaagtaatgaagtcttttctggactctatgctctgctgtgggtggagtgttaagcccttcagaagctgccttccagggtctccacaggtccaggggtccattgccaccaagagtcttgttgttcattattgcgtttactactatagcaacggctccaccagtgtctttattaaaacttgctccaggctagaattttcccccggggtcagtaatgagtttagaggaatggatgtggaaatgagatttgttctcaccagtggagtgaattatgtcttgttggggcccccaggctaatatttcagatttgccacaaggtacttcatcaaaaattctattttggttccaaaaggaccatgcatgcctattagcaaattcagagcatgcctttaaactgtatgttttttttttttttttttccttccccggctgcatccactaaaggctttcagaattagcagtttgtgagaacagtccatttccacgggccagtgaatggtgcaaagaagaagtgcagcccttttatctaacaaggctgagtctgccataactgaggtgaatcaaaggcagagcagccacgactgtgtcagcacattaggtattcgttatcacatcgggcatgcggtaccacgccagacatactcatgtggcaggatttgtgtttgctgtctctcaaattctcttgcctccgtttgattgccagggctcattttaatgccatccaagcgtatgggtttaaatactctccaattcagcctggtgtgtttgacatctagttcaacattccaaagaaactgattgcagagataagtcgattgggaaatagggttgcacatcaaagcactacctttccagtaacagagatgctcagaaggcctagcttattggagaggaccataattgctggttgtctttacaagtgttctctgtggtgggaaatggggagaaagcatctcttgcatgatgcccactatgctcacatcctctctccctcccttcactacttctgctatctcccagataaagggttatattcccgagcaatgatgaccaactacttttcgctagcaaaaaccaaaagggcagggtgatctccacccgatgacagataaaagatggattggcttgagaaaagagtgagggtccccactttttcttcccaatccccattacattcatagccttaagaactgctcccctccagaatcttggctatgattgtcataacttacaccttgtctcgatctgggaaaaaataataaaatgactccattgatgctactccaatccttctgcttgttgtgtcaaattttctttcattttgtaagctgtgcatttgggcagatgctatcctccactggaggtaccattcccgtgcaggagtaaggtttctgttggacaggagtcctcttggcagaacacatttaatggagtgccttttagtgagggtctccagccttggtctaattgctctataatgaaacaagcaggaatgacactgtccttctcacttacatgtcttagtttacttttggaaattattgtgtgcattgaacagtgtttctccttaaacaaacaaactcactcactgtttctatgaccagtgtagagttccagatactgttgaacaggcattactatattaagtcctgtgcacatcatcagcactgtaaattggccctcacctcccatgaagctggcagcctctggatctttgggttgtctgtttttactggctgttaattgttaatagattttcaggtgtaggtcatgctgtgtaggcatcaatccttaatttaggaaggtctgcggctgtccatgattgtgaaaaggcaagtgataaacaaaaactggagaaatctcagcatcctcactaaaaatgtcaagcccagtaatgcttctggtagcaaaagcaaaatttattagtgagagaacaaacttgcctaataaaaaaggagagttaaagagggaaagcagagaaggaaggaaggccccagaagaaggttgacgaaagagaaaacatttaagaaatcaaagccattttagaaagacgagttagagagcaggcatggtatgatcttagatatcttccttgttcttgagacaagaagaaaaggaaggcatttagcgtgagcttttaagtaattctgcttggaaaaatgtatgataagaggccttgctatcctccatctcaggggaatgaatatactggtccagggttcagtggccctaaagccaaattcagctgctgcctgtttttatagggcctgcaagataagaatgagtttatgtttttaaatggctggaaataaaccaaaagaagaataatattttgcgacatttgaaaattatataaaattcagattttagtatccatacacaaagtttcgttggaacacagccatacctatttgtttacatattttctatgactgtctattcattaaaatagaagagcagattccttgcaacagagactgcagagcctaaaatatttactattaatatcagccctttacaggaaaagttttcggatccctgtattggtctattgactcagagtaactaggaattagttactaaaggctgtcacctttccaccggtctgtctaaccctccttcatctagtcttcccttagcagaaggtaatccccttacctacttacccatttactcacctacttccaagagtttccaagggcttatctcatggtggatcctgcgttgggctttgtgggtgattgaagagatgaattcaatctggtgtctgctctagagtacttatagtttgtttagagagcatgtgaggaagagcaagataaatgatggagataaataagagatatgcatgatcaaaatacttggtagagtgacacattcgtataagaggatttcaggaaaactgacatgagattctgaatctccttcagattccttttacctgcataataccattggtcagtgagttgctcagaccagaaagccagccaccaccttttttttcttcttttttctgggggaggtggtgggggggatggagtcttgctgtgtcccacaggcagtagcgtgatcccggctccctgcaatctctgcctcctggattcaacaattctcctgcctcagactctgagtggctgggattgcaggtgcgcaccatcatgcccagctaatttttgtatttttactagagacgggtttcgccatgttggccagtctggtctcaaactcctggcctcaagtgatccgcctgtctcagcctcccaaagtgctgggattataggcgcgagccaccacacccggcctagccactgtctttgacacccagtcacctgctgcctctgcttgcactgcagtgctccctgcacagtgttgcacgtcaaaggcactctccagggttatgcttagcccatgtggccaactgtggcagccttgcctttccaactccctggacctttctgctgtcagaatgaattatgtcatttcttccttttgaagaatatcttttgaattgtcagtttagctccatttctgatgcttcctccctaatctaggccactgttatctctggcctggatctcagctaaagcaatggatctttctcgtccactcttgcatctgttctgtttaaaattcacatataatcatgctacttctctgtgtatgatgagtctcacttttcccatatttcttatgaaaatatcccaaatctgggcatatctcttgagaccttgaacaatcagcttttgagacctcagagcctcatttgcatgactctccccttaattcctttcttctggccatgtggccatcttacagtttctgtagggtgaatatgtaattcatttttcaaaaacaagacacttgtgagaatgaaaggaggcactattaataatgatgccatggcaacaggctataatcaggacagtcccaggcaaaccaagatataaagtcaccctacatttctcagacatcccacactctttctaacatagagtctttgaatgtgattatttttccttatttgtgattgctttgcccttctttacctatcagtttttctctgacttcagagggtgagtgaaatcctctcttgatacacaatcagagcaccttcactccttctaataattataattgaattgcaactgatgtaattgtttatgtgtccaactagcatgaccaatcctcttggtctgcccaggaccgagggagttgcagggacatgagattttaatgttaaaaccaggaatgtcccagatcagcacgtgagaatatcattccctcaaaggcaaggaccagatttgtcttgtttcccactgtaactgcagaacatagagtagttcccaataagttataggtgctcaaaagactttagttggttgaatgaattaagaaagaaaggagtacaatgacagagaggtgactttcagatgggttaatcagggatgctttgcatataaggttccatctcagcttaaaggatgagttacagtttcagtatgaggttaggaaaagaatattgtagacagggagaaaactttcattagagcccgtcctcttttcccactactaagtgccacctggaaaggatgtggagggtcttaacaatgtgatgtaaatggctgctacagttgaatgtgttacctactccaggagtagttgcatttttaataaaaaatagaacctccagtcaaatgatcatctcataatggcagacgttttgaactggggatggagaatatagtttgagggtaagaaagaggagtgaggaggaaggcctaccttcagactggccccaaatgccttatcctgtaggtagcttccactctgcctggggtcagaccacagggctgtggggtctgaaagtacagcgcagtgtacaatcacatcaaaatagtttgggtagagcaccatgggacagcagtctaattgttttttctcaaattttccagaccaattggtctgggagaggttattcctgcctactgtatttctggcatcagtacttggcaccagatgagaagtttgcactgggagagatgacacaatcagaaaggcacattagagctttccaattggtaaaatgttgaataacagaattttcagtgtttcctttagactatataaattccacaagtgagagttcccaattcctgtgaattgaaggcttctgaccatttgatccatatttgtttctgaaaataataggttattagacacaaaaatgcatttgagattcttattttgtagctggggaaaccaagacccagaaaagttaagagttgaccacattgtacagcttgttcatgccacactgggaccaggactcaactctcccaattccaaatgctgtgtctccccttctatacctgcattttattatgaaaactttttaatgtacagaaaaattgaagaaattgtatagtgcacacccatgtactcatgtcttagttcatttttgctgcaataacagactaccttagactggctgacttaaaagcaaaagaaatttatttctcatgattctgaaggctgggaagtccaagattagggctccagcatattcagtgtctggtgagggttcgttcctcatagatgtcaccttctcaccatattcttatagggtgaagggggcaaagcagctctttggggccccttttataaggatcctaattctactcgtgagggctctgaggcctcatctccaagtaccctcacactggggattgggttttaacatatgaatttagggggacgtaagcattcagattatagcaacccgccccctcaattttacaattacaattttgctatacttgctttatcagatatctgtccatcctatttttgaagcatttcaaaagaattgcagacattactacacttcaccttatgcagattattatccaaagtttgatatttgcttatctttttaggtaaaatttatacacaatgaatgagttttgacaaatgcttgcatctatgcatctcaaacccctatatagtactttgagttttccattttaaaaatttcaaaacatgctacattttacttaaacaatcatcttaaaattgtttgctgttgaagatgtacttgtttatatagaaaacattttcacaggaaacagatttgtgtaacattagactatagttttaaaagcaggttccgtaaggtgctctgttcaaatacttaagaagtgactctatgcaagttttaattcatgcaagatgaagtctcaaagtcaaggaaatgcactcatgtgggaaagaagtggagatattcaaaggggatacatgagggatacaaaaccttatagaaaattgagcattgttcccagcccattgctgacttgggcctcctcactcctccatctccacactctgcatctcaaaaaggcaaattacctggaaatgttcaactgggtggggtgtgggcataagaaaatgagacagagctgggcacggtggcttacccctgtaatcccagcactttgggaggccgaggtgggcagatcacgaggtcaggagatcgagaccatcctggttgacatggtgaaaccccgtctctactaaaaatacaaaacattagccgggtgtggtggcacacacctgtagtcccggctactctggaggctgaggcaggggaatcgcttgaacctgggaggctgaggttgcagtgagccaagatcgtgccactgcactctagcctgggcaacagagccagactctgtctcaaaaaaaaaccaaccaaacaaacaaaaaagtaaacgggataaaaaaaaaaagtcacaagctcttttgcttctgctgtaggaatgctctatttgactacactcccccccaccccaccctttttttcttttttgctcctatggaaactaatcagaaaagctagagcagttttgagaggcagatgcagaagaacgatactccacactcccttcacaagctccccttcccacacatgctgcagggtgtgtgagtgcacacacacaaatacacacacacacccctctcctgattgtaccaaggagccaaaaacaactgacttctcatggatgaaactgtgggtgactagtggttcagtactggcttcaggcatgatggattctccctggggaatgcgcacccaacaactgggagacacttcaagcaccttaactgccaatgttttatgtcaaaaggtagagacaagtcataggaggacttgctgcagccccttatagtaagcgaattgaccccaccatgggaagtgggctggtccagaggatagtagcaagcccaaggctgccaaaggcctgctccccaggtggcttcctagagcggaatgtatgggcagcagtaaaatcagaaagggaatgtagtttacttttcttttttttttttgagacagagtgtcactctgttgcccaggctggactgcagtagcacagtttcagctcactgcaacctctgcctcttgggttcaagagattctcctgcctcagcctcccgagtagctgggactacaggtatgtgccaccacgcccggctaatttttatatttgtggtagagacagggttttgccatgttggccaggctgatctcgaactcctgagcttaggtgatcttcccgccttggcttcccaaagtgctgggattactggcatgagcctctgcacctggcctttttttctttttctttttttttttttttcacttttaaagcagataatgggaggggagaaaggattaaaagagggaatattctggaagtctttctgtgggaactccagaaaaccattttggagaaaacagaacatttcagtaacagctgggccttcagccaaagcagatggtccaaaatgaggaatgggagagcagtacaaataatatcaagttgttggctatgggagcactgtgggaacatgctaacagttgggttaggtggaagtccttcaatgctgaccctgcatttaaaaagcatgcatttaggccttctcttttggcatctgagcatggccgactctggagagctgcctccaccactgactggtgaagaaggtgcatcccttttatttttgccaaagccagtccaaatgccctaataaaaacctctaagtgattaacatacagaagaaagtgaatggtgccaacttactgcagtcctggtagttttcctaatgatttgagagagctaggcttgtgattagaattccagtcaccaggcaggatagggggactctagagcttttggataggccaggagcaaaagacataaaaacaacaaaggaacaaatttaaaaatgaaacagcacattaagttgaacaggaatgcacattttctatccctgattacaatcagagctggctatttttagtgtatttctgatgagtctacttcactgtacttcgtaccagaatggcacaatgagtggtatttgctctctattggccagtagctgaaaagatgaatctccatggaagtgtgtatatagggagtgctgaggctgacatatggtagatttttttttaacatctacaaaaacaaaccactttcactaataatataacgtgtgtgtgtgtgcacatgtgtgtgtgtgtatcacacccatccattgagtttcaataatcaactctcttttgcaaggaataaaatatgttatagccagatagtcatcaccaaactatgatttatagtttgagttgcatctaggtggtttatggcactgacctagaaagggtattaatgaggtctatgccaaaactttcagcagatagaatatttgatttttattagagataggtttgggttgaggggccatttttataaactcaatgttaaaagaaaaaaatagaataccataacccaactctccaaatactttctatataaggtgaataccctgacaaatcttatcccagctatgcagagagaagtagaaatacctcttccagtgtggatttagaaattgtaggtacctcaagaatatatgttgcatattgcttcttcaactagtcatcccctactgattaaatacctaccatgggtttggtgctactggagactcaaaagaagagtaaggcaacctgtcttcatggtggtcaatgaattcaccatcttaataaagccatgagaggaaagtgtaagaaacaaaccatttattaacagttaggactaggtataactgaagaaatcagacaacagatgactttgagctaggggagattatttggtttggagtagctcaaagatatttgatcttgatgttttctgtaagcaagtaactccttttgtgtgtctttggggagttcatttcccagacattttaatctaagaatgacgcctttacattggaacaccaccaagttattaacgtagctttcttaacagtggtggccattgtgcttacaaagtatatgcagctttttcatcaaacatacaagtaattgcagagaaaataaataagatttatttttcttctttcgactgacaaggcttaatctgtctcatgcaatctttatcacttgaagtcaggctacccctctcagtacttgccagattcttcatggacgtggataataactataatctatggagcagtcctgcggttatgtcagtacagccagtaatttgcaagcctggttctacaatggcatctcttaggggaggaactgccttgagcttgctcatctgtctgaaccctgtagagaaggatcagccaactggtaactttcagtgaggtttctcatggccttttgctgtcttcaagtttatggctttaagagaggcctttggcaaagttttgattgctgtgaataccctcttataatggttcacttttcaaaaggttttgacgttcataattttctttaatcttcataattttctactagattgggaagaattgagtctcttcccattttatctctcatgaaagagaaacaacaaggctagttgaatgtaccaggtgacatacagccctttagccatacaatgatgatcacatcaaggtttccagaccacagacttagagtctcattctatctcctgtgtgggacctagaacttgtttgattagttctgttgacaattatatacaggctttgggaaacaagttataaatatttgactttttggttggtgcaaaaattccattcaattctgacattatctacctggagctagcatcagatctcatgagttaaaggtctcagttccacaataatgcccccatgtcatactccaatctcaaatcctggaccacccatacttctgaccgactgtctataaattgggggttctcatcatcccctcctcagattcggtaattagctaggaaggctcatagaagtcaggaaggcatttaacttaactttaccagtttattataaaggaaacaaatgaacagccagatgaaggagtacacagggcaaggtccagaagactcctgaatacaggatcttctgtctctgtggagttggggtgcacctcccccagaatgtgtatgtgtttggaacaacaacttggaagttctctgaaccttgatgtttagagatttttttttaatggaggtttcatcatataggcatgatttgttaaatcattggccacccaagctccagctcctacctcctccccagaggtggggatgaggggctgaaatttacatgcttttagtcatggtttggtctttttggcaaacagcccccatgctgaagctatctagggactaccagtcatctcattaatatagaaaagacgctcatcactctagagcttccaagcgttttagaagctgtgtgacaggaacaaaggatgaagactaaatattttttattatactagagatttgaatagatatttatccagaaagacatgcaaatggctaataagcacatgaaaatatcctcaacatcattacccattagggaaatgcaaatcaaaaccatagtgagattctacttcacacccactaggatggctataatcaaaaaagaagatggacaataataagtgtgggagaggatatggagaaattagaaccctcactcattgctgataggaatgtagaatggtacagctactttgcaaaatagttcggtaggttctcaagttgctaaatatagagttaccatatgatccagtaattccatttctgggcataatccaagagataggaaaacacacatccacacacacttgcacatgaatgttcatacagcattattcacaacagccaaaaattgcagagaacacaaatgtctgctgcctgatgaatagaaaagcaaaatatggtatagccatgcaatggaatataattcagcaataaaaaagaatgaagtagtaatgcatgctacaacatagacgaaccttaaaaacattgtgctaagtaaaggaagatagtcacaaaagactgtgtattgtacaatttcatttatattacatatccagaacaggcaaatctagagacagaaagtagattagtgactgtctatggctggaggaaagggtagagggaataggaaatgattggtaatgggtaaccaatttattttggggaagataaaagtgtctacatgtagagagtgctgatggttgcacaactctgaactcattaaattgtatgctttgagtgaattttatggcatatccattgcatctaaataaagatgtttagaaaaatcagcaaatagtatcacctggagttgggccatccagacaacatataagtacatctaaaattaagtctccaagcactgcaattctcatttgccctctgatgaacttggtgaactggaacttgaagtcagttcttgtaaataaacaatgctgctgctgtaagagctaattgacagtgtcgtcagattggctttgccagggagcaagcagtcatggtcatcctgaaattaacatacaaattacaatgatagattttatttgaagagttttattttttcctgattataaaaatagtttctttccaggcaaataaaatgtttcatgcactgaaataatcaactgccacctaattttttttaaaatctttcttttcatacaaaatttcaaattatgaaaaaaaatgcagagtgccagttttttgtttgcatgttttttgtttactcatttaatgttttaacaaagacctcaattctatttactaaattttaagtgtattgattttctagagggtatcggaacaaaatactacacattgggtagcttaaacaacagaaatgtattgtgtcacagttcgggaggacagaggtccaagatcaaggtatcagcatgggaggttcctactgaaggttgtgagggatggtctgtaccattcttctctcctagcttctggtagcctcaaatgttgtttgacttgtaggtggtgatctccctgtgtccctgtgaaagaacggagtgatctttctatgtgtgtctgtctctatgtccaaatttccccttttctatgaggaaacagttacattgggttagggcatatctaatgacctcatcttaatttgatcatctgcaaagacactattttcaaatgtagtcacattcacaggtaccagaggttatgacttcaacatcagttggagagacacaattcaatccataacactacgtcacattctagggcttataattttttaatattctcttggcctagctaaaattataattttaatcagaggaatccattgtaatgaggcaagaatagatgttctcttaagatcatccatgtatgaattgaagtttacctgggctcctttgactgactttgtcattttccatctggtgacttttgataaaaaaaaaaaaaaaaacacataaaaaaaatctccagtgttccaagcctgcagagaaaaaaggatgaaaatgattatataattgggaagttttattatcctctggttttgtgtcatttacttctgtaacactgtttttatcgactgccaagaaatgtatgtgtgttaccatttctttgatcgtcttggcctgcaaattcaggataaagggcacaaggaaaaaacaaacttaccattttcacacaattatttataagaaaaataggactggaacccatttctgatcacgatccttttgaaccaataaaaggaattactaaaaatgtaaggagtgatgttttttctctcgcaattggtactttggctaaaaataaaccagtcaaaaatagaaagaaaagaagatgggtaaggtctgttaagaaacctaaacaatattctgtggcatcatttctatcagcacacaaacatctaaattctccctcacacacttatatatataacttgacttcagtatctctctagctatttccccattcctttatccctttggtaacaaaacttcttaagggaagagctattccagtatttgtattcacccattctctcttgaggcctctccaatcaggcttttagcacctgcactctgccccaacctacccttgtgaaggtcctgaatccaatggaggactctcagcccacctcttactcactatcagcagcttgggcacacttgatccttttcttcttgaaatacttctttcaattggcttccggaactcacaagctcctgattttctcctccttcatggatttcttttttttcattccatattaggtccttctcatctccctgatctcttaactctggagggcttcctacctcagtctttggacattttcgtagatgcacacccacacccttagtgatcttctccagggtcagggtttaaatatcatctttttgttgctgactcccaaatttatgtctttaactcaagcttacctgctaaactccagatccctatatccaactacctatgaaatgtcaacacatgaatgttttattggtgtctcaatcttaacattcccaaatgtcttccctcagtctcactctgccacccaggctggagtgcagtgccatgatcttggctcactgaagcctcgatctcccaggcacaggtgatcctcctgccccagcatcccaagtagctgagaccatggccctgcgccaccacgcccagctatctttttgtattttttgtagatgtggtgtttctccatgttgcccaggctggtcttgagctcctgagctcaagtgattctcccttcttggcttcccaaagtgctgagattacaggtgtgagccacaacacatggcctccgaaactaaattagtgaccatccctctctatctgctcttcccaagtccatcaaagtcaactctatcgtcctagtgctttatcccaaaagccttggggtcccttcatcctctcatattccatgtctaatctattagcaaactctgttgcctctacactgaaatagatctgggcacttactgtttctcaccacttccgatcactaccaaatctccatcattttgcatcagaatttttacaaatacttcctaatggctctccctatattcacctttgccaccctctttccaggtctattctcaacacaatagccagagtgatccttagaaaatctaactagaatgaatcatttctcttctcaaaaccctccagtggtttgccaaaatcattacagtggtctatagctgccacatctgtggccccctcccccttatctcacagatgttaccttccactgctcttcttcattcagctcctggcacactagccccattgccattctcagcaatgttcctgcttcagagccatttacatctgcaggtccttctgtctggaaggcccttgccccactgacattcatgacttgtttctccagcccctcagtctttgctcaagtggcacctcctccataagaccttccttgtctgtactgttctaaatcacaattcccaagccttggcttttatctctgctttattttctcggtatcatttatcatcatctggtgtgctatctattttacttattttattaattgtttgcatcctcccagaagaatgtaagcttctaggaggcagggatatttgtatgtttagttcactgctatatcatcagtgcccggaagagtacctgatgcatggtagggactaatttaaaaaaaaaaaattgaatgaatgactcaatagttcttaatcttttctagcttacagactatgaactattttaaaatttgatgaaatctatggaaacttttttttagaaaaagttatacccacataatttgtactaaaattctaaagctaatgtatcttcttaaatttttccaaggatgttttccacacccaagaactcctgtttaatcatacgtggcctagaggaagaggcaaagtataaagccaaactctactattgtctgttggatgattgctactgcttaaatcatggtggcctgcagattgaggataaagggcataaggagaaaataattttccattttcacacaattatttataagaaagataaaactggaactcatttctgatcacaatttttttgaaccatttaattgaactacaggaattcagatctgtttatttattttgtttcggggacttaatttcgctagcataattttacaagggggaaaatcatgtttgaactcttttgtattaggccattcttgcattgctttaaagaaacacctgtgactgtgtaatttataagaaaagaggtttaattggatcatggttctgcaggctgtacaggaagcatggctctggcctctgcttctgggaaggccccaggaagcttttactcatggtagaaggtgaagtgggagcaggcaagagtaaaagagagagagtgcccggggagaggtgccacacacttttaaatgaccagatcttgtgtgaactcagagatctcacttatcaccatggggatggcacaagccattcatgagggacctgccttcatgatccgaacaccttccaccaggtccaccctccaacattggggattacaattcaacatgaaattggggtggggacaaatatccaaactgtatcacctttgtagctttctgcttatactcctcaagttcttccattttcctttctctcagcatcggagtgcctgattttattgataaggggttcagtttgatcatgatgcatttccaaagctccctttctctcttcccaaggtatttatctaaatttcacaaaccttaaaaaggaaatgcctacaagatcatgtttgaaagaggtttatgtaaatgtccaggaatgaaattattttaatttctgcctttccaatttaaaattctgtattcatctcctaggtaggtacccccatgtgttgaataaaatggcacatttgttgctgagaagttctaagacagcagaattttgccctcagcacttcttaaggaaaatggtctctgtgaattaaggatttatgggtgaccatgcttccgctagaaaggtttgaagatctggacttacatgctgggatcctgtcttgattaaaggctgcagagaagctgatacagtaaatagtctttgctatctgtggactcatatttcctgctagagataaaccaagctttgtgctatatagcaatcagcgagcaccgcagtggcagattcagcgctctgcccctactaggctgacaccttcaattggaaatggcctcaaaatcatgaatgttcacttcggagttacaggacgtggggatgagttgaatgtattcctccatgtgaacacttggtcactttccccacattacactgtaaaaccaatttttgtggttttatttctctgagtcctcattaatgccatttaacaggaaattcagctaaagccccaagacaagtgtagagatttcgaagaaaacttgctttggactgctttagcagagtgcctgtgtattatatatgtgcccacgaatgtcatcaccaggggagaggagcagtcacatgaacgatccaacctaattcatttatatttgattttgaaatgcacagcgctccttagactctcagtaacttttcatggaggtgggaggggtaatagtaagaggagcatgtgttctttgagctcacattgcataatggaaataagcaacaaactgtatctgacattccatgtggatacttagctgttgacactggatttagggttgctactcaaagtgtagttccggagcagtagcatcagaataccctagaagctttttggaaggcagtttctggtgtccacacctcaggatctttattttaacaagatccccagctgattcatttgcacattatcttttcctttttcttttcttttctttttttttttccagaagggttgtttaaagccctgtttcccaaacatggctgtgcattgggagcaccttggggggagtttttaaaatactgattgacacctgggtcctgcagtcagagtgcccgattttattggtatgggattcagttcgatcatgatgggtttccaaagctccccaggtggttgtaaggtacaacagagtttgagagcctctagttcagagcagaaccagaatgcatctcaggcacatgtgaatggtgaagagttgacaatttctgaaacagactttcaatttgtgacctggcattctaccagccacaaatttttatttgtgttttatccactcatatgttagctgtcttcttaatcaccagagacaagtaagttatctatttagtttactgctttttctattttatctgcttatttgaaaattgatggatagctttggtttatatggttattctagaccagtcaaaagatttgcttaattgaatttcatttccgaatatgttttcagagggaaggttatggtctaaagaatgtcatttaaaggtcttaccaatgctatgcagtagttatttctcttaaagcagcaagagctgagatttcaaaaagttaaataactgcctaaattgcacagccggtcattggaaaagccagaggttgaacttggcatttgaaaagtctttatctgattcctaaagcccgtacttttctgatcctccatgctgtttctggaaaaacgtagctgtgtatgattaacagcaactttaaaaagagcatttctggtttatttttgtgtagccttatgcagtgtacacatagacatgtgtagctttttgaaattttgtgtaagacattccaccaaccatcactgagtaaacgtagtatatgcccttaggttctgatttaaataacaacaaacaagcagagaagttaggggaattgaaggtgactgaggagcacaaggtattgagatgtttgttaggtgcgctgggtagggtagcttgaaagaatttgcaagaggtagatgcttcactaagagctgctgctctagtcagattggaaggaagcaacagaggaaagacaagctttagaagaaaggaaaaagtactactatcagaaatactaaaaggttatttcagattgtatattgcagcagatggcacaatgtaaaggacaaatggattaacttgctgagatttttggtgtccacttcatagccagccatgaaaggcacttaacaaagcagtgactttgttaaatgatagcttccagaacatgccatctgtggtccctgactgttctcattgcctgatgaagactggaattgttctgtctgaaaatgcagagtctttcatctggttgttttcatatccttgtgaattcttttctgagattgaatttctgtatatctgagaaggaccttggcttataaacatctttgctcccaatggcttcatgtttctccatagcatcacactgagagaatgctagcaaaaaggcagctttgttgatttgttgattcgtttgtgtattggggatgggtatattctggcataaactattctaaacttgatgctgaaaccctaggaaagccaaaaaggagatcctggtaggggagttctggccccaggttctgattaccatttcctgttacaatcaccatgtttatgagtaatatgcagaagcagagatcttcccaccttcctttttttttcctgttttccaggtctcccctcagtttgtctttatttctttaacttccactgcctcccactttattttcactggtatcttgttatatccctagattctaccctttcttctgttcattttaatgaatgaattaattaaatcgatggggtcttgctatgttgcttaggctggtcttgaattgttgggctcaagctatcatcctgccttagcctccggagttgctggcattcaggcatgagccaccatactgggctctcctgttcattttctcttctcccatcttttcacctttgaattgccactctcctcccttatcttttttgattaagaagttttatttcaacttatttgaaattgtgatggctagtccaggggctaaattgaagctgattttcatacagtctatatttatgaaagattttctaaaatattttattaacagcaacaataaattctaggaagatatttaaaatacaatggagtatgaatgaatcttcaattctgtagaagcatcatttaaatataaatataactgcagagcaagagaaggtattctttaaactatcatgcttcagatctaggggtgtgcttttggcatttttgagtggataaattttcagtatgagggaatgctgggctttgacagaaagtttggaatccttggccctgaacactaaatgcccatagtgccaactgagtcatttgacagtcaaggacatttacacagatttccgaatgaaatggtaagttttattttattgtagcattcttattctctatgttaaatctaaaatagtttctttaaaactgtgccatcatttagatagatgcccgctaatcatttgttcagatttcttatgcttactgcaaaataattatgtagacatgtcagtgttaaagatcaagtgcaacgcagttgctacaagaagtggcacatagagcattcatcattctagttaaacacaaaggagcttgtcctgattacatgaatgctagctttctattccttgaatgaacctctccaagtaagactaagagtccataccttgtagtaatttataatgtgaaaaaatatttttctacctaggattttaatgaaaattaaataaatgaatgtggtaaagcacttggagccaatttgaactctggcattgccttgattatatctggaagataactgcttacccacctccagtgccccaacaaccatggctcaatgactgttttcatgaatcgaggaatttgagatcctctgttaatattaacagcagcctcaagcgtgacagaagtcttctagatgtctgaatccaacacctgcacttttcaaaatgggggactttagtaaaaactctcatgtgacaataatttttgaaacaactccaaataaggcataatgcagggtttaagctaacacttcagatgacctaaagcctgaactgaagaaagcaagtgagtttgatcattattctttctcgtgatgagctctaacagtcacttatatgcattttgttagaacactcctacaaccattgagaacagaataaaagaataaaaagaaacagattcctactatagcaagtgagatgcaggttaaaaatgaaacacatacacacgcacagacatacattccagttgcaagtgtgattaaatatgataaaaatagggaaccaaaagtgacctctttccccacataggcagagtggctttttgaactaggaagcattttgttgtctggtcaatagagcctaaatgtaatactcgcctatagccaggggaagaactccatgcctccaacaggtcagtttattattccctgctgtgtctgggttgcagatgagaataaaacctctcacttctatgagatgagtcaacctgcagttcaccatggccacattcctgggaaaatagcttgtcaggagaaatgactaaagaagaccatgtttgacttcaatgctgcccgattggtgaattatatttttagagcaatcagtttaaatcctacagattgaaattgtgctgctcgctaactgcctgggtgatttggcatgaaatttaatttgctttaacatgcatggggggtaagcagaggggcgttaatttcacatttgagagttgctgcggtactttgaaaataactaaaatcgtggtataatactttgctctcatttttcttcttcaaaacaggcgtgatgctctggccaaattcggtactttagtctaccagtttgggctaattttatcttttttccatgattctcactctttctcactttaatgtcagtattaactgagcacttaccatgtgctagttacttgcttagttgatcatctaattaacattcagcatattagccactcaattttatagttggggaaagttgacaactactgaccatttccagacctttcctctctttgcagggacacagagggaagctcgtctaatagggtgctatgcttttgttctttcatgtctgtcttcccagagtggaaccctcattcaccttgagtgtgcccactgcaagggagaattttggaatcaagggttatgtttttaatatttttcgatgtagcaatccagctttcaagtaatataagttagtcctcaaagtcaggtcattttaaagctatttctctgacatgagtaagtcaaggctgagctaatctgaaaatttgcatgctgataacaataaaacaataaaaaaaagtgcttctagtgaattaatgtcttgaacctacatagagagcgacctataaaggagccattttttttattgcctgaggctaatgtaatggatattgaaaatgccttactactctgccatgtaatctacatgtccccaactgatatttccgctggtcagtattcatattaaatgtaaactcaactatagttggtgattagaaagccaactagcagcagtcattgattcaggcaatgagtctaatgccaattgtacttttaggtaaatgttttgataggacacttcatcagcagtaagaattcctccactgggatctttaagtaaatactttgcttctaagaattgtaaaggaatggttgcttggtccccaaaagatcctttcttagggcatgatttattatttaatggattgtggaaatatgccatttcttgaaatgatagtcaatgagtactataaaagatctgaggagaactatgtgcttcatctaattaagctatttatttgagtttattataagacaaatgtatcttcagttgattccattttatggaataccaggcaatgaagatatttttaacttcttcctgatcatatatgatcctccactgtaatttcccatgaattatgtcagatcaagaggttactttaaaaaaaaaaaataaagattccaaaaaagatgtttcttctggggaagtaggttcattacatctattaggacagtacatgtatcagtgcttgagaagacaaaaccctctaaatgagtgttcaggaggtttagatgtgactatgtcttccccaagaaacctagttcatcttgttccaccaaaatgctcaggtcctagagcatctttatcatggccagagcgatcttgctcatcaatcattagtatttcccctccatttagatttagatttagattctccatttagattatcaggcccctgataaatagcaaagtaggtactgggggtagggaagggggtaattttcaagcaataagggacaaaattctgccatgacaatataagactggatacaacagcccaagaactactaccattttctgacttaaaggagttatgtggtagcttggcataagtatgatgaaattgtcttctgttgtcaaatatcggacataccatacaggttagaatcttgttaactattctctcctttctactataacctataatatatagagctaccatgtgtccagttgaattggatacatttaaatttaaaaaatgtatataacacaaagatcacatatcccttaattgaggctctttactcctttatgccactgtgagaacaattctgaacaaatagttaagagacagatgttctagacctacctctgcctctcacatatttaccgcatgagctcataacaggagcatctatatcattacaaaacaatgattatgcaccacttctactttttgcactgagcttttgccaagatcgaatgagataacccaggtgaaagtgctttataaactctaatggcattatgctttgaaaatgtgacattatttagtgccctggagcagcaaggtactaaataatatcttagtggcttgaattaatacagctgccaaaagagcctaatttaggaaattgcttaaatatgaaaaaaataaaacaaaacctcattccacatgcatttttcactgacacaagctctctgtgctccaggtttcaggaggtatgttaatacagccaaaggagggaggtggttgccagggtaaatggaggtaaatgagagaaccagagtttgcccctgagaatttggttaaagcagttaaccactcacaactgagcctctttcagaacttcttcttaaccgtcaactaatgagtcccttgcacttcttcggttgtggcactctaacttcaggagtactcctatccaaacactttattgaaagaaacaaataagacagaaattaaaatgtcatcacgggagaatatcaggggatggaattctagaaggaagtgtacatgtaggagggagttggtgggtgaagatgggaatatactacagaggagaggaagggggaggatatgataaaggtgcttgatttgaaaagtctttttgtccaatgccatcataaccaaatcactcacccactagaagcacaactagaaaagagcatgagtcatatggcctccattttccctcttgcaaacagagtgcatctttagggtggtgtggatttctggagatagaattttgaggggacaaaggtacaagtaaacgcaaacagaattaccagtgttgtgaggattgtgaaagcaaatgggataaggagtttcgggggagttttagaagagaagtcttagggaggatagcatttccgtaatttaaatatttgaatacatgacttgatcatgtgcagaatgatagggaaatatatttccaacacagcatgtgggagattttttttctaataaatagagctgttctctggaagtgatattacttctagatcagtgtttctcaaactcaggtgctaaagctgccggtctgggcccatactctggcagtgagggtctagatcgcccttgcttcagttgtatgccagaagatctgctgtcaggggtgctgggtcagggattgttgctctagatgggagggtggacagagaagtgtgggtgtttctttcacctctaaaccactctaataccttgtacagggagtgcacttagtggtaggattcatggtgtttatttttctgcctcccaatgtccagggcactgatgtggacaggataagggctggtttatcatgtgctagtttaccactgcagtttctgtattagtcaggggccatttggcaatgaatcttcttcctaattgtagcagacatcgctatatgcctaccacatatccattctctctttttttccttagtaatatcactgtccagcctggcaatattctcagctaaaaagcaaaaatgttgactttacagactctcctccggctaggagaagccacatggcatagttttggccaatgagatgtaagcagaagccatctagaacagatcgtttttctgataaaaagtctgcatgctctttttgctcttctcttttccccatcttgcctggcatatgggcataatgtctggaggctcagcagttcctttgtgatgatgaggatgagagctacattctaaggatgatagggatgccaactcgactcccttgggccactgtacaagccctgattagtcttctgaacaacttcttgctatgtaagaacaataagcatcatacttattaagccgctctttattgggttttggctacacgctgccagacacagtcctggctgatattctagtgatcatcatgcctcaggcaggtaacctcttgtcactttagttttagggaaagaccatttctcatcagcaaagatgctccgttgtatatgatgaacttttctatttttgttcccattggacaactttttctttctttcttttttgaactcttatataattttaaaagtcttgttttccatgaacattaaacgaccatttttacttaggtagaacaatttttactgcccagaggttaaaattaatgataccccaaaaaagtattcaccttccatggtctatattgctgggtaaatagcacagtcacattgttcttttttttctcccaaaaagattccatttcttagcctgtccatttcactcttcaaaataatcactgtccacctgctggatccctctttatccttggcaactctgttatgtcaattatataatagtttggccctttttggcttttgtttcactttgtttcttttctctctctgcaaagcagcctgcagagcaataagatagggaacatgcctgctgggcctgattttcttcttgaaaatagctttgaccaatggttagtgataaaagaagttggctgtctataaaagccaaaaaccaggtaagtggatttaacctcacattggcacaaaggtgactaatggacagaaaatggaatctgtatttgctttgaacataaacaggggcagcaagacatggtaaaaacatcattatacctagagtgagctcaccaagattccacactgctgattccaactgcgaatcctgcaatctcttagcctctctggaactcagttataaaagagtggtctccaaggtttcttccggctcaaacatcctgagctattctcatccaataataaacatttattgtgtacccatgataggccagccactgtcctggcaatggagatgtggggatgaaccatacagagagaagaaaccaaggtttgagagtgcagaaatgagagagaacagaaggaagaactgtcatgggaaaaaataatagaggggggaaatggaaacagtaactaaaatgtgcctggccattttaatggccaggatcattgcagccatcattaatctcaccatccagggaacctccaagtatttttgtcgacaccattcattcaacacttatcggtcagctgtcttaggaagtctctttgggggcatttttcttgtctctcaactagtttgaaagcacttagaggccaggtacttgtgtatggctgaatcaaaataccttttggtatcaagtataaaataaaccaggcaagtgctatggatctcctcaaaaggctagaggcctagcgaggagtcatattaatatttttggattgaatttagctcactggagaaggtaggaaggtagatagcagtgttaacttcaggcaggctaaccactcataatcaagcacaaactggaagtcatatgcaccccttgaggagtgcttaaattatagcaaagaaaaaggtcagtgaatggttatgatagaaaacagtagttttctttaatgagtccatggtacctgttcatcaccacagatccctgaaggcttaccttttagttaccttgccaggaggcattcaaaatagcattttttttttgttttttttttgtttgtttgtttttgtttttttattttttatttttttttggtaagcaaggaaggaaaatagtcaaaaggggaaggaaaggaaagaaagaaggtagcatgatgttctgtagatatagttcagcagtctcatagtctatctgtatttggtatttacattcatagtgcccctccttttgtgcatctccagaggccaggaagtcttttcgatatcctcatctctgacagtgcctatcatagagccgggcacaaagcagatgcctctatggacagaccgaattgacagatagatggaactggttcttcttccctgctccccgattccaagtgggaccaatgatgtgtggcagaatataggaaaaaggaggatctcgtcagtatcttgatatttcttgaggcctgcatactaaagacagaagaatcaatatgactcttctagtcaaaaccacctatttggcactcgagcactgagaataaaagacaaggtcagggttcctggttccaaggacttgggcaaatttataacctatttgattcacatagataataccatcagatacttaccttcatagattgtcaacagctactgcctgacccagaactgtgctaagagaagccatctctaaaattgattttttttattgacacttggtaatacagggtgctcttagaacatgagagggtagaggtggcgcttatctttgcatgtgacactcaaagctagatataagtggggctgcctaacttctagtcttcatgaaggtaggctctgtgggggcagacactatgtccttcttgttcattccttatctttgtgaactggggaaacgtctatagcctttttgtgccttagttttatcacccagaaagtaaggatactatgagtacctattcacaggagcgatgtgaaaataaattcagttaatgcttacttacaaagtccttaggacagtgcgtggcaaggagtaagccttcaatagtcattaaccattgcttactagtattttaggcttgaagagtgtctggcatgtaatagatatcaaaatatttttgctaaataaatgtatgaatgagttctacgtcagtagtattctacttttttttttttttttttttttttgagatggagtttcggtcttgtcaccaaggctggagtgcaatggcgcaatcttggctcactgcaagctctgcctcccaggttcaagcaattctcctgcctcagcctcctgagtagctggaattacaggtgcccaccaccatgcctgcctaatttttgtatttttagtagagatggggtttcaccatgttgaccaggctggttttgaactcctgacccctcaggttatctacccgcctgagcttcccaaagtgctgggattataggcgtgagccactgtgcccagccactactctacttttatgtttagcttgtacatcccttaaataatttttgaaaaagtatgtatttccttgtatatctttaagtagatatataaaatgttatatctcaagtctaaccagttgcaaaggatgcactttctagtatattgaatatgttaacattgtaaaataaaactctcacatcactcttttgaaatataacaaacggaacagaaatatcacttcacccattaaaaaaaaacatgaagaggttctttataacattttcaaatattacttcattctttttcctttttgcattggggtttccattctatcctatcacagaaattgattctaaagcaatatatttttagaattgaacatttttattgattttttgactccattactgtaggctcactaatgaaaaaaacaaaacaaaacaaaaaaaacctttttagccgctgagtatgatggctcacacctgtaatcaccagcactttgggaggctgaggcaggagtattacttgagctcaggagttcaagaccagcctgggcaatatggcaggaccctgtctctaaaataaataaaaaataaataaataattccttctatccatccatatcaaattggattgatatcattattaaaaataaagtggccatatgtgtttaagtgaattttaggactctggttctactgagctttttgtctacatttatgccgatgatacactgtctgatatggtttggatctgtattcccacctaaactcatgttcagttgtaatccccagtgttggaggcggagcctggtgggaggtgattggatcatgggagtggatccttcatgaatgggtttagcaccccccctttggtgctgttctcatgacagagttcacatgagatctgattgtttaaaagtgtgagcacctgcccctcttcctcctgctctggccatgtaagatgtgcctgcttccccttcaccttgagacataactgtaagtttcctgaggcccccctagaagcagatgccactatgcttctagagtttgtggaaccatgagcccattaaacctcttctctttataagttactcagtctcaggtatttctttagagcagtgtaagaatggactaatatgctgtcttaattattatagcttttcactaagttatgaaatctgatggagtgaatcttccaacctaatttttcttcaacataatcttgactccttttttcttatatttccatatcaatttagaatcagactgttaatttgtaccagaaacacaagctattgtgattttgattggaattatatttaatctgtcagtaaatttggggataactaacatcttaatgaaattgaattttcttatcttttaccatcatatagttatccatttatttacatctttaattccttttagcaaagttttgtagtttctaatgtagtggtcttaaacacctctcattaaatttattcctaattttcttattgttttgaagggattggaagaggtagtgaaacaaaatatttaaactgatacttaattttttctggtgaaccataagtttatatatgctgaaaagttcattgtgcattgagctatttctatgataagtaacacacaactgatcaaaactattaaccattttgatggataattatgacacaccgtatattttttgaaaatacatagtatagagagatggaggtagctattagggtacttggattaaaataattgtctaattatcccttttggtagtacttaagggttttttacacatccgagcagtatactttagtaagatatagaataggtgagaattgtgccttattttgtaaaatgggagagtggtaagagtgaaagtggaaaaggagaatttcaaccacaggagcatcttagactaattttaggtcataatactaacagagtttgaggatctagcaattgttttattaaaactgtcctgatagggtactctatgattagtccctgcatatgcttagggagtacatgtaagtggccctgcttacaaaccacttctctagaacagaagtacaagtgaatcagaagggtgacgtttgcaaatgttttatttttttaatgaagttaaagttaatctacaatgatagcattttgacttacttgctttctgataagatttctcatgtcatggagatctatgcagaacctggagtttgtcgctctaaaccactaacttgaatatgctactgttaatgttctattgatacttgctattgattattattaatttgtgtttattattattaattattaaacgtattatagtgggttttttttaaatagatgattttccagaacctgatttttaccctgggaatggatggtatacacggatgtcatatgaacaaggtcctcacatttttttctcccagctggccttcattgcctccaacccctttattttgttctcccattaagagctgtgtaataccaatttttgtaggctacaaattggttttctagcagatggaacatcaacctgaagaggtaatggatctttattactcaaactaggtcaaatattcaggccttctcagtaaatcataagaattatctgagagtcctcatgaggaaatagaaatgcatttcttaatagtaatacgtggttaaaaattaaacaacaaccataactttacttgttcctcacttgggccacaccattatattagtttttttactcagcgtgggtgcaaaatggattgtagctcactgggttctgaatatataacaacaaaaactgtcattcttgtttcataaagtgaaggtaatcctaaggagtatggttaaagtaaatgttcacaaactacatgtagtttcttgaatggcttattcttatttctaagacaacacatcagtagtttgacttccatttgggtgacacatagtaccagttcccaaaaaaaggacattttaaaaatcatgacatgacacggtcacaactagaaaaatacagcaggattagtagctgtgatgaatagggaggtgcaagggatggattctggaggccaggcctgaactccatctgttgtttattatgtgtgtcacctgttggggaaatataatttagaacaaaatctcctccttccccccaaaacctctccatgaaggtggaagagaaagaaaatggtttcattgttgtataagtactaaacaagaatatgatgtgcatcatagaccgcctactaagagattgcaaagacaaaaagaaatcacacctttttaaaaagccaaatagatgcaacccatcccatacatgttcttaagataaactataactagtcctctagtaagaggacttgacagcaccatttgtcacacacagttcaacctgaattcacttggtaattagggtgaccatctgttttagctaattgactttgtctcaaagaaaaacaaactcttatctttatgacatgaggcagttttgcaatttggagaaaggaacctaaatgaagttaggttcctacccctgccacagaactggttgataaggatgctttcttccttgataacatttcaaagagatagttcccaggtccttgagaaagacactcctccattataaggctggcaagaggcttatttaactttgaaaaagatttacatacatttcaaagagactgaaaaataatttacaagttttctaaagcaagaaaaaggatgagggagaggtctcttctctattttcaacagagagaattatttactttttcttttttgatttgtgcttacccttacacatcttaggaagccactcaatcttcttgaatcttttttctcatctgtgaaaggggagtaataacactcttaattatttcacatcacacagggcctaagaaaagtaactgtgcaaaactcacttgtcattttagatgctgaaattactagaaatgagatatctttactggttaatacatgaatctaatatttaagtggaaacttaacgtttttaaaagagtctctctctacaaggccaagaatctttttgcaacaaaaatgtgtcagctctacatttatcggttggagttgaacatttactctctctgcacgtcttacccataagaaccagttttctgtaaatgttgtgtatgaattctcttgttatcaatgtgttcttgttccatagtagtattaacaataaatgttaggaactgggcgtggtggtgcatgcctgtaatcccagctacttgggaggctgagccaggaggattgcttcagtccaggagtttgaggcttaggtttgctatatatcaggcctgtgaattaccactgcaccatggcattctagcctgggcaacatagcaagacatcgtctcaaaaaaaaaaaaaaaaaagtcacagtaaattcaagctgttctaacttattaactaattcatctagatatatttttcagaaattgtatttttataaagacatgtcctaaataattattttggtttaaaaaatcctgcaagatacattttaatacaaaaataaatataagtacaagaaatgaatttagatatggtggaaaacaagcacagaaatattttttcttcagaaatgatttttaaaaacatgaagaaaaaaaaatgatgccattgcttgaattcagaggtacttcgatttgacagatttgacatatcatgagataaagtacaagcaaagcaaaaataactaaaaatagctccatggtaatgctaagtataagaattaaattgaagattgaaagactcaaaaatctcaagcatgctacatgattttaccagctctctcaaataaagccgggctcagtaaatgctctggtgactgaaacaatgctaagattgggctttgttcttcagacatggaattcatcaccttcgtggtgatgaatcattggtgaggccctaattattaaacaagatgtcgaatcaaagctatcctcctctatttgcgtgaggatttctgtacttagaattgagtcctgccacattcttataatggtgcgtgcatatgggtagcaggtatacacaccaataaataatgtggctagtatgattctggaaattacaatgccagttagaaattattcagaatggaataaaatatttaaaacccctgctataaatcttagccaggaaataaattttcatgagaccagtgattaacccaatagcaaaacggaatttatatcaaccattcattaatcccatttcccttctcccaataccattaattaagtgtctgttcaattcccattcctgtgctacacttgtgtcgcttacccaattacagctaattttcttgcatgcaacgggagtggtaatagcctctaacagttgttgaaatgtggttcctagcgtttactgcagtgtgtcatccttaaatattctctaacatgttttctaattctgtttctaaaatcgagtttgtgtggggaggactgagttgaatacagtaagtgggtggtttccttcctttcaggtcctcggagacccttatctgatttaagttttgcctcaggagaaagctgtaccactgagattgctaaaaataactgttctcctgtcttgctgttttgcctatgattctcttggagaaaaaagctttggaaaataaacttttgaaggcgtgtttttataaattatctgatcacttcttcagagttcaatagaaagggtcaattttaaaattaaagcctctgtaacaagatgttcttttctcttttctcctttccctttttaaaacacagtttacaaaaaaggagatggtgaagcctgaaaatattaaatataaactctttgccttattttagtcgttcctaaaattatgggtgtaatttcagtttgtgtattctaaaagtaagtttcccatggatgtctgtattataatttgagagaaagtaattttttttttttttttttttctgatggttcctcacttgtcagtggctcctaatgatttacttgatttaagtactttgtatcttccctctgacactcctcatacttttctttcctcaccccaggtaattgatgatctgtaaataaacacttcaactcattagagaagctcactgtttaaaataagcctgcagagaatccttttgttaaggaaataagccttttataatcacctctgtgtcttctgcacagatttttagtctatcagcttttccttaaagcagaaagtgttttatcttttctaagcaagggaaagattcccttgatatgtagctgggctctagaggggagaacagggaagaaactcgggtttatgattagtgatggggttaaatgcgatagtaacagctcgatttagtggcattggctaaagcgtgctcctacacactgtaatccagtcatctgtggggtttggccttcatgtaacatcacttctttctttttatctacatacctgcatacctggccttgtgcctcttcccattcccctgtaattggaaatggcatctatttggggttgttgtcaccacctttaccgtatctattcaaaacttaatctacatacatcaaatcgttcaaagaaaacctgtgcaattccaatcaactctaatatccagttgtttctaacatgaaattcaagggactacttcaaagccacttggagagtagctttcttcccatcaaagaatgagtagtaggcacccactgttcactgttgacatgctgacagtgcagccctgcataaacacaaccgcttgccctctcacagcttatattttaaaggttgtaaaatcttgtttttgtcatatctggcaatagtattttgtaaattattttttacatgattttttaaaaatgtactcatcaaaatgagctggcacatataagctcattatatttttacattttagcaaaaacactgtcttttgcctacaacatgatagtttgtgttttttggaaaaaaaaaaaaaacaacaacaactctattatggtcttcatagtgtttctaatttctaaaatcattttggcctgtagacacttttaaaaaaaagatgctctctaaatatgaggaacataagattgtgtaactgttttcataagtgaaaaacttacacttaccattgtcatctgagaggaaataatggtttaattagtttttagataaaaagatttttgcaatcagactgtgtttgtaatggcatttataaaacaatttccccctacagtagcattgtaattaagactttcaatgaatcagaggagaagagtgcatttttccccctgtggtcggctgttatgcttgcccctcggggcctgctgctctcctgcatcaggcttgcactaatgcccactaatgccctgtaattgtgtttcacttcctctaattaaactgacagggaactcgaattgctgtcacttaccttaatgatagggaaggtaatgggattagaatgtggcaattctcacacagaacacttaacatcccaaataccagtttaccaggaagaatgcatttcagggaagacctaaggacttctggggttctggtcccacctcttgggcaatacaatatgtgagttagaaaggtcacaaagaatatcttcttcatgggcgtgctcctctgaacatcagctcctgaagattttaatggatattacaagagaaaaacatttctgaggcccagtagaagttggaaaagcagggttaatcaagttaaacagatttcttttatttgtcactgtcagtgccttgatacttgcattgatttcttttcttaaaggtgcactgtggtggcagtggcggcgtgtgtgtatgcatgcatttgtttgtataaagtagttcacagacgcatttgcatatttgataacttttttaggggcaaattcaaggcctggtgtcctacagatcatcttttgagatctgcagatctagccgatgaaggctgtcacatggttatttagtgataggctctccaaccttgtggtggtggccatgcatccaccagatattggatcagccttcctaaaatacctcttcaactccctttcattgcctctcccttcttcctccgctgctgttgttgcagtgtgtcaaatccctcaggcatatcgctgtgaaccccgaatatctgagacaggtctcagttactttagaaagtttcttttgccaaggttgcggatgcacagctgtgacacagccttaggaggtcctgatgacatgtgcccaaggtggtcgaggcacaacttaattttatacattttagggagacatgagacatcaatcaatatatgacagatgtacattgattccattggttccatccagaaaagcgggacaactggaagcagggagggggcttccaggtcacaggtaggtgagagacaaatggttgcatttttttttttttttgagtttctgattagtctttcaaaaggaggcaatcagatacacatgtatctcaaagagcagggggatgactttgaatagaatgggaggcaggtttgctctaagcagttcccggcttgacttttccctttagggtagtgggaccccaagatttattttactttcacattgcgtagaaaaacggaaaacaaaatacttcattatcacactgtttttcccttctattctgggtgctgctgaactagagtatacaatgcggtgttgtggagagtgcacagattcacccaggtttgagacctccgactgactagtcttgtaaccacaggcaaatttcttaaggcctctgaagctccatttatgcgttgataaaaagaagctttagggtttggggttattgtggaggtgggagaaaacgaatataagtctcctggcctgtagcagacattcatttaatgataactgttattattatcttaagattttaaaacttttatttgttttattttttattttattttattttattttgccagcagctaccctatgaccaatatctagatgcaaattgaaaagttggttgagcattcagctctttataaatagctttatgcttggtaaaaaccagcattatgattaacttttttttataacttttatatcctgcttgtaatggtgtgaaaaaaatgtttaaagatgttgaaataatgcagtttttaaaaaaagaggtaagtattcaatatcagctctactaactagtagggattacattctcttctttcctttggttgttttttattttgttggtttgtttttatcattcagctgagtaggatatcagaaatagtaagcatctgctccattgagattcgtagcaacttgttaatttcaggtgggattgtgtttagatgtgacttttggcagttgagttccaagatgtttatcagtttgctcagactgttatcatcataatttagaaatccacgttaccaaataaatgcatgcaaaaaatgacttctgaaagcttgacacattcatagaaagatattcctgtggtagagatcacacaatatcaatttagaatttgattgaacctcagaggccatatcaatgtcatacactgttttggcatatatttacatttaagctctgaatttctcccctctcctgtctatgtaatctttaccatttttagactttcagcatctgcaaagagagattataaaatactacccaagttatgggttgcactgaggattaaaatgaaataaggcattgaaaagtatttcatagactgggaaatgttgtctacattttagctagttagattttaaattattagtagtaatagggtgcatgtagaggacagaaattgtctcacgctgtaaagctaattcccatcatataatctcctttctataaatttttacgtgcatgtgctaaatttggagaattgaatgcactatacacagatgccattttttttttaaccatttttgcttcagtttagaaagcaggccaatgtgggtacaaaaagtaagccttaacacaaaggcctgtgaaaagtatccaattagcctgattgatctattttgtgcacagatttattcttaaggcacttacatgatacagatgttctgggagatgtcaaattttccttttgtgacagcaaactccaaatttaggggcatattctaaatatctctaactgtttttagcagcctgttttcaatggctgataggtttgccatttttagcaaaaaaaaaaagaaaagaaaagaaaagaaaatgaaaaacagtatgtgtatatatatatgtgtgtgtgtatatatgtgtgtgtgtgtgtgtgtgtatatatatatatatatttggcacgctaggctagtgggtaggaatgagaaatgatggtaggagaactggtgaagtttggaactgtcaggtcagctgggtgactgtgctccaggatattgtagtatacttttcttgaaccctatgtctaaagctatagggttagtcagctcagagcaatactttgaagaacaggttcataaagtttattttcactatatagagcattttgtttgtcctacaacccccttcctcaagcttccaaagaggagtgagaggtgcctgggcagataatcccaccatcttattcttatctttttatacctatgcaagttatagtgaactaggattttaaacgttttaggttattttgccacaaaggatatatttctcccccaccattttcatatatctaaacgtttagaaaggacacttaaaaataaggcagggacttcttaaagggataaatttctctgtatcttagaaagttggggaatatacatattctttgacctagtaatctacttctaggaacctgttctacgcaagtgctcacccaagcatgcaagaatgtacatatacagatgcccactgccttattctttgtaaaagtgaaatattgaaattgtggtaggcagaaaaatggctctcaaaggatatccacgtactaagtcctggaacccatgaatatgttatggctctcaaaggatatccacgtactaagtcctggaacccatgaatatgttaccttatatggaaaaggaatttcacagatgtgattaaggttaaagaccctgagatggggagagtgtcttggattatcaggtggatccagtttaatcatttgagtcttcaaaggtagaaaatctttcctggctagagtcagagagagacggaactacagaagcacagccagagagatgctaaattgctagctttgaagatgaagagaggaatgagccaagaaagtgggctgtttccagaagcaggaaaaggcacggaaacagattctcttctagcacctccagaaaggagtgtatgcctgaccacaccttgatttcaatgctataggatttctgacctacagaacttaagacaatatatttgtgctatcttaagccactaagtctggtaatttgttatgacagcagtagaaaactaatttggcaacacagatgctaaaatatagggaaacacttaaacgatagctcactccaagtagcaagtatcatgaattcacaacaaaaggttgaggcatttatattgtactgccatgaaacatggaagagtgttggtgaactcttgctgagtgaaagaggtaggagaactcagtgcagccattgtatcctatttcagcgaaaaaatattgtatatgaacatatttgagtggtgtgtgtgtgtgtgtatgtgtttgtgtgcgtgtgtgaatggaaaaagatctatagctacctagtgaaatattaccaacaatttcagggcaggaagggctgtgtgtttgtggaaaggggggaattcaccttttactttattcatataaatattgttcaaaatgtttaatatagactattgtgtaactttaaataccattttttaaatatggaggaaaaatatagccataataaggccaagtcaatgctgattcattgacaactagccagaagactttggtgtgtcaccttgaccaaggatgacttaactatcgaggagaaaaaaacttaaaaattatctagttctaacaccttgctttagagataagaaagctgggatctaatacagttcagtgactttcctgtcctcacagaaagacaaagaagaaaatggcaaataagataaagatattctggcttttcactataccacacagccacttacttgtgtttgttactgaaaggttaaagaaatatcttttcttactcatcactaggttcatggctgaggcccctgtaacaaaaggcagattagtaacagaaaagcatacaagtgtatttagtatgttttacatgacacaagaggcttcataaagaaatgaagacccaatgaaataagtaaatctacatattttttaatgctaggtttgatgatgacataaatagttgtagagaagtatgattgagcaaaaacgatatgatctaatggtaagaaacgggaggaaacagcatggcctgattttcactttcttttctgtatccctatatcttcagagttaagaatgttctttcccttcagggttaggaagggtacttctcaaatgagggtcatatgactggcttgaggggagaaattcaagaagaaggtgagagtgacctttctgcttctgcagatttctcaaatgccaagatgccatatattgaggtagcatgtcctgaactccatcattacacagcaaaagccatatggctgtcacatgataggcactcagatgaattgtccaaaatgtggccaattctgattttaacatttacccatagcagtcattatcagcaaatatgtatcagatgtcaactaaatatgaggtagtgaagtgttaacaatataaagataatgatgatatagtagtattatgaatagcatagacaaagaaacctgcaattttaggatgacaggaaccatggtagaaagatgcatgaagtgcagtgcatacacacacacacacacacacaaaggaacaaataatgtttgaggaaatcagggattttttttttttttttacagagaagataatatttgaatgagatcatcaataaacaggtgaagagagaatggggagcattgtagattctaacacagtggtcaatgttattgaataaaatgatggagggaatgtcagcagtgagaatgccacgtgaaagagcctagaggcatgaaagcacagtctatttgagcaatggaggtggaaggtaaggttggagagcaaacctgaagtcaaattgcccaggaccttcttggacttatcttgtagatgataggttggcattggagaatttcaggcaggtgagtgaagtaatgtatgcttattagaggtaatgattaaataatggacttgattttcacagagtgaaactggtgacatgaaatgacgtaaaatagctggcctaataatttttcagctccagacttaattgaactaataataaggtggtcataaaacttgtcgtccgaattgaagcactttatagagtgaaaggaggcattattatcaactatgcaaggacaatataagaaattttgaaggaatcatctccctccctatgaaacaaattcatgcaggtgtgagatgattggatttatggatgataattagctggcaggttgatatttgaggactctcaaacataaggccaatccatggactctcatgactataggatggatgctgtggaaccccagaacctctccactataacctttactcattgccttaaaccagtctcaaatttacattatttcaataatatatttatttagggccacaaatccccatgcaagctccatttttagagaagttttttttttttttttaagctgttggctactttagccctcatgtagcaaaggttgctctttcttaaaatttctctgtccttcctaaagaattaattggacttgagtgtagaacctggatttgatcctgggtttatctctcactctttggcccttgaacatgttcattggtgtctttgagcatacctgtaaaatgtttatcatatgagtatgtcataagaattaaataaacaatcaaggtcaagtgtttgacacacagtagacacccaaaaaatagacattgtcttcatttcatatctcttcattgggaaaacagctttttttttttttttattgagccacgttacttctcagtcaatttgcattgtatctgtatcatagcatttgtcttactctattttaattactttaaaaattatgtctcatttgttaagccagttgttcccaagtgggaaaattttgctccccccttccccaggatacttagcaatgtctggagatattttagattgccataactgggggaaaaatacactggaatctaattagcagagaccagggatgctgttaaatattctacaatgcctagggtagccctccacaacaaagaattatccagctcagaatgtcaatagtgctgacatttagactacaagctttagacggtaactccatgcagattgtgaccatgattgtgttgccatggcccagtgcctagccctgtgatcattctaggagtctcagtgttaattagtggagtggaagaatcaggacctgatcattctatgagtctcagtgttaattagtggagtgaacaaatcaggacctgatcattctatgagtctcagtgttaattagtggagtgaatgaatcaggaccaatggtttagccatgatccagctttgcatgtatttcttcactccctttagtcaacatgtaggttgttttcatggtatctcaagcacacagctacccactgcttgcttggagtactaggaatagtaaacctgaactctgaaagggacatcattaaagaaatattgcccataaggggataggtatcatatagttacctaaaatacttcaagtttcttaatcaaaagcacctgcaagctttcacatagcatatagaagttctattttttacctgaattaaaccgtgagagagcatgagattaaatttgtctctggatgcttactgaaatgagaaatatttgaggaccaataaggaaggtggctttactttgctttatttatttatttacttacttacttattattgaattattttgcatcctatagctgccaatttctaataagagatgtaagactctagaaggagcttgagaaagcctgaggaaaccagcctggcattcagaccaagaaacctgctcctgggcttgggaaatttctaattgttggatgagatgctgctcttttgttattcagacaaactgattgacgtgagtcttgtgctgtgaaatactgaagagctttccgagaattcacacaagagatttctggagcctgtcacatcctccctacctgtcctcatctcagctctctagaactccttgtagcctaatcagtaatgtcatcaaacctcaacaaaccattactctggtatttcctgttacaccatatcttagtttgctagggctaccataacaaaataccaaagactgggaaactttaaaaaaaaaaaagatttcaactcttatttttgattcagggcaacaggtacaggtttgttatattgatggactgtatgatgctgaagttcgaggtgcaggtcccatcatccaggtagtaaacatagtaatcaacaggtagtttttcagtcctccctggcttcctctctttccaccctggtagttcctagtatctattgtttccatctttctgtaccaatgtttaactctcacttataagtgaaaacatgtggtttttggtatctgtttctgtgttaatttgcttacgataatggctgccagctgcatccatgttgctgaaggaacatgattttgttcttgttatggctgtgcagtattccatggtgtatatgtaacacatcttctttaaccaatttaccgttcatgggtacctagcttgattccatgtctttgctgttgtgaataagatggagacttattcacagaaaacaacagaaatttgttttctcacagttctggagactagaagtctgagatgaaggagtcaacagggttggtttcttctgaggcctctgaccttgacttggagatggtgatcttctccttcggccctcacactgtctttcctctgcgtgcgtgcgtgcgtgtgtgtgtgtgtgtgtgtgtgtgtgtgtgtgtcctaatctcttctttaaggataccagtcatattggattagggctgagatcgttaggactaatgatctcattttaacttaattacctctttaaaggtcgtatcgcccaaatatagtcacattctgaggtcttagggtttagcactccacaatgtgaatttgaggatgggggagacacagttcagcccacatcacacctctacaggactcaacattacataggtgcccaataaacacttacttagtggaatgatatatcgtttgaaatggagtgtggtggcaggctccttcagcccagatgatgtgatttgcagcctgcagattcttccccaccccaggcgagcacagatggaagcctactccttctacccctggagtcactgtgcttaagaaaacaaaattatgatactcagactgtatttaatgtttattaggttggaagttctttctttgttttccatttaacaggctttggttaatcacaggagaacggacacaagggagaagagagggttgggatagcctcgggaaaggcacaggaggtcctctggagggaaaagggcctccccaggaggtagggatttctatggagctctcaggatgaggaagagagggggaagggaggtatacagtttggttcttataaacctggctttgtgtttgtttacatgtaggttgtggggataggggtggattgccaggaaactttgagcttggcaccagtctggcttctgtacaggtaatgaaaagacttgaacccataacatggtgacccaccctcaagtcagacttatagctggttttactcaggactttttactaccttttgattcctggtttctggcttcttttttttttttttttttttgagatggagtctcactctgttgcccaggctggagtgcagtggcgtgatctcagctcactgcaagctccgcctcccaggttcatgccattctcctgcctcagcctcccaagtagctgggactacaggcgcccgccacaatgcccagctaatttttgtatttttagtagaaacagggttttactgtgttagccaggatggtctcgatctcctgacctcatgattcacccgcctcggcctcccaaagtgctgggattacaggcatgagccaccatgcctggccttcaagtcagacttatagctggttttactcaggactttttactcacttttgattcctggtttctggcttccctttctgacttcctctaagtacctcctattttggtagtagaaatgggatctctggccagttttattcccttggtagttcctgctttggatccaccacagcacacagaagctccaggataaggtctgaaggtctgagtcactctttgccttaaactataaaaatgaatcttttttttgcccctcccacatctctaccattatttgattttttttcccctcagttttttgtttagagtcatacatatgtctaattcctaaatcctaaattcctaatgaactgatttcctatgggaccagagtttgttttatttaactctttaagttttcttctcccacccttcacacagaggtttccatcttgcctttctattctatctgtttagggaacagctgtctattttctagaatgacaaccattttaggtcacaccttcattaagaaacttttgccagctactggacttagtagacatgccagcaaactagagagatgaagttcctaattgaggtttataggctaatggtagaaacaggaaaaaaaaaaaaaaacggtaagtaaattgtctatgtaacatccttcttagttttattagtgttttagcagggaacttctggagtcattacaaatgagttacaataaagaattgtacattaaagaatgatagatagatctctagactttgcatcatggtggagaggacatttagaaaagaatgtttttcttgctgttcagacccagctctggaggctgctaccttctgaggtgtgtataagtgattagcaattcccttcgaggactccccatcagtgtggggcagacatggaaagcctgctgcatctggctttctaatttctgcaaggccatcccttccttgatatgccaagtgagggtgactgaaatagaatccactcttgatgcttgggggatctccctctttctggcagttacaggtgctcagtttgattacaatcatcagtgaggtgtgttcattactgatttcattacccatgcagaggactgaaaaggaggaatcagtccccagcatttgctccccatctttccccagtagaagctaccacggttgtcagagcttgaattcctcatgactggactatagaagtgaaatatcagggtcaatgtctggttctcctttttcatttgcctcatatatgagtatgtcatgaatggattttaacttggtgaaaatttcacaagtgttaaatattactcagatgctcaaagatttccaaatggcaagtcttggtaaatccagatccagcctataaaacaatttattctccctagacattcaatccatctgtcttccatttatccatagttcagattcttggcactgtgcctttccttaggaagcttactatcacaagaggaaaagatcagggtaaggaatttgcttattggataccattttcatgctagactcagagatagacatgttgtatgcattttcttatttttaccataatcttgggttaggcattattttcactattctgcagatgagaactgagattcagtgagtttaggaaaattgcccagcctcacacagctgagcagctgagatgtaatgtaagtctgtgtctacttcgaaagctcttggaaggaaaggaaggcatgtgggagagcatgaaggttgaggaggtaggaagactggaaattgcatttgcattgtgattttacataagaaggtaaaatgagataacattgatttatttatcaaagcatccgtctttccccaccctaagtcttagtgtcataagccttctaggagactaagatgaaccttggagctagcactatggctttccatggcgacacatggccggataggtagctctggatgcaaataagcaggttggtatgagattctggaagaactaagattttggaatttatcttcctcggtcatctatggtcccatctctcatctgtggccagaggaaacttggccttaacattctttgactcccaagtctaatgtcactacaagactttattgagtacaagggaaactccttttgggggcattgtgcctgacactgggagatgtggtctctccctgacatagtttaaactctatctactgggagagtacctgcttacaaatagcagagaagggggccaggcgcaggtggctcaagcctgtaatcccagcactttggtaggccgaggtgggcgaatcacgaggtcaggagtttgagaccagcctgcccaacatggtgaaaccccgtctctgcactaaacatgcaaaaaattagccgggcatggtggcgcgcctttaatcccagctacttgggaggctgaggcaggagaatcacttgaacgcaggagacggagcttgcagtgagcagagattgcgccattgtactccagcctgggcaacaagagcaaaactctgtctcaaaaaataaataaataaataaataaataaataaataaataaataaataaataacagagaagacataatgtcacatgaacttgcagtatacacacacacacacacacacacacacattcattcatatgcacacattcaaatgcaaggcatgatcacaacatttttattttactctgctgtgttgtatatatgattaacaaatgcatcatcagcagtttaggagttattgtcaacctactccaatagtttcctataatcagtgttaaaaatccagttttccatagggccgatgacataattagaagcaacaatagttcattcccctcagcttattctgagtgaacagagaagcttcaagcacccacctttagccctactcttgcctttttcatcagggcttggaagacagggagtagctacagccaggtatctgactatgagggatgcggggtgagaccacttggtgccagctttccccaagaaggctattcagggctttctttgtctgcccgacatcagaaagcactgatctgtcgtggtatcgggaagagagttctgtgtaggctctggggtcagggagaggcagggttttatcttggctgtagaggatgcttcaggatggggaagagggcagaagtgggatttaggagattattatggggtgctcagagaaactcttcttcttgagggctggggcataattacaagggaacggaaaggttgggatcatagaaagaggaacttgggagtgaattttcttaaaatattaggaaatcagcatagtgtagacaggtttacaagcagaagctctgaaatattgcctgtatcaggatcctggttttttgttttacttttgtaaacttgcaaaagtttcttaagctctttatgccttagtaagatcagcagtcacttttatctctttgtccatcgtctcagctaaccttatttgatgtctacaggtggatatgacaataacagtcaaagaatttgggaagctggtatagctttttctttctttgtgcagggactttttttgaaatgttgttacagggtatgcctagcctgtattgttttagtgtgtcagaaagtgtggcttttctcttctaattaagtggtttgattatgaatctcttgggtttttttagatatagtgactaattcactgggaattaagcagaattgccataattgtggattttggttctatttcaggtgtacttccagtaaatggttacaaaaataagttcccaaattaggttaaacaatggaattttgaaggaaatatgaaaatacagattcctaggccacaattggagagattgattaatcaaatgatttgttggtttgaaacccattgaactatcctcctgtttcaagaatttatctataatttaaaaatgtttattaaaatggaaaatttccatgccctaccctagagatactgaaacagagtattttgggaaagggaccaggaatcttcatttgttataactatctcctattaacagttttaagcctatggactattgagtctaagactctcctatttattttctcattttttagccaccatttaccactatttaaccagcagcagcaccctgaggacctaagttacgtaaaagttttcattagcagccattcatcaatgtcttgcactgttcgagatgtacttttttttttttttttttttttttttgagacggagtctcactctgtcgcccaggctggagtgcagtggcacgatctcggctcactgcaagctccgcctcccgggttcacgccattctcctgcctcagcctcctgagtagctgggattacaggtgcctgccaccatgcccggctaattttttgtatttttggtagagacggggtttcaccgtgttagccaggataatctcgatctcctgactttgtgatcctcccaccttggcctcccaaagtgctgggattacaggcgtgagccaccgcacctggccagagatgtacttttgggaagagatgttgctcttctgaatttctaagcagacagggaggaacaactgagaaactctcagcctcccgcaagggctctgaggaggccttggaggtcaggagccagcaatggagaattaagtctctcccaagaagttctcccagttttggctgttcagcctttttcacttatagccgaagactttgtgttgtcataagaatccagtgaagtgtgagatatatgcgcaatctgaaaaggtataagcttgtaggatgataacctaggcaaaggtcttattgtgtgtattttttgtttttgtgttttccttccctacagctggcctgcagagattacaatgcacttcttaaaattccatgcagacctagcaaactttcatttagatgccagcataggaaggaagatctcagtgtatgactggatgtaatatgcattctcaagtctcccccttcatagacacagtgtacgctacagagagcaaagtgtaattttaagaaccttgtaattctttacaaattaacacagcagatggtgtttatgggagccacagagtgaggaatatttgggacgatgtgagacatgtgttccagggtttcggcctgctttctacatagtttagtttttaactgtcatgctacaaaaattccattttgcctcataaagttttcattggttccaagtgtgagggaatgccccaagagatagtactagtatgacagactccaagcatgctcagtgaggtccctgattcacctaagcctgaggagtgccagtggcttgcaccttcgtgttcaggaggtggtagtctcctgggtgttggtgctggggttgggggcagcctggccttcccccagcttggagatcagtttgagaagtcgaggaagagcacagagcttgataagcttcacccaaagcaagcaaaagacagcataagtgggctaacaataaggttagcacctctagattggggcttgttagtgtgcaaatagttaaaatatttctttggttgttttaactgttcatataattaaaaagaagaccttatttctgtgctagttccctcataatgttaagaattaaagtgcttgggacctgtgtgcttgctttgaagacagtgctggcattttggagggggacatgagagggagaaaacaacgagatagagattgaaagatggtgctgccagagaggacaggaagaggtcattctcacaggctttggcaaagacaaagagaggtcagagttgatttgggcaggcaaaacagccctggctctggcactagagtggagatacctttgggatcccctaggatgcaaagagtccttggtgctcccaaaccttgtacttcttctgcccactggcacccacatactttcctcactttcctttgctgcggggctggcaatgggaaaggtcctaggtgttctcaaacacatcctgcctccttgttccattaagggttctcatctcttagaagcaccattttatcgaatctattctctttcagttcctactgttttcaagcttatctactcccaccactcactactttgataaaagccatttactctttgtacttcttcttccaagggtatatacatcttaatcctatgcatacaatcaaaagctttggctcctagaaatttccatctttttcccgcataggggaggtatttgagcagggaagaaagggaatgagtgtataaagtgtaaaaagggaatgagagtaggcaacaatatgactctaccgttggtgaagtcgcagcgagccaccaattccacctctgcacctagccttgtctccaaagatcggtatcatgtaattaagccaagtagctagaatactatttcattcatagccaatacatatttatatgtacatatctatacatatttctaatttgcttagcaccgattctgtgtaaggcactgtgccagaaacttcagtttcaaggaaatgtaatggtctgacactttcctatccttgggcagctgtgcctttaattggataaaaaaaaaaaaatgctcatgacaagtttctgaacactacaggatagtaatgatgcagcttatattatttgtataccgtctgacatcggaaattcaattaacaatgcaagaggtttgcacaatatagaattatttccttggtgagaattgttcataaagaaccaaataaatggtagagatggctataggcacacagaagaggctgggtttctgtgaactgggagggcagggaaggggtgatggaggaattacaacatgagctggctcttgatagaatggtaaatgaggcacagggaggtcaagactgtggatccccacatagacatactttccataaattaaggttaccctctgcctgaatgttttctgatttctgtgaattctcagcaatgtggacccagttattgacctctttttgagatggtagaaaaatgccagactctagggattctttaggtgttgaaagctttaacagtagctgagtggtttggggaatatgcacttaaaaatgaaatggaacttttaatttcattgaaatttaaattatttattcagtttgggtatgtgtgtgtgtatctgtgtataaaatcaatgggaatttgcacttttgccttaactacttttatctcaactgtaaagatgaaatggcattttttagcagtttgctcagttcatggtctcttgcaggcttagaaggggtatgtggttaattaaccccagcttttagcaatcacccaagctcagggggttggcactatgaaaaatgtcttttatgcagggttgcctggcaagtaatcactgaggactacacctgtgttgataaaataaatcaaggaacaagaattgtaaccttacacaggtgccaactacttcctatggctttgatcagcaaattgtgaagtgggtgaaatttatttttaggactccatattttccaaatcatctatccctttcatacctgctgcctatccccaggtgcctacttggaccatccatctttctatcaataaacaagcatttcctgaccatgtcttaagagtttcatcctgagttctttgggagaaaaccaggcacattctactcacaaaaagcttgggttgtattctgcagccgcacaaaaacttattaggtaacactaggtagcatactgtaaatatatgcatggtttggcacactacctacatgaaagatgtggtcagaggtgggagattttgagcttttctttgaagaatgggtacaacctggctaggtgaattgtgagttagaaggggaatggccccttccagtcaggcaccaatatgagcctataaagaaggaggacgtttgtgagttgttgagaaaatacaaatagattagaactggaccattatgaaggggagaccagattctgaagccctaacatacaggcccaagaaaaaaaaaaattaccattcaacctagcaatttcattacttgggtatatacccaaaggcatatgaatcattctaccataaagacacacgtactaatttgtttattgcagcactcttcacaatagcaaagacatggtctcaacctaaatgaccatcaacggtagaatggataaagaaaatgtgtcacatataccatgaaacactatgcagccacaaaaaagaacaagatcatgttctttgcagcaacatggatggagctggagaccattatccttaacaaactaatacaggaacagacaaccaaatatcacatgttctcccttacaaataggagctaaataacatgaacacatggacacaaagaggggaacaacagacgttgaggtctacttgagggtggagggtgggaggaaggagaggatccgaaaaaatatatatcaggtactatgcttagtgtctagtgacaaaataattcttctgtaggtgaacttatgtcacaaaatatctgcactgtttggcacactacctgcatgacggatttgatgtgacacataatgtgtgtgacacaaaatgtgtcacacaaaatccttgtgacatgagtttacctatataagaaacctgcatgtgtatccccgaacctcaaagttaaaagaaaaaaaaaaaagattcaaaaacaaaaaaaggaaataggagttcagtaaaatctaaacaagaattcaggaatactgagctgaggaaattaaagcttgttcttagcaggccttaatgaggatgatgagggaacgcagtcaacaaaggatgctgtggcattcgagatctccactgtggtgagtgggtgtcatggaaagagagatttgaggaacagtatgaatccttatagactttttgatgggtggtttctcaaggttagtaactaactggatttaggggagaaatacgatattaagatttagagctgggtcagtaatttgtgctggggaaaaccctgtgaatgaacctagatgccctgccaagacatgaactcctcagacagtgctccagaccttgcctgaggtctgccctgatacccaccactctgctttccagttactgcggcttagtattttaagatctctggtttaataagacccttttctttgtaagtgacagaaatgccacatgaataaacatggaggcatttattaactcatggcaccaggtaacccatggatagaaacttatggctttaagtgcaactagattcaggaggccaagtgtgtcattcattgacttagaaaaatttactgaaaacctgttgcattccaggtacaactccaggttctatataatgacaagcaaaacaattattttataggttaatgtgttttatatactaaatgcttgtgtcccctcaaaattcaaatgttgaaacctccaatgtgatggtatttggaggtggaggcctttgataagtgattatgtcatgaaagtggaggtctcctgaatgggattagtggaggcctttgataagtgattatgtcatgagggtggagatctcccgaatgggataagtgcccttataaaagagaccccagaggactcccttgcccccttggccatgtgaacacacaaaaagaagacagccttcttggaataagaagtggaccctcaccagacacagaggtctgccaatgctttaatctaggacttcccagcctccagaaatgtgagaaataaatttcctgttgtcataagccacccagtctatgatatttttgttatagcagctcaaatgaattattaataaaagaacacataatggaaaatatgaaccattttgatttgactccaaaagctgacttctcttttcttcccctccttcttcttcccttaaatttctttttctccaattcttcatccctttcttgccgcagtttctctcatcatctctccctcctgtctctctgtctttctccgtcttcctctgcctctccttctttcagctatgctcttctttttgtggggtctatttttggagactccccaagtagttcaaggtttatctagtaccagtttatcaatctcagtgggaaaatatgtctccttcctaataattctacctacaacctgtgattctactgctgattctcactggtttggatgttattatcagtttgttccctgcccacagagtcttggttgggagttacgagggctgctactgaaataacatggatgggttgatggggggatgagaacaggtgttgatctctctgagccagtcctgctttgcgcattgtccaaggcatatcctgatattgctctactatcggatagggcctggtagtctcaccaatattaccatattcttacattatatattgaggattatttctttgaaaatggatgcagcctggcagagaagaatcagagatacatcagtgtttcccttttcacctttacctccttcccttccccaccaccacctcagagaccaagaaagctaggttgtgatgtggtcagagtatgttgattatagatttgctttgtggccactgttcaactttcatccattctaaagagatactgcctgtttcttttccaagagaaatgtccttagctagtgaaaaggtatatttagaaaggtccacatgctccaactaagatttatacataatataaagatattatgaaatgttcaaggttctataaataatggtgctatttgtactaaggatatgatttctatatccagggtttcagggtaggtgggcaaccctccaaaaatgatagtgtgactgttggatcaatagataattttttcttctccctcctgttgtctaaattgtaggtttaaatgacagcaaaatgtgttggagatagagtgcatggcatattattgctttctggcattctgatgattttgacttccatttctttcaaatgacaacaatttgaaaactgggcatttgattagctcctaaaacatctaatatattacagtcacagctacatgatattttgaagattccttatacattcagtcatgtctgcaggtcccttcaagggaaagaaaggaagtgataaacatctaccttcttacaaccatgtcccacatattaatatagtaccctgaaacatggttgatgtgcagccatggatccaatggaagcaccaagatggtcgatttatattcccagggcttccatgagagaccccccagaactggattatgtgtttatggtaggatgaggggctgggatgggaacagcctttaaagaaatactcattttctgggaggccaaggtgggtggatcacgaggtcaggagatcaagaccatcttggctaacatggtgaaaccccgtctttattaaaaatacaaaaaaattagccgggcgtggtggcgggcacctgtagtcccagctactcgggaggctgaggcaggagaatggcatgaacccgggaggcggagcttgcagtgagccgagattgtgccactgcactccagcctgggcaatagagcaagactttgtctcaaaaaaaaaagaaatactcattttcagagatttataaattaataatttttattgctttttgttttataagttagggagtcagtatcagttgtgtattattcagcatgtttatataaatccattacaaacaccttcagaatttcagaaggggtgatgggtatttatatagggagacagtggggtggggatccttgtccaaagtgggccaaaggaggggcctttattttgcaaaggggcaaagagcagtgttattaaaaagaaattgttgaaataaaatattgttctttttctgaagattaattgtaaaaagagaaatttctgttaatggcttaatccttctatttaaggacaaacgaaatataaaggtcttcaaggtagtatctgatcctttagcaaactggacttgaatttaaagccagaggatgggagaataaaggatctcctattaaaaatccaagtcaggaaatttattccctttgctctcatgaattcaagccatggatcttccccaaatgcgttttgtaaaatagttctcaaagactaaaacaaataaagtttaataaacatgcatctccctagcacaacagatggcaactagggaaggtgcccacagcaatgtagagagtagtcccgcctggcttcgttttttaataacgatatttattaaatggctatgtctattgcacactcattctctgcaggtaaagataaagaagaaaagtggggagcaggctcaaaaaaggcatataagttctgcggacaaaaagcagcagaggaaatacacctcaaagtgagattttactggtagcctttgaagagaaacacatgaaactatgaaatcacagaatcctgaaattttagagaagggagatcgtttagatatggaatggaaaaagccctggctgggagtctggaggtgctggtcagatactaatgagccaggtgatcataatcagtcacttcatctctctagaccttgctgtccttatctttgaggggaatgaggaggtgggcaaagaaagacagctaacgttgactgagttaactctgctggttaggtattggctaaacacattacagggcctatgtctttttatgctccccaaaagcaagcacttagccacgttttagagaagagaaaaacttcaactgcctgtcaattcccagccctttctgcagtgttatgattgtttccctgtaacaggaaagtatagttacaggtgcttgatggtttttctgcttctcatatttcacgattccataattcatccttggccctttcattctacagatgataaggttggagtctagagatgtggccaggtcacttaggtggttattggcagagagtggttacaactaattggcttttgtttccttctgttcagcaaaaacagggaataattggatgactgacttaacaccacacattttgcttttattattaggtgatgatgtcaaaataaatacttacatctgctttcacttcagtttgttaaagtatgcttaatttgtagagcctggagggtcagggatggagagctaggtgaggcttctggttgactcctagggaactagaatgtgcttgtgatgatcaaatccttagttactagacaaaatatgtcccaggacctactgtgtaaaagactgaactggagattctgcccctcatttcacctcttagaaatatctcagactagttgtgtatttaaaatgaactgccccaaatattgcctttttaaagggagagaactttttctttagggataccagtttttggcaaggttttcgtacattatctgcctggatggagaaagcagaaggacaggtgatccaaaaatagtttctatgtagtttctaaatcaattctttcattttttttccacatcaaaaatactttcctaattaccctgaatagtctaaatgtcttttattgtttctagcacattgccattgtgattgatcgtcctgctaaccttgtgaagaagacagagcatatattatgctatccattgtgcttatgacaaaactcagacttttaaaaaaaaatggggtaaatggttagtcaaggatcatggaggctaataatagggagctgatactaggaggcaagtctccgctccttccttcctccctcctcactatcccccattgctctctccctttctcctctcctctttctccctctccgtctgtgtctctgtctctctatctctccctcttttcctctctctgtctcactctcagtagctggcttcctgtccagtttaaactgatgaatttaaaattatggccacatttagacatacagagctgaggaaagtaggacataatggcttccaagttcccatttgctgtgcaaagctgagcgttgacaagctactattgttattcctgcacaaataccttattttttaaaattggagctaagaaagggccagtaaattgactatcccatccagtggcccaaatttcctaaaccctagtccttgttttaacattccccagccttcatgtacagtcacaacaaatatggctccagagtcaacttcatttctgaattgttttcagccaaagactttgaggctggagaaacccaggatcacaaatattacacaaacagaatccggacaagagtaacatggaatgattaatgttaccagagattctctgggcttgcagatcaaaataaagttagtagtaatcacactataaagaagctcttatagaaataatttgtctctgtagctagtcaaactgatctcttcacatcatggagaaaaagctggctcatttcactcactgccttcccagaaccaccttgccttcttgtctacatgactttctttttgccagtcaaagtgcctctctctttcctattctaatcttacccagggcttaaggtccagctaattttctctttcctctgtgacttgacttcccaaaggcaacatcttctccctcttctgagcaactcagtcattgagcgtgctaatctttctgcacagtttttggtattgttctggtcttgtgttctggtctattcccctgtatcaggagctctttgatggtgagaattgtggctatcacttttcatgtgttccccacagggaccaataggacgcctcacatctaagggatgtgtgttttacagttgcaggatattgatgccagaagggatacagatcccacatgttgcccttctgctcacagaatggggcaaccaagcctcccaaacgtgtctgtagcaactgcagttacaatcttgaacatgactctttcccctgggggtaggattgtcagattcagcacataaaaatacaggatgcccagttaatgtgaattttaggtaaacaataatttttaaagaataaatatatccgcactgttttttaagtttaaaagtttaaaatgtcatctgatgctgcatttgcacaactcacctcattcaccctaccctaatcctagccctattggatcctgtctttatttaaatttttgatattttattttcaacatggatttatttgcgttagttttgattttaaaaatattacattaggtcgggcgtggtggctcatgcctgtaataccagcacttagggaggctgacgtgggtggatcacaaggtcaggagtttgagaccagcctggccaatatggtgaaatcctgtctctactaaaaatacaaaaaaattagctggacatggtggcacatgtctgtaatcccagctattcaggagactgaggcaggagaattgcttgaacctaggaggcagaggttgcagtgagctgagattgcgccactgtgctccagcctgggtgacagagcacgactgtctcagaaaaaaaaaaaaaaaaaagtatgtattacattaaaatattatttatcttgatgactgagttccttggtgccaccttaaattttgcatctaaattatactccctctctccctcttcactctgttcacaccagtcccaggcccatttgattctcattcttctcatctgaaaagtggttgtatagatatggcactggcaggatggaataagcccagagtctggcatttacattcactcagtaattattttgtgtatctaaagtgtctcaatttttttcttttcactttgaaaagtttagtaatcgatcctccatctgttgcagccaagttttcaactaaactcataacttttaatgtttgaaagtaagtttttttattctaataaatgaataggccacaggaaattatgattttcagaaggatcatggtccagagctccacataggtgccctgtattttgatggcagacaacctatttgcaaggagagaaccaaacagaaaaggaatagcctttggctgctgaatttgtggcagatctgaacttggagaggcagagcattgaagtcacactcactgcacaaccacattcccttgaaagacagagcagcacgttattcttctccatacacttttgttttcttggagctatttgtaggctgatatttcaaagttgtaaaatgttagccactgtattttaagctctttctacttaaaaaccttagtgtctacatctgaaagagtgagtgtgtgagtttagggagtgggaaaggatgatggggaatggtaggattttagaagactaaaaatatatgcacatatgccttggtttgggctttttaatgaaaaccctatagggctgtgcatcagacatttgttcagaaaaaatagttaattaagcaagtggcagagaagagtgactactttaaacccagctatggagagcgggtatgtatgtatcagctttatgcttcccggattttgtcacggaaagagaacatttagaaacctgttggatggtaatttttatgcattgccaaatcatgttatcccattaggcacaacttaagatctgggatctcattttatcatataagcaaattactacagggacctacatgattttatagagactgagtaggccacaataattgacttgccactagcaccataaataaatcaatctgtagcgtttgactaaaatttagataatttaatcaatttgacaaggtttttgaaaacatttatcttttaaggggaagattattgtcatccataaagtttatagagcttttcatccatgggaatcttgttgctcttttaaaaagacaatggggattcttttctgttgagttttaattgtttttctgtacccaccaaaaaaaggagaaaaagcaaagaaataggaaactagtgaaacttccaagtgaacaatttattaaagaacacttttttttttctctacctctgcctgttgtagtcataagggaaattttcctcatgacctcaagctgtgggttgcttattatcatttttagcattccactacatgacagagcagagattagcaatactgtattttctagtaaagcatctcttttgaatttgatatagaagttgcaatatggcttaaaaaatattggtataaaattccgaattctggtgatttacttaaaatctttttcgatttagtttttattatctcagttatcttctattcagaaatgtgcctacacaatatagacacacaaagcatttgtatttgaaggcaaaaacaaaacatccttgttatattaacttaactgctaagcgtctggaggagggatgaaaacacagatttgtgtggagttgaatatggacatatgtgtaaccatcctgagaacgtattggtctttatcaattttaattattatttcaggaaaaaccaactttagagaccaaatcatgttatagttatgtattgaaaataatctttttaaaaaattgtttgaatttaacttctcatgttttcctgatttttttaaatttttaatgtctctaacattgaatatgctaaatcagaaattatttctcttttcttaatagactggaaggaaagaaaaaggagatcctctcaacattgcgattgataagatgactaagaaaacaagagatctaaggagacaggtactattttttatttttactttaagtccatgatattcagtagtggtttccaacaatatccttttccagggtgtcttcttggagatgacaatgaggttgttattctttataacatttacatatacaaataaaaaccccattttatcggcaaggtagagattgctggacagagacgagccagttgcaagcaaggagacagttcctgagcaggtggcttctcactgcccagatccaatctgtcccagtggagactggatgaattcactacttctacatctggtctttagttttccaaatccaggtatgccaagagcctgcctctgatctttgctggttcttacttatcaaactcccgggaatttagtgataaaccagaatgctaatggttaatgagaaatacaactcttaatctgatgggttaattaaggtctcttggccagtgtattcccttgggaacataaatctaggagaaagtttgcttatcagatggttgtttgggaagcagggaataaaatggctaatgacatcattagtttgatgggtctatttttcttaacagggagaaatctccggtcagggccctttttctccttgaaagtgttgtatgaacgctggtaaatgttgccttagaaccctgattttatatgtggccatgatgaactcctctttctttggtagtattatttctctgaaagagattctatcacccactgagttataataaaaccccctcttcttgatttctgcccaggagggcagaatcctgtctcctgctgtagctttggctatgtccatctcattcactaattgttgactgtgacagccagctaaaaccaaccactgccatggcagcacctgctgtattttctgcagctgaaacaattgggttagcatggccacatccagcatttgctcctgcagtgtgttaagtacaaacaaaattagcaagaggcctgggcgagaatggccaagcagcaacttggaaatgatttgaatgagaggaacccaccacttctgatgactgctggggagcttcttggcttttatcaagacatcacctgaaggtgtagacacacttgatctggtgtccttcagaagatatcacaattatttctggaatatgaatattctagctccccagctaacaaaccttttgggggaaacattcccttttactttactttgaaataaggcagaatacaacattgtccttttaggtattagtaactaacagcaaatgaatatatggccaggtctctatctctttgttctcttagatcatctctacatatccccatttgatatgaaatgatatgggtggcaggaattgggatggaggttagttgaaaacgctgaattagatatcagagcccttggttttagtgttagctctgccgctaaactggcagtgtgattgtggatccttcatctcttggtcttacaaaaataaggagccaaactagatctgcaaactcttttttttttaagctgtataagattgtgtgagtctaagggatattctcattcctatgtcagaggtcccaatgactgataatcacagatttttaaaagcagtgggaggacatctccaggtcttgcctttggctagattgtcaaccagctaaaattcatgaactgggtcttcccatcttcctgatcccttggtctcagtagtgattacatttttttttacattcaagaacaagccccctcagctcttttcaatcatggaccaatcatggcaggattattattattattactagaaatgaatgaaaaagtaatttttactcttatgttacaattcctggaaagggttgactctttttagcagaggacagtggtaaaatttgaaggtgaaaaattatggtggaattttaaatgcttaggtgacaagctccttggagagcttcctgtaagatggcagtggaaggagtgtgtccttccctgaagttattccatgtatgttatttctttccttacctttctccaaaatatagaggaataagggtaaaaggagaaatgtttcatggtattaagatccaacagttatggcataatttcacactgtatccatgaatttggttgaaacatctttctcttctccaatctgcctttctaaaatgacgatggtccccatctgtcagtttcatccctgcccatatgttgagatatttttgtctttcttctcatctctttgcctccccatgtacacctgtagtggcacaaaagcttctctgatctaaattgaagctacctagcacttgggcagatggaacatgcaatgactaatttgtttggcccaggtaggtcataagcttagatgtgggtaactagtaattagattaacaaggtgttacctgggtctctgatagcccctccacaatagtggctcagagaacgctaatggctcaagcaaatgtatactgctgagatactttctattctttcaattacagataaatgtatgctagagcagattctaaaagagatccctcagtgatcatgtccacttccctgtacacatgtattcctttgtataatatttagagagatcaaatctcataggggaaaaaggtgaaatcaaatattttagtttataaaaaatatttctagtgacatccatcatgtcccgctctttcagtctcctgcctcctcctcatagcgctaagtttgggcagtgcttttcagaagggtgaccctggagccttgaaaagttttagccaccaaattgaaaagaaacaaagtcaatcatgatcattatcttggactttcctaatgaaagaaagtggaattagacttgtagatactcaaagaaatcaagattaattgaatataaaggattttggtttaagtggaattttcaggtaagtagaactcctctcttgaggcaacatatcccaaggaactggggcattataaatggtgaaaaagattatagggacccaaaggtaccatttaaaactgattaacatgaatccatcttgccagtcaaacccatgacagggggcagtggtagagcagaatcctcctaaggagtattttgtttagaatcaaaaatggatttaggggatgataactgccagctttaagcattgggttctcattttaaagctgtgggcacagcaggccctgtgtctgagctattgtcactgctgtgattctggaatcagcccagtgtggaaacaatagctcttggctgatgccccttctgggtgcctactggcccacatggtctgtccatcccccagagaagactcagtcagtttctgccaactgtacccctattcccttttgctctgtgccacctatgaactattctaggtatgatctcttaatttttcctacaattacagggatgctagttgattctgaatattatttttgtacttttattagtccctgattttccaagttgataaatcagcacccaaacatttctctctgagaagctaataaataatatctatgacattgcaatgttgctaaacttagcaactctttcactccccaaacaaatcaaaggcctaattcttattccttcacccttactagccaccacaatgagtccagcaatgagatttagtgagtgtcaacctgacaaaggtctcaattctattattacaatcaaaacatttttaacaatgagaatttatatatagaatgcttttgcattagggtgagtacttagaatagtaatataacaaagcattaaaaatcaataagcaaaacatgttattggatggaatgtttaaaggctgattcattaatattgtgtttccaagtagtactacagaaaaatcttccaagattaataaaaaacaattacaactaaaaaattccttagctgtctcctttttgacccaattccttatgtacaaactctggctgaaggtgaacagttaccatggagagcttgtaaaatcactgtccataaaatgtaaactaatttataacccacttgtattaagtctttgcaaggtgcctggaactgttctaagttatctccatgtattgaccacatttaatccacacactagctctaaaagattgtcaccatgctcattttacagatgaggatgtgaagccaagtaccgtacctgatatggtttggctgtttccctacccattcatcttgaattgtagctcccataattcccttatgtcatgggagggacctggaaggaggtaaatgaatcatgggggcaggtctttcccgtgccattcttgtgatagtgaataagtctcacaagacctgatggttttataaaggggaattcccctgcacacgctctcttgcctgccgccgtgtatgatgtgactttgctcttcctccaccttcctccagggttgtgcggcctccccaaccttgtggagttgtgaatcaattaagcctatttcctttataaattacccagtctcaggtatgtttttattagaagcgtgagaacagaccagtacagcacccatggccatatagggtgtggacgtatggaagctgcagccaggcaatctggctgtagggtcttgtactcataaattttactctatcctgcctctccgtagaaccaacataagcatgtgggtcaaccatatactaatgcactctgggaaatacacgtggggaagaaggaaggttcacataaatacgtagaagtgctttgaggttttgagcagcacctctacaactctaagatttggaattggtggcacgaatgcactgtgaaaagaaagaaaaaacacaactatagtaaatgtcaaaaacatggttcttgtttgtgatatatcatctcttgggtctccagctgttatggttcattggattctctttttaaaaagtgcaattatgtttaggtatctggcctctcaaaacatgaattatagactttccagaacaattacagaaaaaagagaatgttaaggcgttctattgtttttctcacatctgctcatgatagggccaattatttttaagttcattgtaaaaaaattttaaaaccatttatttctggatttgaatctgtttttcttcataaggatatgaggctatctacatggcaacaaaatatattacagaatattgagttcctccaagtgttaaggtttgtgttctgtaaactgaaaccctacataagagctaataatccctggagtttggagtctaggtcagattgtcaagctgctgtggaaacatggagatcagaaaatgatcatgcagcaaatgggatttgaaatacaagaaacatgaacccagagacagctaaatagaaatgggatcagaggctgggcatggtggctcatgcctgtaatcctaacactttgggaggtcgagacaggaggatcacttgaagtcaggagttcaagaccagcctgaccaacatggtgaaactccgtctctgctaaaaatacaaaaaaaaaaaaaaaaattcacccggcatggtggcacgtgcctgtaatcccagccacttgggaggctgaggcaggaggattgcttgagcccaggaggtggaggttgcagtgagttgagatcacacccctgcactgcagcctgggtaacacatcaagactctgtctcaaaaaaaaagaaagaaagaaatggaatcagaaacaccaaaaattagaatcaaaaataccaggaggagcggagcagagtaggtagtaggttggagtgcaatggtgcgatctcaactcactgcaaccttcacctcccgggctaaagtgatcctcttgcctcaggatcccaagtagctgggattacaagcatgtgccaccacgcctggctaattttttttttttttttagcagagacagagtttcaccctgttgtccaggctggtctcaaactcctgacctcaataccgtgaaaggtcatcctttggatgtatcccttgatgatgggtagtacagtcacgctacctctaccttaggaaaatcctgataaaacaaccctaaatgtcagagcaccatttacttatcacctggaaaatagtcattaggccaagtccaaagtacattatttcatcagttggaaacggttcttgaaatatcatcttgggctagctgttctcttgtcaaggtactattcaattcacaaagtggttcaatttatttctataagccagcatatggttgattgttcacacattggcttgacactagcaagtctagatcacacaaaggagcaaagagtctagtagcttgatcaacattgtttcatcaaatggtacactatactgagcagagggatctataacgtaagtatgaacatgaaaactctcaatgaagtggaagcttcaactactgatttattcttttctgctaatttctctaggccctagaaatcaaggaaaagtgggaagggaaggagtaaatagcaatgactgagccccaaaacaccttccagataatgtctgtgtttggttcaattcccaacaccttcttctatttttagcaaagagaataataccattaagaatcctgatcctgagactggaagatccactgtaggattatgaaacaaaaatgccatcacatttttcagcatgaaattcctaagcagggaaacttagaatattttcaaccatggtgactgaaataacaaagattgtttcatagaatgccctttcagtttaccagaacattcattttactacacccatcctggttaagtgaggttggcccatatttgttgttggaggctgtgtttagactgggattcttatccaaaactgtcactgaaaacgagataattttagagtgtgtggtgcatctaccattatggcctgaattgaggtgtttctagagctgatgataacagctaatcgccttgattctgactgaatgtactcagtggatctttgcagtcagcttgtagccaaatatatctgttccatttgacccctccttgctgaggttaccttttattacctgaaatggcttctggcatcatctttcccaggggaaatttccatcaggactgctgatatttctttatctccccatttcctgaggaggctggacaaatctgaaattcagaaagtgagtcatcttcctgcaggctctgccatgcctactgtcgccaccagtcctggtgggagcccatttgctccaggatgtcctcatattgtgccttagtgattcccatggatgctgctgctgatggctgagggagttcaacattgctctttgcttgggtggaaaattgtgaagaagatgatgctagttttaacaaccctctatttacattacatgcccttgactcatctttgtcctctttttgagctgaatgaaatttccagattatcttaaaaccaaaccttcaccccaccatggctctacacaattatgtgtttcccactgtgatccacttttcaagacagtgacagtcccacgcaactcctccttttgttattccttaaatctccgtcagtcattcaatccaattgataccacctcctaaatgcattttgagtccattgctcctctccactgccattggccctaattcactgcttttcacacacacaaaagatggccatggccacaacctcataaccagtatcctagaccccagcctcctggtagctcctagaccccagttatgattgccccaacagtatcataagccagtgtttccagatccttctgcctttgcacttgtgttgcttctgcctggaatactcccaccaccctttttgttttcttccaagaaaactcacatcttttcctaccaggcttagcttaaatgtcaccttatcatcacaactttatccaattcctgtaaacaggatttatccagtagactcccaaagcatttaaaaatatctctatcatgacacattttgcagtgggtttagttgtttatttgtttttgccagtgctcatgtctttctagtctttgtttcttcaggtaatatcctagtgcccaaaataaagtaagcctgcaccacacaggtgctgaaagagtgaagaatcccctgtctgtagtcaccgcacccaggaaatatcccaatcatcaacttgcctccattctaaactcacatgtctctggttccattgtctcaagggctaaaaatgctagtctaaaaagtctacttatattttgaggataatttccatgattaatgaggataccctaatccagtagtttcctgttactcagttggcttgagaagacttagctcaagagcagctaaaatgaagatatttgactccattttgggagattctgacttcatgtacctctggtggcaccttaaaatctctgtcataacaagcttcctacttatttctgatattctcccatgtttgaattccactgtctttgtttctgatagatggaactttcagacctcatcccagtccctcaggtggtatatctgaggatttgtgaggccttccaactcttctgcaatctccttggcctctattagacctttccacttcacagagtcaatacctgttttcaggggcagaaaatccatgtttgaggcttgtaagagacagaaaaaaaaaaaacagtgttttgccacacactctccatagcacacattacctctagtcaccaaaacgtatgcggtatgattttccctcactgactagttctttgacaccagctgtctgtcctataattcaattctaacactatctacctggagataacttcagatttcatagactaagggctcattttcacaagactgcttctacttcagatgccagttgaaagtagtaggttgtcacctatatttctgactgaccagctatacattgggggattcccattatccctccctcaggtccacctaatttgccagagtggcccacagaactcagggaaactgcacacttttacctatttattataaagaatattcaggtgagcagtcaaatggaagagatgcataggatgaggtatgtgggaaggggctcagagcttccatgccctctgtgggtgcaccaccttccctgtacttccattttttcagcaaccaatagatttccaaactctgtccttttgagtttttatgcattcataggcatgattgattaagtcattggccattggcaattaactcaaccttcagcttctctcacctctctggaggttggggtgggtggggctaaaagttctcaccttctaatcacatggttggtttcccttgcaaacagcctggatcctggggctatccaggagcccatcaaaaattgcctcattagaataaaagatgctgtcacccaagaaatttcagtggctttagaagctgtttccaatgttaccacctaggaaattacaaagattttaagagttctgtgtcagttactggggttaaagatcaaatattagacaaaagattctcctagtaccccttatctacaagggttttaggaaccagggcagaggtctgaacgaggggttcaggaaccaggggcaatggcaaatttatatatttctatattatatatttatataatttataatatataaattatgtttaatataaattatatatttatataattctatatatttatatatttcttattatttcacaaggctcctctcttctgggcataggttagaagtgaatggtctgattgttcactgcttcttattgtagggcttggaaagatctgtactttctggagcagggccaggacaagggtaaggcaagtgaggcgtagcctcaggtgcaagattttaggggctaccaaaaagctcagtaatcacaataaataatattgtgtgcaacactttaaaaaatcaaaaataatgcagaaatccatgatgaacaaaacatcaatgttgtaaataaagataggatcatcataaataagatagtgcagtgttgagtcatgttgaagctggaagcaaaaggaaaatcagcaatactgattctgtctgtatttacaatgttgctgttttcttcatcatggacgaacctcttgttagtcctggctgtgctccagagcctctatctatgaaaatctttattgcacctgctgtaggagaaagttcccccgcaaagtctcaatgtcagatggctttctttttcctttcacagtagtgacaaaagggctggcttttaaattttatgagatgacacgttggactccagattcgaagacctatttgaattgtggttgtcttttaggttgtcttgctcaaaatgcatttcttcttgatgtttatcacagtgacatgggctttttatggcattccgaagtactttagagaaaatggagaacactttaatactgctgatttactctttcaggtctacagtaatttccttactgcctaattataaggctgggtttaatttactctacacataatgtttactgatgcacatatggtgccacttttcaagaaactgtgcccagaacaggcatttttgtcatactagagtatggaaaattcccatttagtatgatattggctgtgggtttgtcataaatggctgttactattattttgaggtatgttccatcaatacctagtttattgagagtttttaacatgaagggatgttgaattttgtcgaagatattttctgcatctattgagatactcatgtgatgtttgtctttagttctgtttatgtgatgaattagatttattgatttgtgtatgttgaaccagccttgcaacctgcagatgaggctgacttggtggtagtggataaactttttaatgtgctactgtgtttggtttgccagtattttattgaggatttttgcatcgatattcatcagggatattggactgaaattttctttttgtgttgttatcctgctaggttttggtatcaggatgatgctggcctcacaaaatgagggtgtatgtgtccaggaatttatccatttcttctagattttctagtttatttgcataggtgtttatagtattctctgatggttgtttacatttctgtggggtcagtggtgatatcccctttattgttttttatgtgtctatttgattttctctcctttgttcttttttagtctagctagcagtcgattttattatttttttcaaaaaaacacagctcctggatttgttgattttcccattatatagagaaaaaaatagtaatatatgtaattctctcaacaaagaatgtcccccagtgaggggggaaatatcacatatcttcttaacttgaataaggttataatctctttaaacacttattttaaaagcagactagtaagtatgtggttacatgtgtctaatgattttcagttacccccaaaatgaggagatgggtaggagttggggaaaggagaaacaggaaaaatagtactgttttgtggacttatttgttaactatctttgaaaaggagctattgattcagaaatcgtgggttcgtaggttcttaggggtggaagggacactatgggtcttcccagggcaagaggtctttcttcaggaatattaagatgccttttgtttacctcagctttaaagatgggagctaattccttcactacagcagttggtacaattattgggtaattttacttgttagaaaattgagttaagatcagtgattttgtagttatcaaccattgatgttgattttttgctgcaaaactgatttctcttcctatgtctaagccccagataaaaaattcagtaaagagctctacttagagttccagagacgtacaaatattaaacattattgcattcaaagccatggcttcaccaacaattgccttgccttatcgtagctatgagtgctaagaatggttaggcttaggaactgggcatgtctctggtcattgagacaactgaaataatcagccatcttgatcatctgatctattactcctgtttgtatctggttatgtatgaaggtcagaaaagtaaagctgtccactaagactgacagttttttagtgtccattctttacttgattctttattgacgatcgctgcaattcttcagagagatattactatcaaaaagattttttttccgagtagagtattgaaattccaataataagattaaatttcttgctgatataaaactcataagttagaaaaccctagtgggttgactctgaagcctgtccttttaatgactgtggttgttaaagttggtacactttgctcttagtttatagcttttattaaaattctttaatgggaagagcataaggtaaatatcaattattaaagagacctgagtttctctataataattataataataggcttcgtgtctaatataatcaccatttctttcttccttatgccattcatatctgtgtccagctccatgccagaaactgaactgtgaatgggattttgataattattattctaattaatcgtaagggaaaaaacttaaggactttcattttagctgggggaatatctgattaaatgcatatcaggagactagcagacttgcctggtgcattcattgagaaatggttgaatggattgtgcctgagcattccaggattaaaggagaaccatttgtcctgaggagtttgaggataagagtggatttttctctttgatccaaccataaatgtcagaagtttgggtgattaatcagtcccagacccatcttctttccttccataatttcttagtttttcacgaatgcatcaatcctgtttaactgttaagggcagggcttctggatttttatttgattccttcaatttcaacaaggatcaggctgccttaagtagtagctacactatgagttgcaactatctaaagggagtgactgtaaagctaaaaaagcacctttgggccacgcgcggtggctcacgcctgtaatgccagcattttgggaggccaaggcgggtggatcacaaggtcaggagatcgagaacatcttggccaacagggtgaaaccccatctctactaaaaatacaaagttaggtgggcatggtggcttgcgcctgtgttcccaggagaatgacttgaacccgggaggcggaggttacagtgagtcgagatcgcgccactgcactccagcctgggcgacaagagcaaaactccttctcgaaaaaaaaaaaaaaatgcacctttgagcaaggctgggaaaccagaaaaatgggagcgggaggttgctgagttccaaggggcagggagaagtcagcactaatggactctgagcagacttcttcagcccctcctttgaaatacaaaagcttagatcaatgtggccctgaggctgtatctatagataccaaattaactagttgaaaggggatggctgggcgtggtggctcacgcctgtaatcccagcactttgggaggccgaggcaggcggatcatgaggtcaggggatcgcgaccatcgtggctaacgcggtgaaaccctgtctctactaaaaaatacaaaaaattagccgggtgtggtggcgggcgcctgtagtcccagctactcgggaggctgaggcaggagaatggcgtgaacccgggaggcggagcttgcagtgagccaagattgggccactgcactccagcctgggcgacagagcgagactccatctcaaaaaaaaaaaaaaaaaaaaaagaaaagggataacttgtgactgatcaagtaggcattgtgtcacaagttgccatagcaaccagcttgcctgctgctctgggtgcattctctatgtgtttgggcggtctgtggaagtacccttgatactgttgccaaatcagcaggaaattcatgatttggggtccagtccaggtcagaacacctacattaagcaggccagccaacccaactagatacaacttctactcttccatgtaactttcctcttccttccttgcctcaaagcttatattagaaaaggaatttcttagggaccactagaataacctttgctttctagcagagtatgaggcagggaaataacaaaagtcgtttggtcaaataccagtcacactgatcacctgggggctcttagaggccacagttagcctcctcagttctcttcttaaggagatagcttctggacacagcagatgcttggttataagtaagcagtgggtaaatggagcttgaaatagccagagattgcagtagaaacttacgtatagagtgagaggcatataagactaaaatccactgatgaaaccatctagaacaggcatcagccaattactatctctgtcccaaacttagccctctgtttgattatgtaatgttgtattgactgcttttgtgctacaactgcagacttgcgtagtcatgacagagactaactggctcacaaaggacaaaatctatgttacctggccctttacagcggagagtctgccaatccctgctctaaaagtaaacctagcttgagataagacaaatatggtgtaagcacctgaattccctgaaaagctaaaggaccttgaatccaactacgtttctcttaaatagcgacagcaccagtcattttacaggatttccacaaagttgggaatgtggagtaatcattgggcttctatctgaaatgaagtacctctagggaaaaattcagcagctgttggaaatgcaaggctgtgcaatagttaaagacaggaagtaaaaagtattgcatacggcagcagaactctggagagggaaggtagctcagaggtacaccgttatccataactggagtaaaacaggggagtgtggtaaatggttttctgttttagaaagtgtgttgagtcctttactgaccacaaatggccagaaacttcagaggtacatttatcagtgacatctgcaccaagaagtaaatgctcatcattctcccttcctcactcaacagcatcttattcccccaagttacccatcccactccagtgaactgaggtttcactcatacctagagtgagaagtagtgagttttgtctgggttcctccccaggtgcttatatttataatagacgttcttctaagacccacaggacttgtgctgtaatgtggaatgcatgacatgtggaagtacaggccaggtgactctacctggtaccaatcctaccacaccgtaacaggtgtgtaggatggaccccattagaaagaaataatagtttttgagagctcgtctctatatcttgcttcatgctctttaaccacacattttttataggcttctgctcttagcctgccatcaaatccatccattcagtaattgtctttcccaattaccaattaaattgtgaggggattaaatcatttttggggcatattacaagcttcctaaaggtccttgctagggtaaggctattctgttactgatgcagcttttgaccctttcacactgggctcaagaagcttgtgcctattcaccaccagttaatcaatggcagatattagatactcagaataaaacatccaggcatctgatcttagatctccctttggagcaagcaatggtggttgggacataaggctgggagtaagtaatcgactaggggtgggagtgaagaattgaaagaaaagtgacctttgtccagttaggatttgtgaacttcaacagccaggtccataaacacatagatcttaagtaaaatggcactactattggaacccgaacacctgactctggcattttctatatgcaaccagaggatcctctctttcctcatctaaacaacacaaataacgatgctcaccctacaaactgcacccttcacccacaccgtgacattgtaaggaaggtcaaatgaaacaatgtctaggaaagttctctgcaagctataaaaacaggacatgcacaggattattattaaaaataagcagccagaaactgagtagacccttccaaatacgcagaaaagttgacctgctttttggtctgggttcagcgatctgagcaaggtagttatgctagaaatgtcttttccaccttcacccttgccacctaaaatttcacccttttgaaatgccaactcttctgggctaagttagacattgggcaatagaaagaatgcctgttctgatggaggggtggagaaatcttaagagaatctttaagtaataaaaaaaaaaagtgcaatatgatgtgaaagaaatgtagaaacattagacttttttacagtgttgtttaggccagcctccaatacatttgacgggaataactcatgcttacctgtaagcaccatttatgaggccagtcaaccatgtgtgaggtcgtgttgatcgctgtagctttgttagtagttgggagttgagacagtggaggagttttcagcagaaagtgagaggagatggcttgtcttgttttcttctgtatccctggccaaaaacagtgcttcatctaccaagagctacttaaatgccagtggaaggaataaatgacggaacactggcccttgagtacagtttagtaaagtaagtaagtgataaagcataatttctttctgaggacttcttatttctcttataataaggttcctgccacctctgagctaattgcattagtatctgtaccatcatattttggtacgtttactctcatttcgtttctttggcataacacttaaaaatcctgactaaaactgtggcatttgtgtagatttttctttatagatccattatttctcttgagattagaaaggaatttttgaatttcacaattaaaggcaaataagagaacttttttagtttttcaagaatgaatatttctccagtaaaaggaattgcagaggtgtttttcattgagtacattaaaatgaggcacacagccttcaaagtcttatgcaagtgtgagcttctgcaaaactagttgactggggagagatatttttttcttggattgtcttttgcagggagctgtttcatatttatcaaatggttgcagatttttagactttgtacaaaatacttttgcagtattagatgtggctcaatgtacagcatacactcctcataccccacccaataggtagacaacttttggtcatttttgagacagtttgtttttctttttgagttagtgagttaaactgtgtctattctttcacgactgtgtgctcccacgaaataagaattgctagagcaggtatgatctattgactgcattcctttgggtttgctgaagaaaatgcagttatttacattgatgaatagccttaattgggtaaaatagactggtagtgctgagctaatacctttaaatgtcttgtcttatgcaattaatattcctttgtcacacatacgtttaaaccattggaaaaacgtcttgtgttcttgactcctgtcagacttaacgaatgattttgtcaagtcattcctttctgccctggttgattgatagctaaattttggtcttctagcttatgtaaaaagtgttaactatgcctttcagcttgtaggcaagggcatttaaaccattctagtagtcaatttacagaggaattacattgcctgtttactggaggggtcaaaaaaatgtgcccctgctcatcagagacacaaatcacagggcccatgagctaatgaaggcagtatttatgagtttctgcacttgttagctgataccaagttcaagatgtccctggtcctggctgctgaggattctggcttccacttttggatatgcctgtgtttatagactatggaaaagatgtatttaagaagaagttttgatcctaatactcttaagagtgagaatgcaaattagaatgctagattgtcacagtatcaagctgcatttgcagctttcaaagatttctctatagtaaggctcacctctgccaccacctggcttatggatttccatataaaccataattaccatatcaaagcgtggaaaatggataccagtctttctgggagaagtctcttggcccttggcttgaacccagttagaaccctaagaaacacactttctttagcatcttacaatttactattttaaaacattttgatcattaagagttataagaaaatggttacattagagcaagtataattcatcaaatagattgttgaagtaggcctatcttagaccacaagttctcctttttttttccgatccctaaatccccagaaagtgagaatctcatagtgagtatcgagcaggtctctttctactcccagagtagggattcattaggactcagcatcacttctacctctggtaggatcactgattccatcttatggtgtccatctgccatgggttctcttcttttatcctctccacaggggctcttcttctttttggtcttactatatcatgggtggggaagaggggagctttcagaatcccttgtatatatactttactcgttcaggaatcacatttgttcctggaatgtttgctgctgtcatcatatataccattgcttttggtcaataatgttcacagagctggcacaaagtagacaagtgacagcttgtgtatgttagtatttaaagcatgtagtctggggccaagcaatattggtttaaatcctgccactgccatctgttagctttgtgaatgtagacaagtgacttaattctattgtctcagtctcctcacctataaaaggaataaaatagtagccagtgatttttgacagaaataaacaagttattctaattttttggagcagtatctggcacaaaataagcactaaatgaagattgctattatgaaatattaatattccccaatgcttttctgctcttgccacctctcctcatctcaccgctgcagttacttctgtcttttgcatatactctcccttccactagcctctcctttgctttcttgtgctgcacccagcaaccgtgggctccattttctgctaacatttttaacagcaccatgtcaaggtgctgtacctgctagattaagccatctggagatccacaatgatcccagcactccctgggaccctgaggcagcttgtcactgtctcttctcataaaggcaagtgctcttgcatatcgtggaggtaaaggaggaatttgacactgacctgtgcgtgctggggcagaaaatgaaatcaacagaaggaactaagtacctgttactgtccttcaggaaaagtcccgatcaacccttccctgtcctagtccccatgacttgtctctttgttataacattttaagtaaagcatttgtttaatctatacaaatagtaaattacagctgtgattttcttacacacagcccatggctatataatggaacatgaggagtagactactgttatttcagtgcatttggccaaagaaatgaattgaaatggcaccaaactagtccactaattgatcagaaattattttcaagatgtctctaccacttcaccaaaaggtgatttggtgaccatgaaaacttattctatgtatgtcatcttatcagttatctattgtcacaacagtgtagtgttaacagtacctcaggggcatacagcaatagcacttgtagctcactggtctgaggcggtcatcttagcccggccttctcctgtgtctgggttctgttgctcttaatggatctaggatggtcttgacatcgatgactgaggtgactcagtcatggtcaataggttcgtcacccttttcctgggacaggcagtctagcctgggcacatgcttctcatggggatggcagagaacaagaccaagccggcctaacgttgaatgagcctttcaaatgtccacatgcatcatggtgtccaacgtccattggccctaaacatgacacatggccaagcccagagtcacagagggcaggcactacagagttacatggcaatggtatggatagaaggagatagaagaataaggttattcatgcaacaaatctactataattatctattccatcagtgagacatgttcctaacttttatactgactatcagcactcacagagaaaaaaatctaagggcacatatgttgatctggctgttgatctggctccattataagtgttgctaatgatgacagttgtacttttaattgatccagcagacctgaatgaatttggtggacaatgaatgagatgggtagggaaaagcacagggcctgatagagctaattggttccattaaaaagagatgctagtatcccaattaaaatgattttgcttcatgaaagacagttggtttcatcaagataatgaccagagaatttcgtgtttctcgtataaggaaaactaaataaagcaagaaccatgattattctttaaatgtcttccctaggctttatagatatgcctctcctcccgctacctgctcccaccccaacctgaacaatgaagagtgccttcattaccaatggagtgtgcattgatggcaccttggcttattaaagtgactttgggtagattatagcactgactgattaccctcattgaccttcagactggctaaactttgccagacttaatgaagctcactacttgtcaagccccctaggctggatggctcctggctcagtcactttgttgctttgattttacatttttaataacaatgataccacacagcttaaggaaatatggcagaacatgtcagtaatcatgtagagcctggagcagccatattcatggaaagatttaaggcttcagattttttgagcctatttgaaatcaccctctaaccccagttttgaccttggctggtatttcttaaatcattgtaatgaagaagttaacactattattcttaacaagatttttgtacacatttatctaaatgacagggtagatgttaaatggtcaggcatttattaaacatcatctacccagcctcaacttgggtgttaacttttatttctgaaagtcaagatggcattgggttgctcagacacatagccaattctgcctaaagattggcatgcaaaaggcttcaactgcagggaaggtttagcaaagaaagaaagctttcatcctgaaggagaaacaggattgattagtagtagctacttggagcactgtgttgaaaaggattataaagtagtatttgagcccagcataaaagagtgcagcacttgattaatcatgtctggtgtggacatagaaaggaagcattgtagcatacttgccattcctgtcctagttcatagcttttgatcttgttccttataaacaactcttcaccttttaattatttcttataaatgtatctctatttattttcaacttccactcatgcttgaatccctgaattagttttctgtcagatcttttctttgctggccacttttttgttttcgggtcagtatctgagttccttttctgtgttcagagaattcctcatgttatgaatctctgtataagaagcttaaatggccaaaacacttgttttcaaagaatactttcctcccgaccgctacctcctgtactcttgcaactagttgaggacgtatgacccagagttctggtctctgtttcacccagatgaaaatcaggtctgcctaacattttgaatcaaaacctattgtcacaaagacacagggtgccttaacatttctgaattttgcctattttgtgaactgacaggtcaatctttctgcttaaatcagctagaattagtttctaatgcttgagactaagaatttgacaataggtcttctagggaggcattcctcaaactttatactgtggaataatcacctagacatcttactaaaatgcagattctggttaaaagcaggtctggatggggccttggttttgcatttctaataagctcccaggaaatggcagtggtactggtcagtggcccacacttctagtagaaaggatctaaataagggaaggcagagtttgtaggaaaataaaaagtctatttccaggttaaattagggcaggccaactacgtagctaataaacttcaaaatgtacaaaggctccgaacagcagaattacatttcttaataatgcacaatactgggtcagtaacagaacactaggcagttttccttcatgtatgcaagggcctaatttaattgggaggcagggaatgtcttttatcttcaactcaaagcacctctatctttggccatgggagcctcctgttattctggcttgcccctgggagtctttgatagttctttgctacctggcatgacaagatatttcaagcttatttgtacactcctggcctcagggtgcctggagtcagccctttctccatgaagctctgttttttttgtttttttctttttttgtagtgtaaaattgtttttcaagttgttcatcactactaggctagccattattttcagtctttttcattagacagaactgagaaagtgtttgcaagtatgcatatgttttcaatttaaaatctcatgttttcaaacgttggcaaggatatggagaaaggaaagctttgaacgttgtttgtgggaatgtaaattagtacaatcatagaaaacagtatggaggtgcctcaaaaaattaaaactagaacttctgggtagaatctgatggaaataaatcaatatctcagagatatctgcacccctatgtttattgcagcattatttacgatagccaagacatggaatcaaccaagtatccactgacagataaatggattaaaaaatgtgataggcagataaatagatatatacacaatggaatattattaaccatataaaaatagaaatattttatatgtgacaacatggatggacttggagggcactgtgcttagtgaaataagccagacagagaaagacaaatactgtatggcatcacttatatatggaacctaaaaacaaacaaacaaacaagaggtggaactcacagaaacaaaaagtaagccagtggttgctaggggctggaggtgggggtggtgaaacgggaaatgctggtcaaagggtacaaactttaagttatacagtgaataagctatgagaatctaatatacaccatgatgactagcaaaaatgctgtgctgtatgcttgaaatttgctaagagagtagatcttaagtgttctcaccaataaagaaaaaaaaaggtagctatatgaggtaatgtatatgttaactcaattgtggtaatcatttcacaatatatatgtttataaaaaatgtatgtttatcaaatcatcatgttatacactttaaatatatacaattttatttgtcaattatacctcaagaaagctgaatcaaatccgatgtgtttctactgacatttctacttcagatctaacactggagaatttttctttaactgctttcttccccaccaacactcctggttagcaaggacataggaaatgatgaattaaaatttcatagttaatcatttgctttcttctacctttaaacgcaataatattggaataataatattcatacttcccctataattaaaattacataaaatacttaaaatattttggtgttttctattccctttctcatccccttttcacaatgttgtaatatgtctttattgtcagagtatataaacatttatactatattctatcactttttaagttaatattttcctagatattttaattcttaaaatattttatttcttaaaataactagataggaaaaggtcatgagaacaatattctgagttcttgcatttttatcagattttgtatgtcttatacccttgaaagtcagttttgctggttataaaattctcagtttacattctctttccttgagtatcttaaagacaatattttcctttggcataaatctttactattaaaaagtctggtgataatctattttttcctgtataaatcatatgctatatttgctgaaatgcagttttttccccctcgtttttctttagaattcagtcattttactggaaaataccttggttgataattacgggtcagtcttctcaggtacatgatacattatttcagattgtaggttatttgtttaattttaaatttttaatttttcattaacatatatatgtttgtggagtacaatatgatattttaatatatgtatatattatgaatgattaaattaagataacatattaatcatcttatatactttttttttggtgagaatattaaaaacccaccttatcagcaatttaaaaatatacagtattagaatatagttttaatacatacatatattctggaaagttttcattgattacaatttttggtattcattctgttttcttgttttgattttctttattcatggaccccctggtagccctgtattgacttttctttgcctatcttcaatatttgtcacattttctaaaatggtttttaagttctttaaaaaatattttttggatttgaaacttttcttattttatttgtcttatggcatttgatgtggtgtttattcattcttagtctttttcaaatgattttcttttatttataattctttcttgagtttcatgacctaattctttagtttttcttattctaatttatcatgttcttccatattttatattatttttatgatgtttttaatttatttgaaatggtaggttgcagttttaatctattttataagcatatctttctggcatgctttcagtgtgcctagggatgatggtattatgtttcttaatctaatttttcttataactttggatgagatttggccttgataattttaagttgctcatttttgtgcacattatcttcctgaaggcttagaaagaggcttgatgcagacagcttttcaagcttcccagagctctcacttctgttatttttgtgtggtattaacaaatatgtttgtctaattgttgagataacctgaatcttcttatctcccctactttatctcaaccttctcttccttttgtctctgttgtccctgtcaagttcaattttgattccactctaaatatcttttcctccattgtgggcctgttctggaagagagccacggcaggtcaatttcaagtgttcactgtaggatctccttcagaccttcttaccctaggcgctgccatttgttaacttatgactgcagacaaattatttaactttttaaagtcccagcttcttcatttgaagaactagtataagaatcattcctatctaatagtgtgtaataggaatgaaatgatgtaatatgcaaagattttagctcagtaaatgacacattatacatgagctcactaataaccaacattatcccaggcagtaatttaatacactttgtcaaatgagtatgtgggagatgtcaactttacatagactttattacattttataaggtaaaatgtcagacacaattcagagttaaaccaaactaagttatacatactttcattgcatacgttatagtaattcgtgcaaaaaggaattgagatttgttcttaattttccttgttctgaccaataacgaacgtgtgggtgtcatcctatcaagagattcacttgaatgctcctggataggtatatttgtttggaaaacatgcagagtgtttatcatcttctcttctgtttatttttatgtatatcccatatacattcagataattatgaacaaaacagcaccaaggtaatttttcagggacagtttcattttattttcaagcagctgccctgttttctattttaacaatgtgggaatgatgtataattatgcattgttagaagatttgggcttgtttattctcatttatcttgaagaataattataagtatttctggaacatagcaactatgtcatcatagcacctgggcacaaacagttttgagattgttagatgtttcatgtttctgcttctatctaacacaaacaatggatctagaatgggcaggagactgcacagtggccaagtttcacggttggcttcaaagtttagatctttatctaaagttctcccgacttgttggttgatgcctagatttttccttttcaaagagcctgaattcttcaactgtgtcatgattcaaaacatccagaaggttcgggtcaatgaaggatgagagaaggcctttgatgggagaggacccatagtgtgtattgagcaacaggccattatgtaactttcaagttgacatataatatgtttaattcacatgcttccatcagtcattggttttcctttaataatgtaagcactgggaaaattttaaaaagaaaataggaatattatctccatgggtaatgagagctcaaaaacagtttagaaaaaaaatgggcaattatactatttcttaattgtatgtcattttttgtttttgtttcaactgtagcttcggaaagcagtgatggatcacatatctgactctttcctggaaaccaatgttcctttgctagttctcattgaggctgcaaagagcggaaatgaaaaggaagtgaaagaatatgcccaagttttccgtgagcatgccaacaaactggtagaggtaagtgtggaggggcctgaagactagagtttaccgatgggttcaatctctgcatatggctcttagaatttcactagagagatattctattgtatttttggagaaataaagtcctggaatcattctttcctttactttctgattactgtaccccctttcgaaggaatcaagctacgaatcatctttcttttatctgtctcacaattctaagcatgctctgaaacatatctgccatttttcctgaacaacaagcaggagctgaaacaaaagaagtggaagggaactctggagtgctgaataccagttttgatttgagggagtaaattaaaatttctgaatggaggcctaggacacttctcccttttttcccacctcaaacccctgtccactccacccagtggtgcctagatgctgtccacactgggaacttgtgaaaaaaaaaaaaaaaaaaaaaaaaaaaaacccaccttccccaaagagatgtttgaacttttggtggaagatcttggggcagtactagggtaagttaagcattgtaagtatattttatgtgttagaggaatctgtgggagttgttttataaatgcaaaattttatggggtaatattgaaaaaaaatattgtacaaagtaaatgacaactaggctgcctaaatttaggagctgaaaacgaacagcctggcaaaggtaggattagtgatgtggggctaaatacaatagaaaatagagttgttgcacaacaaaatatgtgtgctagagaacaagagcccaggagggatgaggatggatcctggaaaatttagggaatggttattagggccaggttaaacttttacaggctctgagcacttaatcctaccaccaccaccaccaccactgtgatgcattcccactttaattcataataaaataaaatcacttaaaatgacagaaaacttaaatgcaagctgaaaggaaaataagttcttttttttttcatttggatggaaaaatcaaaatcctcagaaagttctttaaatgtgaaatcctctctgcttttcctggagtgggtgatgggggtggtgttcgatttagttgcatgctaagcacctgcttagtttgcgccttggttaatccagcactgcaggtgcctcgggctgaagtcacccagccaacaggaagtcctacatcaagcctctgcttctctaggatacaggctgagccatcatccatgacagcagtcagcaggttctatgtgcaaaagccttggccacaataatggaagctttgaacttcctgctgtaaccccaatgtcttgagaaaataccagcctagagctaaaactagggtaatacaatatcaaagcagtttttctggctctgttctctcatatcaggcaagccttctatcacccttcacattccacctacatgctcggagagttcacttagctatttagggatccagagtctttccaaggttgaccttggaagctctgatcactttcgtattttgagaaggggaaggcggagaaggaggaggatatgggtacagaaggaagggaagaaagaggaggaggaaaaaaaaataatgctgatgggtgctacaaagctttaaatattcacatgtaataaaataatgttagcatataaatataccatcccatctgtataattacaacatttacaagataactgcagagtttactgaaaatattcattgatggtgtgttgtagacactctggatgaagaatgggacatggatttcaagttgtgtgataaacatctactttcagtcctattagtgcctttacttcatttgcaggacatatttgaatttcaaacttaacatcttgtgtaaatatgagactggggccaaagacccagctttttccactcattctcctttctcctgtgacaggcgctggacacatccaccctctccccttattctgtctttaggttccattgtaggtaaatctgttcactacatgtgattcttgatcctcaacttgtgacaagctgaaagcttagattacttgcagctccacatttcagaaaactgcactttgcctccatcaggtattcccttcatttcccatggatggtcactgtggccagcagcattttaatgtcttgatgcctaggagatacaggggctagtgtgtggtctggcctctgtgtgactagggagtaactgaaatctacaagtttgcatatatacaaaaaaaaaaaaaaaaaacccaaacttgaaccaccgagctgagtgttagcctttttctagttttgaaaagtgtgtggatatgggcacctttcttagtttctgtgtctgtaatatgaaaaagtcggtttgtatattgattttatatccattgaacttgataaattcagttactaattctaaaattttgataatttccttttggattttctatgtacatagtcatgtgcctgcaaattatgactgttgtattagtctgttctcatgctgctaataaagacatatcatatgcaagactgggtaatttataaatgaaagaagtttaattgactcacagttacacatatgtggggaggcctcacaatcgtggcggaaggcaaaggaagaggaaagacacatcttacatggcagcaggcaagagaacttgtacaggggaagtcccctttataaaaccatcagatctcatgagacttattcactaccaggagaacagtatggggaaaaccacctccacgattcagttatctccacctggcaccacccttgacacatgaagattattacgactcaaggtgagattgaataggaacacagccaaaccatataagtgtatttcttctttcccaatacttatagtttgtttttttttttttccttgcattatagtactagctaggacctacagtacaatattgtggtgataaatatttttgtgatttctggatctcagtggggaaatttcagttctttcccattaattatattgcttgctctatgtttctttcagatactttaattaggtcaagctagttctagtacccatttgccaaaatacttttaaaaaactatgaataactatagaattgtatcaaatgctttctctgcagatgttgagatgattttctcgtctcctttattctctttcagaggaattgatatcaaagttatgctttcccttaaaaaatgaattgaaaattttttcttccttctattttttggaagtgaatgtataagatgagcctcatttattttttaaatgtttggtagaattcactgataaaacaatgtgagtgtggaaaggtttaaaatcatatgactatttaatttttttaaatttcttttaaggtcagttttgttaatttgccttctaggaatttgtcatttaattttctaatttactggcataaaattgtccataatacatttgtattttttgttagatgtataaggatctgcagtacggtttcttttttccccactcctcatttagctaattagtatgctctcttttttccttgattagttttgcagatagtttatcaattttaaaaataagctttcagctttatagatttgtttgtattctattttatttatctctgctctctttatagttctttttggttttttcctgctttcttccagtaaaacttacttcttcttttctaacttattggaatggataatcatgtcattaatttcttgcctttcttattttagtgctgtactcatttaaggatataaatttccctctaatctatgcttaagtctggttattttctactgctctaattttaagttcacttatccatgtgggtccaatatactcaaaacttatatattgagttcaatttttttttaaatttctagttgattcttttttaaagggactccaattctctagtaaaatttattatcaggtcatctcctttaaaaaaatattaatcacagttatttcaaaagcctaagtcaaagaactccaatgtttggatcaattttgtttttgttttggggcggctccacagatggcagcccccaacacatccaaaatccactgggatgttaatattgatgatgcaacacacccaccaagagggtccagacaggtttattgctcatgtaatgggacttcagggacagcagagcaggcaaccatgccagttcataatggttcaaacaaagagaagaataagtgggtttagtttttatcatgttagggcatgtggctgggatcaggatttctatgtgacagccaggatttgagtggtttgtatttcccaatagcaataaaaaggtggcccctcttatcagtttgcccattttggggacaaaagggaaatgggggaagggtaggactgacttaaaaactgtcagcaaacgttctttttttttttgagatggagtctcgcactgtcgcctgggctggagtgcagtggcgcaatctctgctcactgcaacctccacctcccgggttccagcaattctcctgcctcagcctcccaagtagcttggattacaggcacccgccagcaggcccagctaatttttgtatttttagtagagacggggtttcactatgttggccaggctggtctcaaactcctgactttgtgatctgccctccttggcctcccaaagtgctgggattacaggcgtgagccaccgtgcccggcccagcaaacattcaaaatagactagcactgttcattacagttcacccttattgtctgactgatgactggaatgtgccatgtttcatattattgaatttagacatgtttaagtgaactattatgggactctatgaggctttgaaaatggagacagactttattgcttgtctgtttttattaatttttcttgtgattgtgttttttgatatgctgggtgatattggattgaatggcaaacatgtgtgtggacagatatagagggtctggataatgtgttctccttccagagaggattcaccctattttctgttgggcagcagagaggcagaccatttcattacaatcaaagatcaaagtgacttgaacctaggttgtagcacttctaaagtttagcttacccttctttcaccacagtcctgaagaataatcttccagggtggccaactgaggatcagatgtgtcaccttatttgtgaaatcacaaaccccaatttttgttttttaacaccacgagactgagtttgctttgccttgctttttggatggtctcaatttgcttcttgcctgttgctatttgcaacttaactgactgtcaaacgccttggggaaaaactggggatgaagctccaagctcgcttctttgaacctctcttctctatgggatcttaagtccaagttggctgcctcagcggggctgtgctcagctccattttctgcctcctcagccctatgagattgctgaaaactccaaggaattctcttcctctcagcagcgaccttctttctgacttctcagattctccttcaacactaagaattagcaaatcccggcgagggtgactggagtgacaggcggaaggttaggctcccctcaatgagcctctctttttgatgtagtttaagttttgacatctttggcagctctcctttgctttcaagcaaattgcttttattgtgtatttctagtggttctcagcaggcaagtgggtctcttgtaggctactccgtcatgtcaagaagcgcaaattcctgagagggctcatttagataagtttatggtgttttgttgttgttgtttttgttgttagtatttttagtcagacatctttttatccagtggaaattttgcgacttacatacctcaaaaaaataaatgaataaatcaataaaaacagttctgactgaactgaaataacaagcttggaggtctacttcctacaattccctcacttaatgcctcttctccccattaagcacaaccttccaatccttcccagggcgcctttgatctctgtttgaaaacctctgatgaatctctacatttccattaatcacataagaatcattcataaatatgtgaaataatcaatctatgaatcagtgatgatggttttagtccttcaacatttttcttgagtttaatgatagtatattcagtttgctatctattttatgggttttttttcccttgtatttgtgtgccattttttccaagtttgacattcataaaaatagagtctatgaagtgattgggcccttttacaacctacagaacttgagaaccttagaaaagtcctcagcaaggacagttttagtatatataaaatattagtaaaatgttcataggaaaaataatatgggttctcataattgctttaacaagtgaaattttgagaagcttttgttgttgttgttgttgttttctccacaatatttaaaacatttaataaaatttggggaaacttccactggggtgtgttgattagaatttaacaggtcaactatgatgtaaagtcactataggaagtatcatctgtagaactagataaaataattattagtaatttcctctcatcttcagaatcatgcccttctaaagattagctaaggacttcagggtggggccgaccctgagggtatgccgagctgatccagaaacacctgtggtacctcacgtctaagccttctggagaaatggaatacaaattatggcaactcagcagcaaagcagttcggtcagggctggggtggagtgggtgtaatttgggtacaaaatatgcatcgccacaatgaaaataaaagctaatcttgaaaatgagatgcaagatcaacatagctattttgggcctctgaacttgttttattccttccattgcttgcctgctcagtcaacctgcctgctttcccttctcctcccatctctaccatgcacacctgagtgcaagccacacattctattgtgcaggcaactgcagtggcctccccacaggcctcttttatctgcctggccctctacagtcccttctgcacagagcagtcagagtgaatttctaataatgcaaataaaatcatataatttccctgcctgaggccattcagagacttcctcttcttatcaggttaaagaccaacattgtaaagaagcttacgtggctttcaggatttgaccttctcttcagtcttcaggctcaccgtcctgtcccctccttcctccaccacccccaacaaggaatcagccacacttgccatcttttgcttgttaaatgtgtcatactccctcccatcctagacctatgcttgtgttgtttgtttcctgatgcattccccactctatcctttcctctagtttctaggcattgttcagctttcagcctgaatatcatggccccaggtgggatcagttccttacgtctttcacttcatgacatcccttttactttaggattgtaaccattcagctctacaactgtatgctagttcttctgcttagtttaccaattcctttaggaaagagatcaggtctaattgaatcctaactacaacccagctcctagccaagcacctagcatatagcaggtattcaagaaagagatggtgcttaaaagagaataaaataataaatgtagccagtgatgttgccagcttttgggcccctgagggaatatatttctatagcacagttgtaggatcctaaaggtcaccttggagatcagcagtaaagaggcattgtacttttttaattgtctaatttattaccaagaagaaatttcaaatctgtgaagaactaatgtgaagaaatactatttgtaccaagtagaaaacacctgctgtttgctacgaggctccctgagttgaattaactctctcaagaggctcccaaagttgtgtccctaactccactatcattcctttcctgtcctctgcctgacaagcatgctttgggttctcatcctcagctagtggatgtgagagagggagctggctctatctgacaaagtaaagtacagcactgaagccatagcaatgatgagttagacaagggaatctcaattctttgcttcatcttcttgacttagttactcctgatagcagtgccccatgaaggatgagaagctgtatctactggaaattcagggcttggaagtcagagtcaaaccctaatactcagaatcactaatgtgatcatccatcagttcagcaccagagtgccttcctttcacccttgagtaaattgctcttctcaattaatccttccccttgcacaatgctgcattcagcaatatttcctgagaggcccatgtgctgatgctggtctagttgctggcaacataaccatgaacaaatcagaggaagttcctgctctcatgggacatgcattctcttgggaaagataagaaagggagaggtaagtgtatactatgtaaggcagaactatgtgctgtagcacaaaattaaacagagtaggatgataaagaatgaaggaggagggcatgtgaggtcgggaaagtcttcccttctaagatgactattaaatggagatgtgaagggagtggaagaacattccagactgtgaaaaaaacaagtccaaagaccccagggcagcagtgtgctttgcaagtttggtagaaaacaaagagaccagtgtgactggagccgagaatgagaggaaaaattacagagattaaattgagagctgggtataaagattttgtagtttactcagatattgagttcattggaaggttttgaacaaaggcatgacataatctgacttccatttttaaaagttcacagtgctgcttgatggaaaatatagagtaataaaaagcaaagaaagaagaatatgtccaatgatattgcaatagtccagcaagtgattagtactatgactagaagagaggcaaggtcagtgggaagatgcggctcaattttcctgtattttgaaggttgagctgagatattggatgttgggatgtgtgagacagagaagagtctgggatgaatccatattttgataagctgcagtgacataatcagttgaaactttaataaaacatagcctacaatcccagactgtttctcagttggctctggcttcagttgtctgatagatgtggtcctaaaacccctacacaaatgtcctgggtttaaataaatgtaagagttttgtatgttccagggccttgtttcaaaccatgaactaaaaagaaaatctagaaaaattgcatcaacaactatattgatgatgatcatgccactgcacttcagcctgggtgacagagtgagacgctatctcaaaaacaaaacaaaacaacaacaaaaaactacattgatggaattggacctccatgcatttttttaagacaaacccaatattttcatacccctttttctccttgctgccttcctcaatacagctaataatatttgaactacaactgagttactgaagtttctctaatcaattgagccatagcaattctgtaaataataatactctataagagctattttgttcagctcacttatgttaaacttacagtaaattttgtcatttaagaagtatatattccagtactattctcctccgtaatttaagaattccccaattcttaaaccctaccatattttgtaaggttttctataatacacaataaagcattgcagaaaagttcaaggcccccccttagactcttaataactatttagatataaagctagggttttaaaattaactatttataaccttatttaatgcttctgacaaccttatgaagtagccattattttttacttcaaattacagatgagaaacctgaggttttaagaagtttaataattgacccaatgtcacatagctagaaagaggcagaatccatgcataagcccgagtatcccagactccagagaccacattcttagccactgtgccacactgcccccaggctcttattcaaggtatctgtacagcctaaagtctgatccttcatgtaattatttagtacagtttctgtccccaaagtaattgtttaaaaatgttagctgctgatgttggcgtaattgtataggcattaaatttcatatctctgaaatcacattttagagaacagctttattttactgcacataccctgaaagtaatacatattactgcagaagaattcttatatactagtggaacagatcatgcaaactgctttcaggtactgatattgggcagtgaactaagctcacccaccagcttcacgagtcttcacctgcacagtttgcatcgttcatatctgttcaaattactaaatgccgcagactttcaagcttgcttgcaagttggtggagtccaaggacatttagtatttttatgtcaaaggtctgttgcagtgcttgaattaactatgcacataatgtaaatactaccaggtaacatttcaatatttataccataggcaaactataaagcgtagagccatgattatgaaatcaatttttttcatatgtaagagaaaccaactattagtttccatgaaaaccttccaatggactcaaatatctaaataaaatacaaaatctttatacccagccctcaattttgtctctgtaatttttcactgacatttagataaaaactaaccataccgtatgtaaacctccaaattatattccaataggtgaattaagtacccttacaaagaaatatccagaaaatagagggcaattaactatgttgtccctacctaaggaggagaaagagaatcaacacttagcttgttccctatgctagataccatggtaatgttcacacattatctcttctaatcctctaaggaagtgctttaatagttaatatcataattttgcagatgagaaacctgaggctcaaggaaactaaaagtagcctgaccaaagtcactagatgatggatgagtgacagaaccaaatgaattcaagttccctggggtccatgttctttctcctgttccatatgcttgctctacctgtatagattcatatttataaatattaaccttgtacattccttacctgcctaccctcaccataataaaatcataagccagcatactggtaatattgcttagtatactctccaaagttgaggaagagtggtgtgatggattagaaagattcccaggaaactggcatctggactttaatagtagtgttgccacattagacattagaaggttacatttcatgttgcttctgcagacaggtagaaaatatttggtcttttgttatactaattagttttggtgtttcatcatctaagtagggagtgtctattctctgcatgtatgtatatacatatatatgtatgttttctcttgtattttgtgttttctgcaactgttgaaaggtgtgtatatattatgcagctacctcagaaaagttataaccttatattgttaagatcagacaccttcaatgcaaaaataaaaaagtcacccccagtaaaaatgatgtggtatgtaagagcaagaagtgttttaattgcccaggaaaaaaattcttcgatgttagaagttcaatttcttctaactctgagggatttttaatgtcacaaagccttctagccagcctgaagccatagttggagagggattgtgtattgggacattgctttttagaaccaaaaatgagttttcaggtttctttgactccgttagttttagaaggaggtggagttcaacttcacaaagcctgcccaaggctcagtgggtatgtactttcaacccttaccttaacagacaacattgggtcctttggacctgatgactggagtttctttgatgtgtaatgatttacccctactgctgtgtgtgtggacagatcactttaatcctctgaccctcagattttgcatctggcttgtcactatttaggtgccgcctatctttgatattttacaattctcaggacctttcccaatttcagattctaggaaaagggaagacatgttctagggtgcatttgtggttgaatcttgaatttgtgggttacaaggaaaacatgtcattacagtggtttcccaggtggcctcacactcaggtgaacaaggaactgaagcttggagtacagctggtagttgagctgttctaaatcgtgaactgatcggcaatatggaacccatcactccttattgtactcccataacttaggtctgtgactgatccgatgtctgaaacacaggtttgaataactcttaatcagcttggtcattatgtaagtagaagccaaagagggaatataggtctgtgcctgtcacataccaaaacctacaccttagctaaatgacattctgttattaactgagaccatcggtttataaaaattaaaagcttcaactttttggttttttttttctttttctttttctgtaggcacattagtgcctgttggtaaaagccagtaattgtgagtggccacagtgcccagggttggcaggtggtgtggcattctttttattttttagttttaataatatatttaacacagtataaccaaaatattacttcaacatgaaattaatataaaaattactagatattttacattcttttttcacactcaatctttaaattctagagtgtattttttgcttacagtacaccaggcccttgaataacatcgttttgcttattagcacatccttttccagtctccagaaacattctctgtccctcaaagccactccagtatgtgcgagtatgtgtgttagacacatacacatgttctttgatctaaagaacagatttttttaatcatatgtaaaatacaacatgagcatcttttggggaaaaaattgatgttttaattgaccttaatgtaaaaatctaagtaaatactgtttgtaatacaaatgcaccttttgaaaatttccccactaccacttcccaccagattgctgcctttggctgctcctatttagacattctggagctgccacaaagtgtgaatatcacacatccaaggtgcctgggaattgagtcaatattttcacataataccggtggccaccaaaatatagttacttacttagactgacagattgttattttttctcttaaaacaataggaccctcattatttatcttttctaaaccttttcttggaagatcaaaagaacaaacctgcccttccaaatctgtaaagtatcccaaccaaatgattctcttaccaagttgataggaggggaatccaagacacatgagctctatcaccttcccttacccacacacattttcttattattttattacttaattttttttttgaaaagagtggtttataacttaattttagaatacaaggtagttggatggtaaagcctgtaatgtatctttaaaaatggatttcaggctgcctgtatgagaaaaggtgctcagcttttctgtaaaatgtcatgacagtttctgcacagagactggagacttggagaatgttaacggcagtggggcagtagagtactttatggatcaatagttttgcaaactaaaaatagcctgtgatgggacctatcccaacacaacactcagctaaagaggctgttttcatccccacaatcaagtatctcaaaaagtcaagtcttttcaagtaggtgacttcaagtatctctgttacgtagagcttaaaaaaacctaatttgcaatttacatccaaattggcacacttttcctgtgcctattctgtaaacaccatgccagccaggtgtttgtgtccatcctggctggccaacgtcttagcctcatccccgtctggggaaggggctcaggtgggaaccccgccatctcagtgaccactgtggagggtgaatcatacccctccaggtaaggttcacagctgaaaaagccaaagccaaacacacaaataatggggcaataaggaattaaagcgggccccattcttgcagaggacacggggaatacagctagatacagtgcaggaggagagattcaggctgtcgccgcagggtcaaaagttcagacaagcagaacaaggaagactggagagttcatatgttggaggaaagtgggaaaagaaagggaaagcagggaacctggttgcctctgctcacagctcttcctgatgcagctctaattcataagttaaactcttgtttttctgcccttgaattttgccttgaggaccattttcctctctcactgacttcacagactctgtctgacctttcttatttctccccatggtcctcctgtcaccagaaacctttcaaacggttattctatatgcttgtagattctagtgccttgctacaaatataggttatattattgaccattatttctcctgatagttttcaggggaaaaactgctgatgtccaatgaattctcttggtttgatttttgcctggaaatttgagagtaacaattacttttctcaagatgaaaacaattcaacctttgtcccaattgcttaactagaattgtggaagaaaggcttttgctcaaatactgttaataaatgactgcctcagaattctgaagagtttctcacggtcaaaaaatactaatgacatgtgtgcaagtgattttcttgcctgatagagtccaagtgtacatccacaacgaaaagcatcaaagctaatatttctttagcctatcttggagaactttagcgtgaaatgacaatttccatgacaagttgtcttagaaatgaagagaggttttcattttcatgtagttgctcataattttctacttatcgcttctacaacaactttcaaagcagtgaatgttctgttttgttcaaaaacatgtataattttgcagaaacttaatgtacttgtagctattctggtggtgtacttttaattgcttttcattctggaaaactatgcttgatgatcatgacttcgaaggagctgatgatcgctacttcgattgttgtcattgttgtctgtctttctttctgtgtctctttttttttttttttttttttttgagccagggtttcaccctgtcactcaggctaacatacagtggtgtggcatgatcatggctcactgcagcattgaccttctgggctcaggtgatcccttctgggtagctgggactgcatggctaatttgttgtgttttttgtagagacagggttttgccatgatgcctaggctggtctggaactcctggggtcaagtgatctgcccaccttagcctcccaaagtgttagaatactaacactcatttaaaaaattaagcaggagatcactaggcagagaattgggaaagaaattcctggctcaatgtattgcaggagttaaggctcacaggtagcaagtgtgcaatatgtcagggcactatggagagatgctaactggcccggcctcatttcctctactttgaatgagttttttttccttgggtagagattatggaaatcaaagtacttaaggagtaaaataagattattgtgtatcagggtttctcaacctcctcactactgacattttagtcctgataattctttgttgtgaagggttgtcttgtgtgttataggatgtttagtagcatctctggcctctacccactagaagccaggagcacttccctctaattgcaacaaccaaaaatgatccagatatttcctgggggacaaaatcatccctggttgagaatcacttctctataatctttaaataaatatgcatatgcacactcagtgccctatacctacatcagttcatttggaacacacattatttgatatgaatgcagtcagcagataacacaagaaataggtgaaggtttgtttcttaactgaatttatctctgaaattaccattactcaaaattctcaacagtttctctccccacagtaatttggtaaaaacctcttgtcacaattttttttttctctgtgatcttactgctgcttataatctcactatttaaaaagatgccctagtattctgaaactacttccagaaggggacattttactgttgttcaaatagtaatacctaattaggattctcccactgatttctttttaactaaggcagctagcttaaaataagcctctaatgaaagaggacaggaacaggtaggtagagaatatgctggagaagatgtgtataaagaagacactggaagatggcaaggcccattccattcatatcacccataaagttgaggaccagttattaaatgcaaccacagagcggacatagttcatactccataagcgcttaatagctgagggttaaattcttgttggaattctctggataggcctatgatcaatctacctttagttttactttccattaatcccttttaagaaaggaaaataaatctttcatacagttagcatctttccatagtgccctgacatattgcacacttgctacctctgagccttaactcctgcaatacattgagccaggaatttctctcccaattctctgcctagtgatctcctgcttaattttttaaatgaaaagatagtaagaatgcaggatatttctaagcagttactggaaaccatgtgctgtagtaaataagccccatccaaagtgaggacaatatacagaggcaggaagatcatgtttatccctagagtcacggtcatcgacattagtggcttcgctcccaacctctgaaggcaggtcagtgtttgcagatgagtgtgttcaagtatatcaagggacagacactgctacccagggcatgagcatgctggttacagaaagcaaaaggtctcattgttctatgtgtgcccccaggcagcattggtcttacctgggagcttgttggaaatatagactcttgggtctgcattttaacaggattcacaggtcatttctgtaatgttcaagtttgtgaagctctggcataagaaacattttccagaatatcttctcatgagatgctctggggggtggtgggggaaacaacaacgggggtttggggaagcatgggttcaaatacatatatatgtgggaatctcctcatgctacagccgctgctatggtctcaatgtttgtgaccctctgttttggtctattcatggtgctggaacaaaataccttagactgggcaatttataaacagaagaaacttattgctcacagttccagaggctgggaggtccaagatcgaggcaccagcagatttagtgtctggtgagggcttgctctctgcttcaaagatggaggcttcttgctgtctcctcatatgatggaagaggcaaacaagctctgtcagtcctcttttataagcgcaccaatcccattcacaaggactccaccttcaggacctcctcgcctcccaaagacctcacctcttaatacctccactttgaggattggatttcaatatgtaaattttggagagaaaaacagtcagacaatagcactcctcaaaattcttatgttgaaacctaattcccagagtgatagtattaagaggtggggcttttaggaagtgactgggtaatgagggcttcatcctcataaatgatattaatgcccttataaaagaggctgccttgtctcttaggcaccttctgtgaggacacttagaaggcaccatctatgaggaaaaggccctcactgggcactgaatctgctggtcccttgatcttggactttgcagcctgtggaactgtgagccataaatttctgtcgttgataaattacccaggctaagatattttgctatagctgcctgaacacactaagacagccactttttggagattcgcaacgtacttagtcactgagaaacatactttaggaaattccagtttataagatcaggccttagggatgggggaggcttgaattctagacatttctaagtaaaatttggttatggaaaacaagggtttaacatgataaaagtgaaaggtgattactttggatcaactttattattttttaatgtcaaaaaatggatacattgtcatatgtcatggtagtcagcttgctaaataccattagcttccaagtgatcctgtcaaaggcaatccagaaatgcataattactattgagtcaatgcttatttaccgagtctaattatttattttgttggcagttattgttctttctggcattagttctaaagctatttggtaaaatatggacagttctaaagtataggtacagtattcatttgctagagctgccattaaaacataccacacactgaccgggtgcagtggctttcgcctgtaatcccggcactttgggaggccaagacaggcagatcacctgaggtcaggagttcgagaccagcctgaccaacttggtaaaatcccttctctacgaaaaatacaaaaattagctgggcatagtggtgggtgccttaatcccagctacttgggaggctgaggcaggagaatctcttgaacctgggaggcagaagttgcagtcagccgagactgggctgcattgcagccattgcactccagactgggcaacaagagcaaaactctgtctcaaacaaacaaacaaacaaacaaaacaacacacactgagtggcttaaacaacagaagttgattttctcatggctctggaaacaagggatccaagaccaaagtgtcagcaagtttggtttctcctgaggcctctcttggcttacagatgccatctcacggcgccctcgcatggtctttcctctatgctcgcacatccctagagtctcctcctgcgtccagtttttcttttataaggacacaaatcagattggattagggcccatcctcatagctcctttgaacttaatcacctgtttaaagaccctatctcctaatacaattatggagttagggcttcaacatatgaattctgggagaacacaatttcacccataacgatgccaaatgtttttttttttccgtttgtttgttagtttttttgttttgttttgttttgtttttgagagaagggaagcagaaatactttcatttgttttgaaggctttacatttaatttttactcattatttatgccaattattgcacaccccagagatgaattttatgatggtctaggtcatcactaattattttgtttctgatacagattctttcaccttatttaaaaatatcttcaaacttttcaattgtattacataaaataaacctgacttcatcagggagttccttgaactctagagtctggtccaggctgttgcagtgagtcgagatccaactagtgatactcctcattccatctgttcctttaggtagtggatgcagagttgtgcaaggttttccctctgctgtgatttattcaccaaagtctatagcattcccctccaggatgtgaaaaatcacaggagaccttgtttgctaaaagggctcatagagaatgaaggatgagtattacatcgaccactcctttttatgctctgtctgagaaatttcatttcctagcctgagcagctgccattctctgaagcagcctgttgccactgctgctgagggaatagctatttttaaaatccctttctctttttgataataaaatattcactgaaaattatatgagtaaataaagtaggagtgggaagtgaggacaataatgatattgaatatatcacgtaattatgagctagactttccccagtctaaataattttttgactactttcgggtcttttgcctgctgcatcaactacagccaggtcatctattacatacagcaatttaccctgtcgacaaagaccgtcgggaaaaattcatcatcaatttatttctcacttcccctgctgcattttaatgttaggatatttgcaaaaaagttggcggttatatgaataaatgaagcattggttatagctgcacttgacaataacatctagtgtttataaggtttttttgttttgttttgtttttgagacagagtctcactctgtctcccaggctgcaggctggagtgcagtggcgtgatctcagctcactgcaacctctgcctcctgggttcaagcaattctcctgtctcagcctcctgagtagctgggattacaggcgcaaaccaccacacctggctaatttttgtatttttttagtagagaagaggttttgccacgttggccgggctggtcttgaattcctggcctcagggaatctgcctgccttggcctcccgaaatgctgggattacaggcatgagccaccacgccaggccttatcttataaggtatttttatacgtttgtattgtatggttttatattatttgaaaacactttcctcaatatatacttggtccttggaacacctcagtgaggaagctaaggcaagtttcttttctaagaaatgtgacattagcagttggtaacagacatgagtctagagtccaaattaactgagcatctactatgtgccaatagtattctgaatatgtgagatgtgtcaatgaacaaaacagagatctctactcttggggagcttaattctaattatagaaggcagataataaacaatagacaaaataaatatataacttatgtaatagaagatgacaagtgctatggaaacaggaaaagtagagcagtaagggaggctgacatatagggtcacagttttaagtagggtggtcagaagaggttatattgagaaagtagcatttaagcaaagtctggaaaggattgattttggtgtttagtaatttgctcactgtctctctgccacctgtttattggttatagcataatcacccaaaagacctgcaagtatttgctcagaaatcttaacaaccatggggtgattagaaagaacaatggacattggcctggacttctaaaaaaaaatgacaatgtgaactaggagtagtctaccttgagtcttggtaagcagaaaattgcaatacctttttaggacaaatgagttccacagttttaagaaaatcttagaattaaataagtaaatggtgtttctgctgagttcttggctatcatgggctaatcagtatgccttctaagatgcccatctgcatatttgggcataggactgctcacacattgagacgaagttagacttctgtttgtccctaagaatgttccttacaggctttgttatagatcattgcagatccagctccttactggataaagttgatgaaggataaagaaggaagatagaactttatagggagaatcaggtgttcagttgagcagtgaaaaaaaggcattacgggaatttgtgatctaaatgctatgaaagcatatttgacatctcttagggggattctttatcctgtgacataaaattccaccccatgatctgaaattattccaagtaagtggggcagaatagactaagtaatcttgtaatagacaaccctgaccctcaatggcttaagatagcatagacttaatttttcttcataactttccattgagagtcccagggttacttggaagcaccggtttctctccaccatcctctctgcaagactgatgaagcggccactatctggaatatgccagtatttgtggctgaggcaaacaatgtggccaaacatgcactagcttctaaagctttcattggaaaatggcacatgcttcccctaacatccatggactaaagaaagtttacctggatagaattacgttcaagtacttgtggaagtaaatcctacatggtgggtggaaggagaaagagccaggatatttgtgaactgtgtagggattcacgcagtgggtaaaattttgaggtttctgtctaccctgagacttcaaaaaaaattattggtgaagttgctttttgctatttgatgaggtgtccttttgctgttcagactggatatttgattcctcttgtgtagttcttcatttttcaggaaggagtagggcaggaccaatttgtgcaacgatttgaagttgaagagatgcagtttaaggtcaacatatgacagttttgttgttagttttgttgacagtatactcaatatccttttataatgaagtcatttttctcagaagctcatgttgggttgcaaaaaaatatataaaagcagccttatcttccacagaggaaattttaaaaattataattcttataccacaggcaacaccattgttttttgatctccgtgacttctgttttgcaactccaagatattaggttctatagcttctgagaagagctcatgagtgtagaaaggtctgaaaatataatatgttaggcaagcaatgtgtttagtaaagaaatggagacagaatggggaggccaaggagatgtcaaaggtcacacaagaaataagttgagcccaaagattaggtaaaataggagaggtcatgatgttctcgaaggcctgattcagaagaggcaagaggtggggaactcagtcagtagcactgaggagcaagacatgccgaggtgagccattttcctaggtcaaaaggcagaagccagaacaaaagggagacaccagtctttcaggcagtcctccatgggcaggtggcactatccttcttctgcatctttctgcacttgcagaggactggctctaagaggactagtagcctgcaaaataagtttgtatattcttgtaacaggttcacacatatgacaactcctcatttatttttctatatcagcaggtcttcacatgggccatccttgtgattctcctccactgattagcccatatctcaagctcagcctttctaagtgattcccctttaggccacccttttgaggcagtatggtgatgtggtcagtgggcattcatgagtctattctcaaagctcccagttaattgatgtgttctgctccagggttgcccagaaggcaggagcaatagaccagtgtcttcttagttgtattgcccagccatctggaccttctagagaattcactgccaggaacgcaggaccatagtctaaaaactgattactccaaaccagccatgagccacttagcaagtgctcacatctcatgccctttcaacacacatgcagtgacccccatcctcagtggaacctggctccatcttgcttttgttccttaatacacgcaccacttctgtttccaaggagctaccatgccttcccaatgccatggcttgagcaagaggatgatccactgggtgatagaattttaggccattaatataccgtctctgtcttttttacccctctctgtttcctgtatgttaaatggagatactaataccttcccctcttctggaagacaagagaataattgaatgaatttaaatatttaaaccacttcccctgccaaacaaaacaccagaatgagcagcctcagagaaagccctagactaaggctcccatcattgttgccatcatcctcgtcttcttttctcttattaattaatctccagacagctcagagcagaaaacaaagggaccttagctctgactggagtcaagaattttcctttctgtttctcccatgcatctcctaaatacccaccagagtctagcagtgagaggggcctgcaataaggaactgaagctcatgctttttccttcacctttttaaaccttcctttaggatctgcaattggtggaaagatgaatttgtaggcctgaggtattaacaaccaaactgaataaaggcagccttcctgtggaaccaaagttcacttaatcgtgccttgggcctgggtgaacacaaatgctgttctttagcattgactcagggaagcatcgcttgcttttataagattgtaagacaatgatggaagtaaaacagctcttcttcaccccacttaggtaggccagctttagaatggagaacaaggtgtgattttcaacccataatagtattaattcaaactgacacagcaaggaaatccatttttcaggctgctatttatttcttttctcttatcagtcaatcgcaaatatttattgagcactgtctatgagctcagcattgaaggggaaacagaataagcacaagagatgacctctgcttttaccatttaacatttccttgggggagacaaagctaacattcatggcctaatagaaagaacacttaactggaatcaggagatctgtggtcttgtcacagtcggttgagtagtatagtgtgtggttaagtgtagaatgccctggaattgggctctcagagctataaaataaggcactgtcgttaattagcagtgaaaccttgagagaatcctatacctctcatcaatttttctcatctgtataaaagaagttaataatagtgcccaactcaaacgcttgtcaagagcttaaagttaaaacttggctagcattatatttacgacacattaagtatgagatatcattcatttaatatttcagacaagcctttgaaaatctctgggacagaaaagagaccagacttgtgttatatatttcctgtgccctagagaccaaatggggcacatcacatatgcatttttatacatccccactaatgccttgtaaagtgggttagggagacatgaataggttaaaatcatgacatgaataggttaaaattttgtaaggtctgctatttggtaagagacaaagcttagttcaaactctgatctgagtcaaaatcctgtgcactttctactctcccatagcctctctgaatgtcagttttccctgtgagaaaatattgggatagatcaaatgggctctgagttcagctctaaatttttggattccacgtcatccaatcttctagtaaaactgaattttagatcaagggcaataaggatgggagcactgcattcacaagaggcttttagaagtattaattaggccatgaagaaccagtagaatttgtttatatgaaaggagactacttctgctaggcataaatattagaacaatggtgggaatgataggtagggaagacaatataaaaaattatccctaccaagaggaggctgctactgaggaaaggttggagagaggactgttttccttcctaataccttaatctgcagtttctcaatatcagcaccattgacattttaggccagataaccctttctcctggggactgtcctatgaattgtgggatgttgatagggctgaattgtaccccgctcccatctaattcatatgttgaagttttagcccccagcatgatcatacatggagatagagcctttgggagataataaggtttagatgaggtcatgagggtggggcacctatgatgtgattagcgtccttataggaagagacaggagagagtttattttctctctaccttgtgaggacatagcaagaagactgccatggaaatgattgagaggaccctcaccagaacccaaccatgcttgcaccctggacctccagcctctagaactgggagaaaataaagttctgttgtttaagccacccagactgtagtatgacacttgttatggcagcccaagcaggctaagctgtttagcagcatccctggcctctcctcactagataccagtagcatccacccagttatgacaaccaaaaatatatccacacgttgcccagtgcccctggggataaatcacctcaagttctcttaagttcacaatttgagaagatcacttgggaaccactgtcttaaccttgtcttaattctaatttaggccatgaacctcattatctgcaagtttaggttttatgtttgtctctttgtgtttttttgtttgtttgtttgtttttaatttttatttatttatttatttttttgagacagagtgctgtcctgtcatccgggctggagtgcagtggcccaatcatagctcactgcagcctcgacctcccaggctcaagcgattttcccacctcagcctcccgagtggctgggactctaggtgtgcaccaccatgcctggctaagttttgtattttttgtagtgatggggtttttccgtgttgtccaggctggtctctaactcctgagctcaagtgatccaccaccttattccctcaaaatgctgacattacaggtgtgtgccactgtgctcggccccgttatttgcaagcttaatattgctgctttaaatttatgtttgcctaatatggttctcaaactttcctgtgtataagagtcaccaaggggaacatagtaaaatgcagatatttagtcttctgtccaccaaaaacttggtgtagtggtctgcattagaaccaacaaatttgatttttaacaagctcctaactctggtgattctgacacagtctagggacccctactttgagaagcactgacattgttgctatagtcagtgtcaaccttgaccttacatgcatagtagaaagacagtggccttgggaacaaataattgtggatttaatcctttattttttatttacttgggattatgaagtgagctggctaagcatgtagccgtcaagatcaggtgccctagtttcaaagcctggcttcgtctcttataggatgtgtagcattgggtgaatcactcagcatttctatgcctgggcttccttacctgtaaaatggggagtattgtcagtgcctgcctcatacattggcattatgtatgactggatacatggcaagactctggtaattgttcctgcataatgtgttcaataaatgtatggtggtagaggcaaaggttaattaaaaataagtgtggactgttgccatagcagccttgtaagggcattcttgactctgttaagaattcttaatgcacttagcacaggatttttctgactccagagctcctatgagtgacttgggaagtttgtagaatgcatgttcccagcttcctccactcaagagagactaattcattatgccccaggtaaggtttaggcttgcatgtttataaagctatccagatgagtatgatgcaaccaactcagataccacacatagaaacacactatcttgaagaaaatagattgtgttatgtgcacactcgacctgcttattacattgatctattcaagtgatagactatatgctagaatataatcttttaagtctgttctccactgaatatcccacatagaggtgattacaaaacatcgcatgaattccttgttttcatatttgatacttaagcattctctttagcttctagttttctttgatatccttggaagctttccaaattgtgttctggaaaaaaaaatcatgtaaggcttttttaaaaagggaggaagaagacacttcagaaaggatgtcacccagacttaaaacccttttcaacaggacgtttcaacaagttgggttgtgaacttgagaaaattaatttttggaaattcttaaagcagtacagactcctattaaggaaaaaatctagtagtgtagaaaactaaaggcctgtcagtataaattttcatttcatctttattcctattttttggtgaaaataaaattttttcagcagaaaataattttctccttagggtttttttgaggaaaaagatggattttgcttgttaaaaaaagaaggcaaatgtattctgattgcaccaacatttcttaacgtgcactccaaactctccagcttttttccccataaatttgatgagaattatgaccaccatgaatatgttcactatcaaaatcaaagacattgccaaaaataggtagaacttaagtgttacttcagttaaatggtgatcttatcactgtgcttggtgtcatttttattgtaacatagtggaatattttagaagggaatgattagtagtccagattttcttctgcaagagctagagattctctgatgtagtttttctgctgtagtacatttttttccaatgccttcaatctattacttttaccattgcaaatcttttgggtaatatgtgtaatgggcgtacatttggtccatgaaactcaggagcaagaatatcacttgtttttatatttataaggtatataattatagctggccactttccaaaagatctggcgtcttatggaagtctagaagcaagcttcttggtatggggttgttgtgttatttctcttactctaggcctgtgtgtgagcagccactccattcatacaaaattgtgcataggttataacagaatgtcctgtatgcacagatgctctgatacttcctgctgcaagaggagaatgtttattaagcctagtgggggaaaagctcctagtggaattattcctcctttccttcctcttatcttgggaaatcccactgttcttccccagtcaggcccttcccttcatccttctcccacgctgggataacttccgtttaataatcccttgatgtacccaacctttcaaacaaacacatgggtgggaattttctttagttcacccttagaaatccaaatgtgctgttaacttatgtggaaggtgggagggtggagggcatatttagggatgaagatgaggtatggctgagaaagaacgcagaagcttgctcattcttccaaggagagggccagggtgaaactaatcttttcatccttacctttttgaaagaagaactagacagatagcaatgtaacaatagaatgttctcccgaatatttgtggtaaagtctccgataactaaactcaacaaatcagagcctttattactgcacttagttctggaaggagtccaattacaacaaagtaactggtatcagattcttgctttaataacacctttccaggaaggccctgggctcttttctaatttggcccaatcactgacgccttctccatctttgtcctcagatcctttgtgaaatcccagattgtcttcacttactaaagaaagacaaccatttcattcagcagcctggatttactaagcaagggaggagtgggtattttagggtgatgcttagcaataagggtgaatttaatatgttctccgtttcactcttagcgacaatctcaaaatcttcaaatagttcaaaaaaattaaactgtttttgtttctgaggagcattcagcaaaattgaaaagtcagtaggatttactttgattcctttgtttcgcctagcctgtgtgtttctgaatcctgactacacattagcattacctgaggaacttcaaaaactccaagcctgggtctcacccctagagatgctcattcagtctgggctggggcctgggtgtcactaatttgaagtcctccaggtgatactaatgtacagccagggctcagaacaccagctgcactatttgcataagtctcctttcttgttagcatttatttatttatttataccctgaatatcttaggactgattttttacagggttatgctcttagtaggcaaggagctgataaaatatcatgtatcccaggagcctgtatgttagcagggtcttcagaaaacctggaacctaaataataatggtgaaatggtggcttgacagggcagcgatattgccttcatttccccagctctccttcctttcctcctttttctctatcttttcctccattaatttgaaaggcaattcttaaggcattcacactcaaatttctgccatatatttggttagctacctgtagagctgatgctaggggtcatgctttctaaggcatagtcctatgtatcccgacattgatgatatgggtttgtacacgtagtctgaaatgtttgattagctacccacaatcagtagcagcctgcttaagatatcagaagaccaagaagcaaaaataggccaggtgcagtggtttaggcctgtaatcctaggactctgagaggccgaggcaggaggatcagttgagcccaagagtttgaggttgtagtgagctatgatcaatcatgccactgcactccagcctggatgacagagcaagaccctggtctctaaaattaaataaataaataaataaataaataaataaataaatacactaaataaaatacacttcttggtctattttgttattgtagcagtaatatctgttcattgcaaaaacattagaaaatgtagataagttagaaagaacaaaccaaaaaccacctgtaatatagctagggttgcctctggctttccttgtgtctccttctctgttttcaaataactttctatacttaaaatgatttttaatggatcctcctcttggtacatgttaaaacagagcctctgactacatgttctgtaaggcaggaacatttaagattttaagccaacttagtacctttgaattcaaaacttgtagtttcttagaactccatacattagaatggctgtggaattatccagtgatcaataaggatgtgagtttcagaaagcttaacacagaactaatcagtgacagaactataaatacaaaatccagggtcactaggttctgggggccatgtgcctttctgtagctcacactatgtgcttggtgtgtagccaagtacaagggtgtcagtttaatctgggtctgcaagtggtaaattatgctttttaaagtatttactgttgttctacacagtagaatgagaaatgagagttgactatattcttgacatgatctgtgaaataacgtgattgtggttgaatttcctggaaaatttgaagaataaattgattattcaaggtgtgcattggtttatacatatctcctcttctcttaatgcaaagctatgatgttaggaatgtccaaagaaattagtcacagaaacaataatatttaacccaacatgtcacaaaccttgatttacagaacactagttcttaagatgttaatagatattccatagaaaactctggattaagtcaaattaaagaaacatttttcataattataggagtatcctgggtctacaataagcttatgggcattgtaaatccctgtatgagacaaagtatgcaaatttccttgttgtaaccataatagctttttttttttcctttttaaaggaccatttattacatcttgaacaactagtatggttgttcagccagtttagaacatgctggttttatctggttaggctttgtgttttgggaacatccagagaacatcttctaaaggacaaagatgtgctgagagcataaagttaacctgttgtaatttaacccagggaacaaaagtggatttgtcatttcttctcaaggaattcttgtagtaattacccttgtctggagttgcttaccttacccctccaagtctatcttttttcttgtgttagtgtctcttctgaaagtcctaactttaaaaaagcagaatatgatacctccttttttacaaaaccaaaggagggacattcagatgcttccttgaatctccagtttccaagctagacagtcttaaaagattttcagaggtgtccaaagtaatcaaagtcttcttctaagagcacttgttgatggcagaactgtattagtctatggtttatggtgattaaaatttgatatagtgcaggcaaatcaatagaatcacagggttggatggtaattttcagcagtggaacttgagaggaacaattctatttctatttcatagtctttttgtctgtttgtcttaaccaagtcttcattaataacctcctgaccattaaggtgtcattgtttaaaaaaaaaaagtacttttccctgtctcattttggaagaaatatatacatacacttacctttctctgaaaatatctggtgcattatcctttgtgtggccttctccccctcccatgtgattttgtgccacggtgtgtaggtgattaagagtcatgtcttataatactgactgatacggtttggctgtgtccccacccaaatctcattttgaattgtatttcccataatccccatgtctcctgggaaggacccactgggaggttattgaatcatgagggcagttaccctcatgccattctcatgatagtgagtgagttttcatgagatctgatggttttataaggagcttttccccctttgcttggcacttctcctttttgccaccatgtgaagaagggcatatttgtttccccttctgccatgatggtaagtttcctgaggcctccccagccctgtggaactgtaagtcaattaaacctttataaattacctaatctcaaggagttctttatagcagtgtgagagcagactaatacactgacccctggcctcatgtgcacatcctatagcagatgcttccatgttttcattggactagacctagcttcatgtcaagagacagttgtgagaatcactgcatcaggacttgatatgtaatatatgggtcaaccctttaatttagatttgttctcttagatcaggcaataattcaaatatgatttgagtaaaatattttatttaattttggggggatgaggaaatgtttgagtcttatttgggaattaaggaaaatatagccaaaatcagaagttattacaatccaacattcaagaattacagattccttcatgctgatgtcagtttctcagtccaacatttattttttatcggaaaaaaaagatttttacatatatttaaatcagcatatactagaataggtttaagataagcataaagaggagggcaaaaatagaatttggacatagaaaaaaatccctaaatccagaacatgaggctagttatatatcaaagcatattaaatagatgactaattataacaatatttaagctatatttggttcttttgtccctggcactataccaagaacctagcaaccataccacaagatatttataaatactattattttcattttacagatgaggcagctgaacctgttacatttcttacctgtggtcatgaacctagtacataatgcaatcaggattcacagctaggtttatttaacttcagagcctgtttacagctgttgtgatatactgtggatctcagttcatccatccatttattcaatcaacaaatattctttgtgtctcctatttgacaggcattgtgctaggtaccataaacatggatgagtaacacagatgtgatccctgcttctgatgcatttacagacacgtggctgtattctagtcggctgtgtgcccaatagtttttaacccaatggtccataaaattccatctgtttcctaaatcagtcaggtctcatggggctgattgccaaaatgggagaggtcctctgggcagctgtcggtgttctaacgccgctgacaaactgaccagattctgagccatatggcaagcccctgatgctggctggcatcctcacaaatgcatggagcttacaagggagaagaaaggatgctggtggcattgggggcttcttgcaggttgggttggggaaaaccagcttagataaaaagaaatctaggaaagggtgaaatattcaaactatcagctttgactagagaagattcaatttgagatagaagggatgctgaaattaatgaaccttggttagctggtatccctgcagtatgataagatctatcatttagatcaaggagatttattcttgggatacagcaagacctcccaggtttttggaaaggtatctgatggaatgaggcaaaaatttcagagttagttggccaagttatggtgggagagagtaggatgaaaggctggggtgccttctaggccaggtatagctggggttgaacctgacagcctgggacctctttgaaggccaaagagacagactggccacacccagtgggaatttgttaaggggctgctacctgatgttcctgagggtactttgggagctaaatccaagcatagagcaagcatgggagcatcacgtggatttccatttcaacactggtgaaatcaaatctcctaacacaccgtcatctagctttgccttgctcagggtctgtgcaaggttgagcaggctgagtactggtcattactggccatggttgggcatggccaaggttggtagggataggggctgactaagcacccacccccaccctaaccctggaagaacacaatggaaaagtaatgtgttaagagtgtcagtctaagaacagcacatctgtttgtgttactggtactgaacttcactatggaagcaagtgggtggatagactctaatatggtgcattcaaaatggatattctctgctggctttagcaacagcttcatggttagtgatttctccatgtgtgtgattcgctcacgtaattctgtttagctccacgaaagctgttaaaaaaacaaacaaaataaaacagaaaaacaagacagaagagagaaaccataattgagctagcaacgtgcttaaataggaaacactacagaacatatatctgtttgcgggggatcacaaggtctcacaaaacaaagttgcataggagaatgtgaggacagacagggttatataacacaatgtagtttcaatcagaatgattttgtcctttgacctgactgtaaatcaaaagatacgtttctattctccacccccgtgtttttcttgatggtaatttccactgaatgtcaagctttttgtgtgatgaataaatacccattctatgggtaccattaccagctgtcctagctgctgtaggaactctccttgactgaaataacaataaattatttcaatcatttagaaattagctgcacaattgtcaaagctctggcttatattaacatgatgcttgagaaaaagaaaaaaaaagaaaagaataaaagaaagggcaaagagggagaaagaaaaacatttcgagccccattccaactatcaagggaggctgtctgagaacaaaggcaaagcgacatagtttactcttatctgctctaattattctttatcttaaagtattacaattgattgtattgagcatctttatctatgtctggaaaggatcaaataagagaaaaggaggggctgagaggaacactatagaaagatagatttttgtctcattgcaggaagagctttcctttaaagggaaaatatgctgttatggaaggtccctggaagcagtacgatgcagagttcacctcgggagttctgggttcagactgtcatggtgggacttagcacttcgcaaactgctctgtaccttccccatgtgtagaacagggaaaactgtagtccatccccaaagagacaatatgtgcctggctgttggtgataatcagccatttaatactactattcatgaatcccttgtccttgaacgtgttcaaatgttagatttttaaaaagctctattcagctcagagattgaattcttaggttctgccagggagataaggagatggatgagcagaactcagtgaggctgacggagggcaagtaccctgggcactgggtcttgcttattagttctgccgggcagcatgcggcacacttggtctccccaggtctccatctgcagcctctcagacagcgtgttgagctgacatatggcacagggccagccctgggcatttgatcattgtcagcctcccagcagaatctttggcctgagcacagattggcaggcgggcagtcagtgcttccctctctgatgatgggctagcccggggaaggcccagagccaaaggtcagaaggaaaacaaggaagctgtgaaatcatatcagagaatcagagctcagtcccttcttttcacaattgaggagccagaggctctgaaaagggagatgatatgcggaggctgcatccctcatgacagcagaacttggaccaaaagacaagtccctttcttccagattagtgatcgccctgtttcagcttactgactgtcagggctggcaaacaaatggcaaatggttaggttggggtaatgaggtgtcaggggtttatgaagcagcctttttgtacctataaatgaaatttttaaagtgccatgatatagtcagtaggcctatgtcaagaaagaaagcttgtcacataagtctggcgtagagccactgggcagaggcaggaagaaagacataaagagaaactgttacccagctagtaattgccaggttgaatgggcttgtataaaggtcatctctctatcaggagggttgagaaggcaggactttgtggagccaaagtgagggaaacagaagcagatttagcaagattctttttgtttcttttttgtgggcatgagtagaggagaggaatgtgagactgacattagggtctccacggcattaggtctccgtgaagttgcgagttagtggaaatttgtgtttcatgccttcatcaccttatcttttgtaccttcattcctcttccacatctttctggagaggagtgtactctcacaaatcctctcctcattaaagtgaagaaaataatatgataaattaattcacaccaagatggtggtgactaatgtgtgctgtccgtgcgacctttgagttttaaaaggagattctaagagaaggccagtgccattgcttaccattgagcagggagtctctaccagcagaatgtcagatgaggggaggaggaatggtgtgtctggatgcatattatgagcataattttgttctcagtgcactgatccatttaatcttcgaaacaagcctgtgattacctgagacacagagtggttatgtcacctgaggaaggtcacatggctggaaagagaagtttggaactaaacttagtcacactatggctctaaaacaaaatgtcccttttactgttcaatgcttgccagtgagaagttactttccttatttgtaccataattttactcaagtctgtgaggattttgagttgaagatatggctcctaatgcctggagccggatgtgggatgtgctgaatgcatctccttcagttactggtctctattactaagccagaagctggacacctgagctattggtgacatggagtacccgggttgtagaccaatgctcctatgtgtaataaaaagttacttgcttttcttggaagcctcttctttctgtgtggccactttaatatcccctgcacattggtatcccctgcactttggatgatctggtattgctgtggcttctgtgtgttgtgcagccctgctgccattccaggaatcaccagcaatactgcaactgatgtagtctcagtacatttgggtggactggggtgctattggacgcggagggagcaggcgggatagtgagatcccagagcaaggccactttgcatgacattcaactggaatgtagcttgtatgagttctcaaagattatgtcaccaccatacaattgtctttgggtttctcagtgttttacaactaattaaatgcagttagtgtttaagggctcaaggcttcgtgcaagttaggcccacattgaaaacccaggcaatgcattttagctacatggccttagacaggtacttatacacttcgagtttcagtttccttagctataaaatgggaagcataatagataccttattgggcacctgagggaattagatgagaaaaggtacatgcacatggaggtcgagtagaaggtggttatcagaggcagggaagattggaggaagcagggaataaagagaggttggttaacaggtacaaaaatacagttaggtagaaggaataagttctagcgcttgatagcacagtggggtgactatagttaacaataatttgttgcatatttcaaaatagcttgaagaaagtatttggaatgttttcaacacgaaagaatgataactgtttgaggtgattgatatgcccattgccctgatttgatcattatacatttttttttaattttacatgtttttttttggacagagtctcgctctgtcacccaggcggtgatctcgactcactgcaacctctgcctcccgggttcaagtgattcttctgcctcagcctcccgagtagctgggattacaggtgcccaccaccgcacccagttaatttttgtatctttagtagagatgggatttcgccgtgttggcaaggctggtttcaaactcctgacctcaggttttctgcccgccttggcctcccaaactgctgagattacaggcgtgagtcactgtgcccgactgatcgttatacattatatatattgaaataacatgtattgagataacatactgtacctcataaatatgtacaattattatgtatcagtaaaaaaagaaagaaaaatgttcatggaaagtttttttagtataatgctgacacataataagtatacaatacactgtctatattattaatattaatattactgatgtaaaaatatacaaactccttactaggcttcgtaagatccattgtatttgctcctagaattctttccaaactcatctttgtatctcttctcagactcagcacatagtagatttagagtaaacactatattgagggatgggttcacatttctcttcattctcttttctcttgagaatgaaccttcatatactgatgctctaaaatttattttattctttcagggattttaatgctcctcctccttgtttccctcagttagtatttctgctttctaagattttgttttttttctcttgtttaaaagtcagacacccttccaactcccttgtctcctgcagaggagatcgaaagagatgattcacttttgaacatgtgaaaaatgacttccttgaaattttagttcatcgaacagactatcctctagtgccttccttcacccttgctgcttccttctagagctgaagttaggctgcagatgaggagggcaagaaggagtatctatttttcaatccttgtgtaggtgccaagagacttaactaacagcagctatagaaataagttgtacattttgtctaacttcctttgaagtctttgaagaaataaataaaccttcgatttttttttagaaatatttagagtaattctatttaggtcagttgataagttacctctgttagaactgagggactatataaaaaacttggatgtttcaattattcatatagtgatgtattttgtagttaatatgacctattgtgtattaatcagatgtggactactaaaacctaatttattcagttattcaaagaagaagtagactgtgcttctgtgtgtcaaataatatggttaattttctggatccctgacaagtaaataaatttatgttaaaaaataacaaattaagattccctaaaatatgtagactattgacatactacaaaatacgtatttatatttgtgtttggctggttggaaatacctagatagcaagttcaattttccaattcattttgcaaacacctttctctttaaccttgaaaaatcctttccactgttatttgtgaaaaatcatttttttagcagactgctttctgaaaatcactgacccttctcctgtttggaaaggaccttgaagttcagcttgttcaaccacacaccaaaagctctaatcttccctctagcagcttagataacagctagttcagtggttgtctatcctgggtttatattattaacttatagagacttaaacaattataaatgatcagccccctctcttctacctcccaacaactttgatgtatagtcatgggctacataaggacatttcagtctagaatagatgtacacaattgtggtcccataaaattataatgaagctgccctatacagatgtacaattaaaaaaatattttataccatatttttactggtaacttttctatgtttagatacgcttagatacacaaatactcaccattgtgctacaactgcctacagtattcaatagagtaacatgctttacaggtttataacctaggaacaataggctataccgtatagcctaggcacgtagtaggatacatcatctaggtttgtgtaagtacacgctatcatgtttacacaatgatgaaaccacctaaggatgcatttcttagaaggtattcctactcagtgatccatgaatttaattggtctgggaggagtttggcattcacattagaaaagctccctacgtgcttttaatgtgcctccaggctaaaaaccactatacaagttgacctgctgaggtgctgatgagaggacgtagaagaccagaaggaccacagttcaccttgacattgaggttaaaagctattcataagatattcatatctgaaataataaaggcaccatgtacatttttgaattcagcaagaaaagggcagttttcttatcctgcttatcttaaggtgattgcacagataacatgggcccaggcagaagccagggaaaaaatgccttgtcaaaagatgaagagttaagggagtctgttgaaagtggcagcctcccctcattgccttgatcagtgctccaattcctaacctggaacataccaatctgtcccaggacaccccacacagacatacacttgattttgcttccttttcctcctgctattctgtacttctgacaatcatctccttttcctaccatcaaaatctgtcttggagatgatgtgccgacatccctcagccacattgtttggattcccataaaagccactcaattcccctgccagggtactcaggtctttgtaggcttggtgtaagcataggtgggccagtgtgtgagagactgctggactggcagagacttggggcattctcatagtgttcaatttcctggcaggtcagataaacctgtggggggcactgagactcaaaataatttcctttacccagcgtttatttgggaaatcccctgacttctcagatacttaagaaaatgtcagggctctgaaaataagttactaatgctcctgaaatttaaactcttaagactctatacataagtcagatatgaccccattaaggaggatagtttacttctttatattttgttcgtagaagaaaaaaaattgcctttgtgcacaggtcctgctggaaaactgctctcaatccatagcctttctttgcttggaactgtagaaactgacataggttgttcctaatcttgagtgacagtcatttagctagcagacatttgcatggtctttggagaattatagcacatattaagcatgcctatatcttgttcatttcttatgcacatactccagtgctttttagatcttaacacaaagaatcctgaagaaaaagaaactgtaacactcaaagaaaagtaagatattcaaaaagaatgtgacataggctttaagaaaaagctggagaagcagttagtaaacttatccctttatgtactatatgcaaggtatatttccctctttctcccgcttcttctttccctccctatcacaccctgtccatctaccctcaccccagctgtcattagttgtattcattttatgaatcttacaaataccctaccacatcttgtattttacacaacacacacagtcacacacatgcacacaatttaattcaactgtaagtcttccctattggtttgcaacttgcttttcttatttaaaatatcttgtacattcccattctagataaatggaggatatccttctaactcaatggttctcaaactttagcatgcatcagaatcacctggaggacttgccaaaatacagattgttggatctcatcccccaagtttctgattcagtatatctggggtggagcccaataattttttgtcaatatcacatttataacacattcccaggcaatgttgactctaccgttccaggaacacaatttgggagaagactttctaaccgcttcttttagatagctacataatctttaatgatagagatacagcatgaatttttctgtcattccactactgattctgacaaagattctttgctttacctaactttagccaggctcctaaatcttttcctactcccatttgtgcatttccttgtaaaatccagttttaacaaagaatcctgttaagtcagtttagtaagaaccacccaccctcaatatctgatcaccctccttgtctgatgaagttccttatcctcccccatgcctgacatgatgtctgatcaccctggcccgttgtttacaagaatcctgttatgttggagttcccattatccctgatgttacctcgtagtaatttttcatccactgacctccctcacctccctactccttagctataaattgccgctgcccatgctgtattcagaatgaagccgtctccccaccagctcacactgacccccaactgcaaattcccattgctagggttcctataactattgcaaaggtcctaaataaagtctgccttatcatgccttaactagtgtcattgaatgtttctgtttgtttgacaatatacatgcaattattttgtctctacattcagtggtgcaataaatgtccttatactgttatgttcatgtactggtgcttttatcttgctaggatccgaaacttaaaaaaaaaaagtcttttgaactagattatgagtcacaggagaaaatcagtctcactgctttgtggccacacttcagctagatcttattgctagacttggaaccaaataatgtcgactttttccagaagtatatcctccctcagaagaatgatattttccacttttgtggataatcaaagatatatgccccaggctcctacagcatttctagaaggggagctccagctatgcaagttgtcagcaagggcaggttgagtgggctttgtgctcagccccctggggatctgctttgcaagacatcattcactgggcaataaaaggtttggtgatgttttcattgttatttaaaagtcagttaacttactttgattatgtacagtgccttgggccttgccttagaagtctagggaatgaacacttttaattgaactcctgctgtattctaggcacttttaaaaacaagatctcatggcattatgataacaacctcgggaggtgggactctgcacaggttaattttgtctggttgttgaagaaaatgagtctcaggctactgaagttgcttttctaagtctgttgatgatggtatatggccaagctaaaatttgaacttagaaacttctggcttcaaatttatttatttttttcctggaaacatactgctttatacgggaagacttgaaagcagcaaatagagtctctatctagggtatactgattgagtttgaggttgtatagatattggtcattttaattcttttttaagcctctgtttcttgagttatatctgttgtaggcagcatcatttactcattcaattttgggcaataatcatgactggattaaacatttgggttttccatttatgctgatttcatctaggtacaattttctatctctcttatgtatctcatttttctctcccttcctttccttctttctttctttctttttttttttttttttttttgacgaataaagagctgctgggtcatcacttctcagcctaaagagtcactattaatcttgagagcagcattcctggtcgaaaagacactaggacatggtttgcaagcatccaggaattagtctacgcactctttgggtgttatcctcaacggtgtcttctctattcggtttctttcttgtcttggagtcccagttccaccttgttatgaattccctatccctaccctctccactctagcttctcgttgatcttttatagcttattttctagtgcagtgtttaacctctgctctgaaatcattagtctatttttcctccctacttagtcggcacactgattattccagattctatggttcctgtttccaaccctctcagcctttctcgtcttttacctgactccctaggagttggcgctgtgatgcgatgcttacttgactgtttatgcctccatctctgacctttttctgaaaatcttttcatactgtggcttgctaaatactgtctgacaaatcccctgctccatttatcatctcacatggttctttaactgttgttttatcttctgttccttttaagtccttgttttcttcacttctttatccagtaacatagacatgtgagcagaggaaaataaaaatagaacaccccccttaatagtcgccagcactacgtctaacttcctttgttcattaaggtagtactttgtacattttaatgtattggtagtttttcaagtagttgaaatgcctagattaattgaggtagggattgcagatccttagaagggttatggagcacagggaaagaatcattcggctctggttaaatcttatttttctttattctcattctgtgtggagttattaggatggatttccttagaatgtttgggagttttcatgttcaggctgctttcaaaatcaacagtctccacgggtggatactcaggatttggggtaacaagaggaatgagttctgattccaccctatgaagcttgtgatgaagcatttccaatacattattgaatttgattacattaatagtcctgtgaagtagatcttcatattgctattttacagtcaataaaccaagctcagaaagatggaagaaaataaacatttatctagtatatattttctaggcagtttggctaaaggataaatggcttgccccaaggcacattgctgtacgcagaggagctagaattcattgttttacccactgtctcaaagtgctaatggtcgtggagtcatacttttagggacttgtagctcatggactgaggtttcaggaatgaagccctattctcctttttcatcttctgcctcttcctttatctccccttcatgattctgtgaacctctttcatatttttccttctttctaaaccaacaggtttactcttattggtctgtccttgacccagcattgatgccttctctccctctctctgccagcctccaagcatcactgcagccctcttggaattctagttgatcttatcccagcagctccagcctgaactgtgagaaagaatgttctatctgtcctgcatgaaccagaagaaagaactgtcttcaatataatggagatccaataatctgttttgacagtgatgttaattccaaataatttacgggttcttgagcttttcatcatggtaccaggttttctatggggtatcagacattgggttaaaactgattcatgcaatgaaatggacaaatttgagttgtggtcagatgttttaattagctctcttttacttagagttcctcctgccctgatggttgaatcatttctaccaaagttctttgtgcttcagtgaggttttctcacagtaaaaagggaacaagcagatctggacttaaaaataggtagaatgagtagtatcaggaaattctgtcctaatggtgtctgtaataatggctgaaaattcaatattagctaggaagtttcactttgtcattaagtttttttctttttctctaatgcctcccccaacttgcatacccactctggcatgcacaatgttcctatatcactttgggacgagaccttgtttatgtaaatttcctatattccagacactgttttaaggactttataagcattagtttatttaaacacatgaggaaggtactagtacaaatctcataccacaggtgaagaatctgaggcacagacaagttaattaacttagccattgttcagcgggctagtaagtggcacagctggtgttaaaattcaggcattctggttccagagtctttgctctcagctactctgatggttttgtttctttctctgagattcatggcataaaccctcataaatactaatttcacagtattttaattatttgtcaaaagatatgcgtcttcattcaccctgctccattgggatgagagctactcaaaagcaagggttttgagttattcatattctccagcagggaatcttgccatgacttgttcagtattgaaccctgctgcttacaatcaggtaggctctctataagtactggtgaattaatcttttcaacctcctgctccaattacagtgaaacacatgataggctccatgaatgtcaagtaaatatatgcattttgtgatcaaggggtatggtcttaatacatatgtgcttgtgaataattccccaaattatgaattatatttattccattgtccaagcttaatgactatgtagtcagtgtttattggtgtacttccctcctaccatttttgcagttacagaaccattacaaatggaagactgggtgacaacaacgtaaattactgcagactgaaagaacttggcacatgttgccaggaacaggtatttctttgagtatcttggaatgcttgaagaaggccacagagggtttcttccactccttttggaggtgctccaaagctttctgcgatgctggtgcatttagaaatcaaagcagcccatcaagaaggccaattctaggaagaaaacaaacaaaaaaagaagtcatttgccctcgccctagccctccctctattttatcctaacttcttctttatttcttttaaataagggactagaaaagatgtgaaaccaaagaatttcaattttatcacttaattttcattttatgatgcagttagaatgagctcttcatttatttgtttcgtaagcccaagctttcactaatgttttcctgaattttatattctgtttcagtatggtgtgatggtttttatttttttcatctaaaaatgaagtaggcattcttctaatatgaaataatagtgtgtctcacatagttggttatttagtgctgtgttttaatcgtcagcatgaggggccacaagttatctgcaactcttctgcttccatatgtgttttcttcctttgttattcctgcctgaccttttcttccaagaatagaatgagaaagcaacttgttatatgttcttcctctgtaacttatattgtaattgccacatttctgttgtgatattgatttggaaaactcatcggcattctagcgtataaagtaatagaaatctgaatcctgctggagggagttatttagtctttattgaagtgatttacagagagctttctacccaaataaaatgctcagagaaaaaaggagatgtactgatgcaaaagcgtgcctgtttctcaagcagcaccaagaatacagagattgtgtcattctagcttttcatttcttctttccttgattttatgaatgaatgacactaatgaaataagtaaatgtgcattatgtatgtgtttctggacagttatggatgactttccaggtaaaacttggcaaagcacatttctttaacataccaaataatttaaaacttactagaggagcctcttaataaaaaatgttgtagacaatatttttgcaaaaaaaagaaacctttttcaaaatgaagacttgttttgtccacatatttcttcaaaaaaaaatcttacttcaatttgcaatgttcacaaacagatggaaaaactacatttgattgatacatgaaaagttctcacagttcccatagcatttgtctgtgagttcagctgggttattgtttctgtttcatgctatcttgcttaggccccaacaggatttccatcaaagagttcaatgaaaataagattataaatttggggttccccaaggaacagcatattttagataacaagagggctacatttggtataatagataccttgcattgttctaataaatcatcagtaaatatctttcaagtaagtgaatttcatgggctgtaccaggtacgtgtaagctacatgtcattgtatctccaagccaatggataggatagactagatatcatgaagcatcagtttagccaaggaggtttacctgtgattaggcatgccatgtttactcatagccttattaatgccttccaaataccttaacataaagaaatgtctttcagggagagataaaaagtctcaaagaggttgtaagtcccacattaagaaagtggtagagctatgattcagacttaggcttacttcacatgccacgcgcttcctcactctaaaagtacctccatccttcatgcacaaagacagactaccaaaaaggagagagaaaataagaaagataaggaaaaaagaatatatgcagaaactagtgaaaatcaaataaagtctctacactaattgactgcattgtacctgcattaatttgtggctttcaataatgtaccagtctgttataagacactactaggggaagatacgtggttagtacatgaaacttctttgtactatttttgcacttctgtgagaccataattagttcaaaataaaagttgcaaaaaaccccaaaacttcactttaatgatctagggcactcgtgagatccattatttctacgaaaacaagagtttcctaacatctatgagttaacactacaatgcaatgctgacttgacatttctttctttttttcttttttaacaaactgcacagtctgaatgtttatgtcttcccaaaatgcatgtgttgaaacctaattcccaatgtaatagtattaataatatgggggcttttggaggtgattaagtcatgaggatggagttcttatgaatgggattagtatccttataaagaaacctgagggagcttgtttgccccttctgccatgtgaaaatatagcaagagtgagtcctcaccagacactgaatctgctggcatcttgaccctggacttcccagcctctagaattgcaagcaataaatttctgttgtttataaattaccctatagtgtttggttatagcagccccaacaaactaagatacaaacataatagaatatatttattcaaataagtgttcgatttttcatggaaggatttacacttttcctgatcattattctgttgctaccagtgtccttagagtatcttgtgaggaattgctggaagaacctgtggcctattcttttggatattctctgtacccatatatttgtgttttgaaggcaggattggcttttgaaaaagccaagagttatcagggcgaagtcttctgaatacagtaaaataaactaaatacaatttaatacccacacagtgctaaaatttggaccctatttgaaaaaccaaaagcagcaaaagccatgtttaatacagtattatttatgtttataaacgtggagctagctgtgtgcagtggaaagtttgaacacaggctacagagatggatgttattgcgtcatgtgctatttttcatttatttatttatttattttttttgagatggagcctggctctgtcacccaggctagagagcagtggtgcaatctcggctcactgcaacctccacctcccggttcaagtgattctcctgcctcagcctcctgagtagctgggactacaggcgcctgccaccatgcctggctaatttttgtatttttagtagagacggggtttcgccatattggccaggctggtcttgaactcctgaccttgtgatccacccaccctggcctcccaaagtgctgggattacaggtgtgagccactgtgcccggccatcatgtgctatttttaatattagtacccatttctgtagacgcagaattcaatatcacattgagatgatgattatcaagtgcctaacacagggcctgctcactagtaagtgatcagttaaaacttagcagctttaatcatgatggaggaggatgatgaattttgccccaagaaaagtaccttatttttttctgagccttttttattatccaaataacagagggcttgaaccaaatgaaagctaaatttttcagctctgccattcagtaacttggatcctgaagcaggtgtcaggaggcaggacggaggtgttgaaggtgctgaaggtgcaggtgagatcaggaagatttgctgtttgtgtggtggtggtgtgacggcttataggggtcttactgtggcacagagttttggttttccccctcaatttacctctgagaaagtcctttcctctttcttttcttagggtctgaggttttggtcattttgctaacatcttgagactgcactgacatctattctgtcttagaaatatcatagaaacaaatacccaagaagttcattatatgcctgaacagccagaacctccaagtaattgataattgtttgataaacagacttgtgtctcccagtgtgactgatggaaagccgtgtttctggcaggttggaggctgctgaatatcagttgcctgaaagatagacagacttttccagctgggaaaaaagtcagctcagatattacggagtttactgaatttggttggtgatatctgacactaatccacaagttggatagagcagcttctggagagtagacactagtagctagtagacattaggtactagtagctttcttgctgaacactgaaagactgacaagccacaaataggaagttggcttctaggtgcccctgagattggctaataaggtcaggggttggatttcattgcagagtttagtatgtctgtctgttggacctttgggatgggcatagacatgttggtaccttatggggggtatagtctaggctaggggctggtgtgcagtgatgaggaagtaggtggtaggcaaggggcttatgacattggttggtggggaacctttaagcaaaagggaggtcatcctatcactaacttctctaagtatctcactatcttatttttggcttcaaaatattttttcatcatgttcttgcaatggccatgtcaatataccttgaaaaggtcccactttttagaatggggcaatagcaatataaccctaagacatgggcaagggtggctcctctactgagcctctctcattcagaggactctgctccagccctccttcagcattcctttacccgtgcgggggagagaagcattggggccaagggagcatgctcattcagagcccacatccagtgccatttagacatagactactcagaaatccctgacaaatagtctagatctaattctgggaccttcttagatctcttgcctaccactttgtctaccactttctcttgaggcagattgagctgctgttgaacatacttcttggcaaagcagtggtcaaagggcagctgttgggaagaggttggagttgcccccttatagggcaacacagggctggggatggaaaggagataaagggccagataaggatttgggagccacaggtcagctggccccctgccttcacatgccagtacagaatttcaaggcatcagagtcatccaaatttgaattccaaatttggatttttgttctatgtcccaaaaatgtcatgagtaagcctgcggaaaacagcagtgtcccctacacccagctctcctcctggccagggtcttgctctatactggactgaacttgccaatgaggttagaaagaagggcagttgtcagtattacttcattcattcatttaccaaacattcattgaatacctactgtgcgctaggctgtgtgtatggatactgaggagatgctgtccaagacggatgtgcttcctacttcttgaaacctgaggaatagagaaagcatacagaagataggagtaagaagaccaattaataaagattttctgattgtgataaaatcatgaaataatagtgataaagtcatgcacctaagcaactgtgtctggagacagataaaaaaggggagaagagtttcattgagatgagctactccagttgggtctctctaagcaagtgacatttaagcaaagtcctgaagggagaggaggcagccatgcaagactggagtggaggggggtttccagcccagaagacaacatgtggaaaggctatgaggtgggacataacttggagtgatgtgcagagccagatcataaaggtccttgcaagcagcccatgatagggggttggtatattatcctaattgcagtgggaagccatggaggccttaagcacagtatgatttatatttctaaaaggtcattctgactcccatgtcagaaatctttggaagaacggaagcaggaagactgagtagggggccctttgtaagaattcaggcaagagacgatggtgattgttcttatccatgagaaagccagggtgcttccacgataagatatcttccttctcataaggtagcgtttgctaaatcttaaagactggaactcttacctttgtttgtgaagaaaagctgtactcatttattatcctgttatttattatccaatatatggttattaagcatggcgtatgtttttaaccctactgtaggagccagtgatccaaaggtaaaggaggcacagtctctactaaaaatatctggagagattcattctgtttagaggcaggagccagggagcagggactgaggaaggaaccaagaagaggcaattatcactggagagtggtattaaaacaaaggtttacctaatttccagtttaactcatggatatggccatgggatatgacctcataggagccagttgttgcagtcctagactatgaggaatttttaaatgttgattgcttatttacttcgatataccataatgtaaggataaaaaaggaagggtgagtaacagtagaggttttttgtttgtctgttggcgggaaagtggtcctttgtcctcaagtttgttaaaaaaaaaatgcataaagaaggtggccgggcgtagtggcccatgcctgtaatcacagcgtttaggaggccgaggtgagtggatcatgtgaggtcaggagttcaagaccagcctggccaatgtggcgaaaccccatctctactaaaaatacaaaaattagctgggtgtcatggcacatgcctgtaatcccagctactcgggaggctgaggcagggaaaattacttgaatctgggaggcagaggttgcagtgattgctccactgcactccagcctgggtgacagagcgagactccatctcaaaaaaaaaaaaggttagaaaatatgcagaactagaagtctagaggacctgcagataagggtggggcttgcagggaggcaaatggaaggcaagagagttactatgagagcctagggataggatgattatggtgatcctggcagctcagtggcaccaaaaggactatatttcacagactgcatgtatctagccatggctgatgaataaatggtaatctcttacagtcaacctactcccagtgaagactgacttggagggaggtcgtggagaaggtgccacattactcattctgaatcctgcagcacattctacctgaagcaattatagtgggaagatggtatcttggcacccataggctggagccatggaagcaaactctgaacatgcaatactaaattacctgaaaggaaggatgctttcccaatttagtttagcttttgactgaatgaaataaagtttgtgtccattaggtaccagattttcatgtacattcacggggttggattcccacaactcttggaggaggaaggaactgtgttgagggttgaatgcccaagaaaagactgggacccaagaaggcccatttttcttgatctagggtggggagagatggagcctatgcagggccagtcaagcacaagacagaattaaacaaggcttgtgggctaagcaggaaggagactggttgacacattctcccgtagaacagggagggtatcactggtttattattttagtgaacaggcctccagttattgtcattacacgtgtcaaagggctaggagaggatgaggtctgcctcgccccatcccaccttctcgttcagcttgtcagtgaaatgtattaggtacctactgtgcccacttgtctgctggaccccttaaaggcatcacacagtcaccaagtcaatatgtacaacttttgcttacagtttaagaaaagagaatttaaggacagtactatttgagaacaactaaaggtaagaagcacctgcatccttatctgaagctagggaaggtcagttctgatgagagtaagggcattcggtgtggactggtgataatgaccccagactccccaggcctcaggctcctcagcgattgagctggaagccagatcattccaagtggaaggaacagaggagccaaaggctacaggggtcaggctatggtgccctcagctgctggcacgttgcaaagtgagttacgaaacagaatacaaaataaaagctagtatttgtaagaaaacaaaactatcatgaagggctttttctaaaatgtcgattttctttgtgtgcctagataatgggtgatttagagtttctacttggtcattacctatatattctaattttcctaaaatgaaaatatacaacctctgtaatatgttttataaaatacaggcacttaagcaattcatgctaaaatgaaagtctggacattttgaagaggttataaatgctgtactcattggaacccacctcaccagtgaaagctccagactctggcatgcctgagtttgctcagcagtcagtttacattttactaaactttctcaatctccattattgctccccaacaacagaaaaatattcagtcttacgatcatgggtgcttgtacatcctgagtgatcaaaaatatctctagagaatagatttgatgctgcagtaaagggcctttaatttttctagcctgggggtccctgactggctgctcacagatgtgtgtttgttttttgtctttgtgtagtttctggccatcataggattttttaaaacttgagctaacattaaaaatcagagtttatgtataaacatttgaatccctggcttctctttccaaaaccatctgtcttacattcctgcccagccacacacagcttcaatgcaggcacagctgccccttggatgatcagttctctgcagtctttacaattcactcttgcttcctgacgctgaggccaaggcagttgtcatttaccaaaacagtttttgtttcttaatggtagagacctatttttaaaaatctatgttttaacaacagtaaaaaataagaaggtacatcagaagaaccatatattttgagagaagaatgagaaagcatattttttgtggaaacactattcaaacagactgcagacaccaagtgacatggttggcttttgttggcactggagattttgctgctttgccctgagccttaagatcttcctcatggtgctacactgccagcaaagaagagtttaaggagagaatggaggtgggtgtccatatccacagcctactcctgtgtgtgaggatccacccccaccatatcccatctcatccccaaaacaacaacagcaacaacaaaaccagaattgggcagttcctggtttagaaggcaagaggtaaatttcagtattgccttcccattccaacatagcttatactgttacatacctacattttcctaccataaattgaaccatttcctatcaaaccaataaaatgcaaagtctttttattatctagataatgactgaatgacaaaccaaagggccttcctcggtgctttttattgaaatttcctgtggagccatgaattctctgttattagggtaaatatcaacagaagacaggctggttagatagctacttggaagtgttgacaggaaattaaatttgcaaacagaaataaaaccgtggtagaatttttgaatacaaggacaaaagcaaggaaattgaatattgagattatttgtagcattcttccctggggatggagaattgaagagcacatggtttgccattcatcggaaggtcaaacccaagatgacttagcaaaatagtcattcttaagaccaaaaaaattatctcacaggcccagatctcagagatatagacacctaagcaaatgaggtgtctgtgagttgggtgatttttactcaacatgttaatttttctgtttgccatttttagagatgatgctgtacagtcatcagcacccttttccaaaaaatatgataaatgtttcttcaaataacttaacgatctcattcacacattcttcggtgttaataataagtacgtgtgccaatgatgaagtggccaacagtatccctccactggaaagtgtaaattgtgtcattgtatgttgagttaacaaggattagagcatactgggttttatattttggcattttttcccctttatttttgagggtaaatctgttggtccatgtaatacacatgtgctaataactgctgatttaacaaagaagttgagaggtggtgcaaaataaggagctcataaagatatttttaatttattaagaaaagagtaatggacatttatttatttacttattttgataagtaaaggactggagctctcaactacaaatatgaggtcaagtgatgagatataaatatcccttgtgtgggcatcaggaaatctgctattctgtcaccaaacacctatgaaatcatgtgaagtggaggtgggagattaggtgttttgggacttatttcagggtctactattctttgacatgatgactttgttcacatatgcatttgaagagctgccttaatcataaaataatgttctaatttactaacagtcaaatcttcctagagaggtctcaaactgccagtctgtgtatcatataaggcctgttgaggaaatgattacagtacacagaatattgccacatatggaatgaaggggaaagaaaaaacagaatttattacaaatagttaaacatttagcatattctaaaagaaaaaaataatggcttgtgcttttcttaaaaaaaaaatcaattctggcaatctggggtcatgttcctatcgactagagcaataatgttagggcacagatggatttgcccttgtgtgcccttctcaaggttcacccagtcaccagatctcctggcactgaggatatgtcaattgtcacttatctctttatttttttacattacttgccttgagagaactgagctaaatgtcattcttgagaatagcacctatgtcctttaattagctgaacccatgaccacagatgatgtctgattcacccccaaggaggcaaaacaaatgtgtagagatatctgagaagtcgggctggagctttttggctctcggggacactctctcatgttcatgtcaattaggacagattttgttgaaaacatattttgcacactccttaagacccaaatggcagatgagcttcacgtaactgccaaattttctctttttcaacttacttctccaggggaaaaggtggaaaaataatttgatacactagttgtaggaaactggactttaactcagtgtttgacaatcagtcaattctcagaaaacaaagtgacagaagtaacatagcatcaagaagcaaaaaaagcatttttcccaggcaattgttttacaactaaattatttatgtgtattgaggggtttaagaattattaaatgtattttctcccttggctcagttctttacattttttctatttataagaagtgaaactcagacgacaaccaggcaggcaagctcacagacgggtttactgacaacaccacaatgctcctcccctctcttgctttctggcctcagacataaggagcagtctctttgggaatgaagggggcatcatggaatgaaaaatagaatgccctccaaggatgaaatacagctaattacatgttgttcacctgcttagtttcagagggtggacttatgacttgtgcctgttgaagaagaaaattgcttgatagcagtggccatgttatcaggattcataggagagagatgattatctgttaattttagagtaaagaggccttttactaccaggcaaaaaagcaaaaatcatgcatttctcatgcataacagaagttctttgttttggtagaataattactatttagagtatattgggttggatttgtaaaatgactggcctagagtttatagataatcagtctcagtatggagatttcagaacaggaatgtgcagatgtggtggcactgataaggaatagaatacatttgtacctatgtggtacacatacacacgcacacatacatacacagaagcatactacgtaggagaaaaacaggctttgaaaaatgaacacttgtttttgattctgattatcttaagtggttgtaataacagtcaatactaactgattgctttctagtctgttcctggtaaatagaaataaattttaatttgggaaatattttctttaaaaaaatcaatagatttatgggtacaagtcatttttcattataaggatgaattatgtagcggcaaaatctgggcttttagtgtacctatctccagaatagtgtacattgtacccactaggtaatttttcatccctcacctcccacccatcctttcccattctgagtctccattcgttatactactctatatgcctttgcatccccatagctcagctcccatttataaatgagaacatgtggtatttgattttctgcttctgcatcactttatctaggataatgccctccaggtccacccaagtttctgcaaaagacattattttattctttcttatggctgagtagtattccatggtgtgaatgtgtgtgtgtgtgtgtgtgtgtgtgtgtgtgtgtatctcacattttctttattcactcatcagttcatgggcacttaggttaattccatatctttgcaattgtgaattgtgctgtgataaacatacacatgcaggtattttttgatataaggactttttacccccctttgggtagatatccagtagtgggattgctggattgaatagtagatctacttttaggtctttgagaaatctccatactattttccttagaggtcgtactaatttactttctcatcaacagtgtataagcattccctttgactgcatctgccccaagacctgtggttttttgactttttaataatgaccattctggctggggtaaggtggtgtctcactatagttttaattagcattttccagatgattagtgacattgagcattttttatatgtttattgcccatttgtatatcttctttgaaaaatgtctgtgtatgtcatttgcccacattttaaatgggattatttgttattggtttattttctcgctgatctgtccttgtagattctggatactagtcctttggtggcggcataatttgcaaatattttctcccattctataggtggtctttttatctgttgattatttcttttgctgtgcggaagctttttagtttaagtcccatttatttcttttcgtttttgttacattttcttttggggtcttagtcataaattctttgcctaggccaatgaccagaagagtttttcataggttttctcctagaatttttacagtttcaggtcttaaacttaagtctttaacacatcttgagttaatttttgtaaacggtgacagattcttttccatgtggctatccagttattttcccagcactatttgttgaatagagtgttctttctccagggtatgttcttgtatgctttgttaaggatcaactgattgtaggtatttggctctatttctgggttctttattctgtttcattggtctatgtgtctcctttatactagtatcaagctgttttggttactatagccttgtaataatttgacgtaattaggtgatactgtgatgcttccagatttgttctttttgcttagcatttctttggctatttgggttttttcttagtaccatattaattttaggatttttgttctaattctgtgaaaactggcattggtgagaggaattacattgaatctgtagattgctttgggcagtatggccattataacagtattgattcttccaatccatgagcatgggttttttttttaatttttttgtgtcatctataatttctttcatcaatattttgtggttctcattgtagagatctctcaccttcttggttacatatattcctaagtaaaaacacatataagtatttttaaatttttatttattaacagtttttttcctctgatcattattaggatccattttattataaccaactcttagagtatcttggaacagttgttctcgatcagagattttagctccttgggggacagctggcaatgtctagggacatttggcaacgttctgagacatttttggctgccggacatggtgatgaaaaggaagagatgctactggtgtctagtgggtaaagactagggtgctgctaaatatcctatagtgcgcaggacagcctccagcaacagagaatcatctgacctaaaatgtcaataattccaaggttgacaaaccctatggggaacagttaaaggaatgggatgtatagcatgatgaagtgaagacaaaggaaagacctaatggctgctttcaagtttttagagggcttttatatataagatgggttacacttagctctgcttatttttgtagggctcttggatcaacaggtggaaactataaataggcagatatggaggaaagctttctaaaagatatctacaaagctgaaatgtactgccctaaaaaaaggtaaattctcatctgtagataactaaaatgtaacttagtcactagaaagggatgtcctctaattattatacaaaactgatttattgaaaacattttaatcacagatattgtgataggaaattggagtccacattggaaaggtcatttaaataatttaagtggccactttcagatgcaaagcttgaataatttcattcttttgtcaactttggagaaagcttggttccatatacaacattatgaatgtatgtaagtagcacttaaggaagatatctagacttattttactaacccttccttttacttctatatggttttagaaatagatgtaacattttcactacttttccttacataattttctagaccagcagttttctaatttaattgatcatatgcccaataaaaaataaaatgtaaaccttacccattatttgcatgttaatataatttataatttatttttcccacaaattaaagttttaaaagttgacaaaatgaaaaattttatgcattttcctacatggaattggacaaagagctctaactcaatgcttttcatctaccagaggtgagaaggcacagtgttttatttttaaaatgtaaaaaaagataattttaaaatttattataaaatctagatgaatggtatttttttcagacctataaaataaaagccccaattttaaaaattagatttaacagacatgaaattagtgtctaatattcctgtaagagtttccaaatctttacacccaattcctatgtttatctcatcatggagtaggactggtaagtttgcagacttgccccagtctatgagatgtaagtatcgttgcttgtgagaaaactaggcctattgtgcgacctgaacctattgatgtaaaattttgtaatcttaaattggcatcttgaattttcaatccagggcttatgtgagatgtctttaataattcagaacctttcctacctaaaattaggatgctctgttgattggaggtagaagtctgagcttccctttgcaagcttttacgctaattatcacatgacagcaagccattcacttatcacctctatatgctagttttctcatttgccaaatgtgtctaaaaggaccctctatttttccctgacatggcttttatacctagagaaataaatgtgtaggaaagcactttaataagatagttgcgataaataaatgactcctaggaatcccacaccaaggaattcatttacgttcaggtgggtgaacaggtgagtgaaatgtattttctagctctaaacctaagcatcttttgagccacttctgagttttgcaaaatgcaatgtccatccaagctactaattagttgaaaactgagccacatttggttacctggacattccttttcattactaatataccttggttgaggtaaaatgccaaattatatgccagaaacctgcaagaatgacagtaactctggtggctaaattagtgcaagagagaagtttagctgtgaaagtaatctctattattttgtgcttccttatactcaaatcatgtttaagtgtctaatggcagaggagtcgtggtacaaatatgtctgttctcatttctttggggtattgtatacattgacttaacaccccattcccaagttcctcgtttgtaaaatggtgataataatagtacctgcttcatagggttgttgttaagggaactaattagataattcagtcaggaacttaaaagtgtttggtgcacggtaaaggcttaatacatgacaggtattattagtatgaataatgtttgttttaacagaagtacctaatcagaggaaattatgcttcttaacaagtggtacaatcgcttggtaaacagattggtctaacactagaaggatgttaaacctgaccttcttattggaccctcaccagtcaaaggacctcagagtttttcgtcttattctgcttcttagtacagggaacatcatctttcagatagaaacaaagcagtcgtctattattaaggactacaaacttgttgagcttttgctttgcagcctctatggatcacggattataattaagaaccaaggtttaatgcctccttttaatcatgcaaacatatatgacagtaaatattaaataagaaaaaaaatgatactataaaggacttcatgccttccacaaacctagaaggtaaacaagtgtctacttgttggaaaaaacaattgtaatttcccaagaatatatctgatggagaaccaagtttagatggccatatcggggagattacttccagtaaatagatctcatttgctatgaatcatggacatttaacaacatatgcaaaatgttaagacttagaattgtatttcccaaggtcttaatttaatttaatttaatttaatttaatttaattacttcagtcatgtaatagtctttagaaataaaggcaacagactttgattaatctggtgatccaatcctcctcctcctcctcccaaaagtctgtcagacatgaatctgggccagaattttcatctgggaacaccttgaaacctaagtggctgagtgtgagcttcatgtaatccctccaataaggaaactctaacttttaaagggtctcttgacatgcgtggtaattacaggagtacagttcctggtactggtaggtggtggctgaaaaaggaatatttagagcaggggtcagctagctttctggaaagggcctattgtgatcattttaggcgttatgagacggacagtctgtcacaactgctcaactttgccattgtaatgtgaaagcaactatagacaataggtaaatgaatgagaatggctgtgttccaagaaaactgtatttacaaaaagaggcagcaggctagctttaatccaagggccatagcttgctgacccttcatctagagaaatggttgctaatgtaacagggagctactggccaaattaagctagaaggtgtattattttttgattccacagtgtcaatctccatgatgttcatattttctactagttgccaacatttaaaaatcaggagattttttacatacaaatatgcaatctgatatctgaaaaacatgcaaagatctggtaacacccatctgtcttcctccacagcaacaatagttgtgcccgcttcagaacaagaacttgctttcttgttctccacaatactcaccattccctggtgccttccagaaattcaggcccacttccttcatttacactacctgtcttgccctggctctgctcctggaagaacttgattttgtgaacactttttagtagatcttatctttcttcctctttcactccttgttcctgaaagctatctcattttggctcactgaggctgaggaccaggcatgcttttgcaaactgatatatggctgtacaatagtattagtgtctctgagagagtagcatagctgagctctagaagtagtgaacattttgtaccttttgttcatttcctacagccatcctaaaatgatatatcagttttcaagtctgtttccctctcccttctttctttcattcccatctagtacaccagaaaaagtgtacatgtttctattcttatccttcagcattttatatcttttaatcagatgatttgcagtctctttttgtccatctagagtcatgttgttgttttatatatatatatatatatttacatatgtatatatttaataaaagtagattatttattgtgcatcaaagatgatcaggtctgcactgaatgtgagattttaattacatgattcaatgtatttaattcaactcattcaatcctactatgtaccaggcactgtgttgggcattgaaatgtaaagtcagagttcctgtcttggaagaggggtgcaagtaaacagagactttgaaatggagaatcttatctacagaatattttgaatttacaaataagtccatatatgaactaaggagaatggtggaagacacaactctttaccaaaaacttattttaaatgagtggtgagttggtttcagttcagaaaacaaagtattgggataaataggaaattctgtgatttgataaattgagtcatggatgttttatttaacatctgaaaaagtactctgtgctgaagaatgaatagtgagacttcagtcttttaaagacctgtgcagggctgtacagtgtagcttggtgccaagcagacaaaaactaatgaagagaaaaccttgcaaggatttgtaaggcaataaatgaacttcatcatgggtaaatgtgaagtagctgcttgaaggaaaaagaatacaaattattatgagatgatgttctttgggctgtcagttatgctgtataaaaagagtcattgaagaatgttcactaatgacattagtccattatgagttagaaataaagtaccaccaaagtattgggaaccaccaagaaatatatagaaaaccaaacattggttttttaatttttttaatttaaagtatgctcacttatgtgtggaattctgaatgcgcttgtggtcaatacatttaaagcaagatttgtgatactgatttataacacgtacctatgataatccagacatgtagcagatgttccacaaagagcagttaaagaggtatatgtgggcatgtacccgatacatagtgtgtgtgcattagagagctgttgaataagtgaatatgggcagaatgggactgaaaacagtgtctagtgtcttaaaattaataatagtaataatacttggctcattggctgttcggcgaaaaaggaatatgattgaaatatgtaaacaaacctctgatgcatatggaacaggaaatagcctttgtcctagtctatagcacatgaatgggagggagaaggggagcagtttccaagaaaggaatgcaaacctgagaaattgctgtaggacagctatcattgttttgataccaaataataaacatggaactcattctgtgataatgtacatacttataattcaaaggcagaaagtttttgttaaacaaaataatgggtctggctgggcgcagtgactcacacctgtaatcccagcactttgggaggccaaggcgggcggatcactaggtccggagatcgagaccatcctggctaccacggtgaaaccttgtctctactgaaaatacaaaaaattagccgggcaaggtggtgggcacctgtagtcccagctactcgggaggctgaggcaggagaatggcgtgaacctgggaggtggagcttgcagtgagccgagactgtgccactgcattccagcctgtgtgacagagcgagactccgtcttaaataataataataacaataataataataatgggtctatgaatgaatcttaaaaatgctttactcatttgttttgcagaatagtttgtaagtgtacgtgtgtgttgtttgtgggtgttttcccaagtcctttaaatcaggcaaagaatgtgtatataaattctactcttattttcatccactgtcaaactaacttctgtgaaatattctaggaaactttgatcagaatatttgtttttggaagttaagtgacatcattcatccttttgagccaaatataatcagcatccctgtgccaggaaggaaaaaaaatacctttactcttacattgactattccaagaattacttttctgataactccatacagggtttctccgaacctctctgttcatttgcattcctaacaatttgggattttatttagtggtcaagttgtattcaccctggagcctggaatgaggacatccagcctgacaacctgttaaacaacttgtgaatggaataatgaatgaaaaggtcagacagtccatttaaggaataacattttttcagatttcaaatgccattatattgtgacaaaatccatatgtgtttcagtagaacaagaatggaagcaaggttttaacctttagttttaataaatattttttattaaaaaattgaaacattttgattccttaaccagtgaactgaaaacaataattggaaaacaaaacaaacaacaataacaacaacagaatcacaaaaaagtccagccagggcactttctagtttcacagatttggatgaagcaatttaaacatacatcagccaaggtacattcaatcactctctattacttacagcagtggttttgagtattgttttaatggtgttttatcttgagcttcatgatggtattttgcaaagcaagttaagctttaggagtctagcttttgatttcaccatattttttttttgcatttgtgtgacattattcatgttgaatttggttccattctttttccagctcctaattacaccctcagactctgtaaagatgcatttgttcctaagtgcaatcaagaagcatattagaaatcagctgtacatagttatgctcttataaatggaaagtctattacatttgtgttagaaacagaatgttcatactggaattcaattgcagttgatagacacatatcaattgcttaggacatgctaagtgctgcactagatagtgtggggaatatggccataaataaaataccatccttgtcccagaaagctcaggttccaaaggcaatatcacatagtgactaatagttcaggctctgcaattagggcttgtgttcaaatcttgttttgtttcactattcacaaaccctgtgacttctttgagatatagtattctccagtaaatagaaaccataataaccatggaaacacatttgtaatactatataattctgattatataagtagtacatgttcattattaaaaattcaataatgagaaaaaaataaataaaatgagagaaggctcactgcgatttcatctccaatactgatgtaaccaccctgaagaatttagttcttacatttccagaaaattttcttatgtatatacttacattctattaatttttgggtacattttgtctgtactattttggaatcagttttttcatgagcttttttattttgaaatgattttagactggtaaaataatgcagagagatcctatttaccctttgtccaacttcctctaatgttaacattttatatatgaccttacaccaatgctgagaagttaacagttgtacattactactattcaataaatttcatactttatttgtattccatcagctcatctactaatgtcctttttcagatcccggatcccacattgtgtgtagtgcttgtttagttttatgtaacaaggcattttggatatcttttcatatctgcacatgtagctctgacatattgcttttaaaaagtgcaaaacttgggccgagcgtggtggctcatgcctgtaatcccagcactttgggaggtcgaggcgggtggatcaggaggtcaggagttccagaccagcgtgacctttaccaaaccccgtctctactaaaaatacaaaaattagccgggcgtggtggtgcacacctgtaatcccagctactcaggaggctgagtcaggagaatcgcttgaacccaggaggcagaggttgcagtgagctgaggtcacaccactgcactccagcctgggcgacagagcaatactctgtctcaaaaaaaaaaaaaaaaaaagtgcacaattttaatcaattaagtctgtatagttgtagtagtccattctcatgctgctataaagaactgctgaagactgggtagttataaagcaaagaggtttaattgactcacagttctgcagggctggggaggcctcagaaaacttataatcatggcagaaagggaagcagaaatgtccttcttcacatggtggcaagaagaagtgccaagcaaaaggggaaaagccccttataaaaccatcagtcctcatgagaactcatttactatcacgagaatggcatggagataactgcccccatgattcaattacctcccactgggtctttcccatgacacatggggattatgggaactacagttcaaggtgagatttcagtggggacaccgccaaaccatatcaatagtataatttatgtaaacctcttttgactattgatgtttttcatatgaatcctaaaagaaacttatctccatgcattgtatgatttaatcttcactatgacctgtgtctcttagacgccaaactaaggctctttcatctaccctagagtggttccctgtataacagacacaaatgtgttacttttgatatattttttctgtgaccattgacctcctccaattttagttgtgctaattttcattgtatagaagttcttactttgtgaatgattaaatttgtagatctttttatttctgatgacttgtattgttttaaagctaaggaaattatttgaatatcccagtttcaatggctaaagcaagtatttggaatcctataccttatttgcaattttcgagtttccgaataaaaatagcagtgatcctcttttgatgagtgaattagtttttggataatggttaaaaaaatgagccaacagaagatggttttacctcctatggatacagcgcaggattataaattgagattctgttcttgaagcctactcatttcataaattcataaatttaccaaaactgattatatttttttgtttggttatatttatttttgttttttttcccacctggcctggttaatagggtatatgtctgttcactagcacttctatttgggtagggaaaattccctaagtccctcaactttactacggtcttttggggatcattataggacagatgccatcaattttataaaatacattaaaaccctaagagaaaaaaaaccttctctccataagctgtaactctgtgtctaacatccattgtgaagttcaggctaggcaaagagttaaaatcaatgctatttcctacttggacaaacaaaatgaacaggagcctgagatagccacctctgagttcagcttgttgttattcagtttccattctaatacagtttcttccttgctcaatatcagtttataaaagcatgttacatgtccactgaccccagataactaaataaatcccactttatagtcatagaactaagtcccaggttgtatttgtacaaatgcctgccaaagatggatacaaggaattcagaataaatcaaccattaaattcacatttcttagtggaataaaagtaggaatgaggaatccaattcaccatcactctctcatacacacgtgcatgcacatacacatatacacacgtgtgcccacacacacacacagcatggtacattattagttttctttgttggatgcatgttttggttttggatttctttgaagggcatttatgcagagttggttataaggtttggagtcctggaccccagagaactgcatttacttctgtctttgcatgtacctttgtaacatgtacctggtgattttatgctggtcagatttcccatttgaatgaggtgacagcattcagcaagttataagtctctgagatggacatttctgcaggtctttttcatacatttcccgtagaaatcttttaaatcatgttcacaatgaggcttaaaattactgctttcttaaggaaaagggatataatccagggggtttataagcagcatttgatgaaagtctttgaaaagaaagtaaaaatcagttcattttaatgattggcaatcaaaaaaagataaaccatcattaaattctaagatctggtatactgagactgagaaaaaaataaaaacacaagctaccttataaatgcactgctgataatgtattctaggttctttctttttcagtagatcatcctgaacatattagcctcaggttgctggaaatcaaaataatggcatggtgattgttaagagtccatgttatataagggtgttctgatattgaaattaatacttcacttcttgtttctgaaaagtgaatgttggtaggttggtttttgaatgtgttttgaatattttaatagaactgggttctatctaggaggaaataaaactatctctgtggcagacaccacagttcttcttcttggttgtaaacttacttcctagtagcatcagttcaagatgtattctcatggaaatgaattttattttaatgttcagacatgctgattgtggaaagacagtgtgagaattcaacctagagccttgctctggcagtgaaataggatataaaatataagaggagactcatggtgaggtcacacgggtcctgaaatcttccgagaagtgaatcataactcattccaagtgacaggaaacaggtccgaggggatggaaaagggatatgaatcagacctgagttaaagttaacctttacaatacctgtcaaaaattactaagcaaaacagttatatgaatatcaatacatgaaatgctttctccttatttgagtgaaccagctgctctcagactcttgaacagtaaccatatctagagatgtaaattagaatgtcaattacaaatcattcttatattttcatcacattagaccgtggataaattgtgtaaattatttgaaagtaattaaatttctaatctaaaaatttagattcagagttggcatttttttttccttccccccccaccccccccccggtaaagcaccagatagtaaatattttaggatttgtggcccatacagtttctggtctctaacacaggttctcaactctgtcattttagttcaaaaggagaaacagacaaagtgcgaatgaatgattgtagctgtgctaaaataactttatttgaggacattgaaattcagatttcatataattttcatgtgtcacaaaatactactctttagattttttttaactattcaaaaacataaaactactctttgtctgtgggattatacaaaaacaggccttgggccagatttaaacagcgggctgcagtttgctgagctcagttttagataattcacagtaaccactgatttgtgctgctttggacagtggtgtaaagatttacctatagtacattttctaaataatatctaagaaaaaaagtcatgatttttttaaaggacagaatgttttctcccacaaaataattggtcgctgacaatttttttcttgctgctaacctgatttgtcagagaagtgagcactacatctttgtgttatgccctctccccaaattccaatactagaaatatatttatttggttttatgttaaaatgcagatgccatcttttcgtatgaactgccattaaagatagaggagaaagaatgtatattctgggaatctaggggcatggcctcaagttactaatttgataaattgtttctgaagtctagtgctttatcttaaaatattatgtcagttctgcattctataccactagataggtatgtttatttcagggtacacaaactgttttaagtcattgaacaaatatgcagttcctctgtgacctgccatactgccagcataaccctgaggtctgggcataccttaggttaagaaacacagcagcgaggcaaactgattgtttatcagtcccagtttgatggcttcagagcagactttaaatggtaaaggaggaattacacgtgagcatcccagttgtcttgtatagtgacgtgaatggcccctattcccttgatccatggctgctacttgcagacctaactccagcccaaggtgggagaacggcatgatcaccgtctttgaagacagatagacaacggttttaatttttactgttccatgtgtagttagactagttattgagttgaattttgtcatctgaaaaatgaaggtaggatttatggttctttagttacaatccaatgacttttgctaatataattcagaagggatatatcagaaaactgttggaggatgtaacaagggaaaattaaaatatctggttggaggaagacaaaggagagaaataagaggcaattagctttccagggcattttattgagcaactatgagatgctgtggttaagaagccattcaatttgcctgggagagttctggtttatacctgttgtacttgcataattactcaaagctcccctttcaccctcaaaaatgtctctgttcacatgacacattgtcatcttagaggactcagaagtttgatctcacttccgactgtgagttggtcttgctcttttttcctgacactgcaggatctggttttgttgcctgtgttcagagccaacccgtatactccagtatcaattctagattattccagagccacctggtgggggtatccaccgtccatgggaagtgaggagagaggtgggcaaacagacagccatgatattgaacctcaggtcctcacactattttttgtctgggaatggaattagatggtgatatggtgtggatttgtgtccccacccaaatctcatgttgaattataatcctcagtgttagaggcagggcctggtaggaggtgattggatcatgggggtggatttcacccttgctgttcttgtgatattgagtgtattctcacgagatctggttgtttaaaagtgtgtagcaccttcccactttctctcttcctcctgctcctgacatgtaagacatgcttgcttccctttgccttccgtcatgactataagtttcctgaggactccccagccatgcttcctgtacaacctgcagagccatcagccaattcaacctcttttctgtataaattacccagtttctggcatttcttaatagcagcatgagaatggactcatacagatgggacagtccatagtattttgaaatttgtcactatcccttatacacattcatgctacttcagtctaatatccatactgttactcgaaatggctttctgaaacacaattctctctaaaaccctttttgactcctcatttacatcaaggaaaaataaaacttctcaacttgacatacagagcctttgatggcctagcttctgtcttttctttgtcctcccttagttgcccacagcttccctatcttgtagattcctctaatattcagtggcctgcagtccttatggcgccatactcttgcccttctgtgactgggcacatgctgtttcctctggctggaatgctttgccctaccagccttgtgctggtttttcctttcagaatcagagtggaagttggttttcttttcttactagttctttttttaatcttctgtttgagttatccttcataccactcccataattcccttggcggacttcagttctaaaatgtgggaccccgaatttcatttgatagtttccttgtctttctctctcagtaggttattggcttcttggaggcagagaccataattttcacctctgtaaacagtggaatggtacatagcagctgaaagaaggttggataagtggataagtggtcttcatgagaaaggagtgttacttctgggaggaaaaacataaatatgcaggcagtggtgatagggattttaataagacacagagcacggtacagaatgcatgctaattttatgtggggctaaattagtgtgaatctgtgtggcccagtgaccgggcccatttcagcttggtaagaaggagaaagaattgtctgtggcctccagagaggctttgtaatttattttcatcaatacacatgtttcattttctaagtgcaaatgttgccacggtgatcagcgtctctggtttctctgggaaccctctctaaatacaacccagggtacccagagaacatggagaatagaagttggtgatctttgaataattgtggaaggcatgtgtagtcctggaagactcaataacacttcctgaatttataaaatgggaagatggacttcccagccaatgggcttggaagatggacactcactagcagaattctacaaaggattaataagtggacttttttgagtccttagtgaatccatttgggttcctaattattatcttatgggaatcacttggactaaggaggtctgtttgtagcctaatttttccttagaaaggacatctaatttactgtctgtttgcatatctgtcctctccactagctaaataattttatacacatttgtgttcttggtttccaacacagaacatggcatgctgtaatcacagagtagctgctgaaagaataggctgatgaacttgtaaaggacatttgggtggttttgaaacactgaaaaagtcaaatgagtcaaagtataacatggctatttaaaaagttatatgatctgagagagtgttcaaagaagtggtttctacactataattttcacctttgtaaacagtggaatggtacgtacgtagcagctgaatgaaggttggataagtggataagtggtctgcgtgagaaaggagtgttacttctgggaggagaaacacagtagggagtcttagacctattctattttgccctgataggactagaacaggagggttgtattaaattaatcaaactccgtaataaaggaggcattggaaagtgggaaattattgagagaaaaatgtctgggagagtcttaaacataaggagtgtattttggaaaactaggacagtaataaacaataatttttacagagagttgaactgaaagtgcctgcaatgatactaactgaaaagaaaaggcaaagtcactggacaggaagcacacagtccaccccaggaaagctgtgatggctgtggactaaagaacagacaaatatgaatgggaaacagattccaaatacattcatgaaaagagtaacagtggctgtccctgatgacaggtgatgtttttaatgactttttataataacctagtattagatgcatggtgggggggactatacatagatttttttttctcttaattcaaaaaaaatagaacagaggattcttgtgtggagaagacttagggggcagaagaggagttaggagtgctattttcaaatatttattgggtcatgatgtggaaaagagattagaattattctgcatgatttagttagaactgcttacagaaaagctagacgaagggacagtttagctcatattaagtatgtcttatgtctctgtggtgttaaaagataatttctaataaaaggcaaatttatgactcatagaataaaagtaagtatgtgttaaaaatcttacttaactcattaatgaggaaactggtgaggtattacaaccagttccaaggcaaatgcaaagaataaacaaattcagatttgcaaaatagttcccaaggagtcagaatcagatatggcgtaattttccattgaattcccaaatttcccctagagtgtctctttttgaccaaaaatattatcaaagaaatattgttctcaatctgcagcatgaactgtggtggctcctggttctacgtgatgtttggcaccaggaatgacccagaagtagccaaatgatgacctgttggggatactgtagaaaaagtttactcataggatagttggtttgccaggatgactttaaagatagttaataacctcaaaattctaagatattacctcaccactcagggagccagctcctgaacctgtatcactacagctgggtccttttacaaattcaagttcctattaatacaaacaactgtccttccccagcttatgagggtttcctgtgtttctcactgtgccttgagaatctacctgccctttggattctagttctctccttatttgtctgacattcaccaactaaactctcttctgtctcttaaagcgctttcgacttggaaaaagaaacaactgtagaagataagattatgtgggctattttaggttgaatctttacctcccccaaccaccaaaaaaagaaaaggaagaaagagagaaatattgaagtattaacccccagtacctcatactatgacctcatttggaaatagggtcattggagatgtaattaagatgaggtcatactggagtaggttgggcccttaaagcagtatggctggtgtccttataaaaagatggccattctggccaggcacggttggctcacgcctataatcacagcactttgggaggctgaggtgggcagattacctgaggtcaggagttcgagaccagcctggccaacatgctgaaaccccatctctactaaaaaatacaaaaattagccgggcatggtggcagatgcctgtaatcccggctacttgggaggctgaggcaggggaatagcttgagcccgggagacggaggtttcagtgagccgagattatgccactgcactccagcctgggcggcagagcaagactctgtctcaaaaaaaaaaaaaaaaaaaaaaaaaaaaggtggccatttgaagacagagacacatagggagaaggctgtgtgataatgaaaatagagattagagtgacacagctgcaagtcaaggaataccaaacattgctgggcaaaccaccagaggcacagaagaggcaagaaaggactctcctataggtttcggagagaacatagttctgatgatagcttgattgtggacttcttccctctagaactgtaagacaatacatttctgttgttttaagccacctagtgcgtggtactttgttacgacagccccaggaaactaatgtagggatatagacaaatttctcttctatgggctggctctgtgcattgttctaaatgtgaagagccgggtgtaatgtgttatacacatataatgcctggcaaatacaaggcactaattaagtattagtcttcttcactgtctttttttttttttttttttatcttagaacctgtaaattataaaccaagtgactgcattaccacataatgagaggaacgtgacttggaattaaatctgagtttaaatccaagctctgccactagctagctagctatatgacttagtatgacttaggacagttttttttttgtttatttgttttctggataaaaccatttttctggtcagggtaaagatgaaaaacaatggctgtgatcatgtggtacagggtaagcacccgatacttagtaactactgtaattttattcttcttgcatgatgattcttattatattagtgcttcatgacttgcattgctgctagggagtttgtaattgttatatttgctcaaacaattgaatttataatcgttgcattcataaggagaaagatgactgcttttaaaattctctttatatcctggacattttaagacttgaaaaattagtgctttccacttttatttttgaactgctactaaatttaaaggactattaatcccccatgtttatgactcaccaattcatcatcaacacgatgccttttaaagcaatatgtgactcaggagaagcatgaacgaagcgcctgaaagaatttgagggtggggagatggttgtgttgaggatgaaggaggagcatttgcatttatttttcctttgaagtagagcccgaaaagttttgctgaagaaaagatatctgagcatgtgcttgagtttgattcattaattttcagtatatcttaaacttagtttttcaaactctttttattttactatcatatgagctcacagcaggaatgccaaaccacagtgccattgtgtgaggcacaagggtgttgaggacagtatgaaaattcccttttgagtctgattttctgaaataccagaggccacagttctgagtggctagtgcaagggaaagaaatgtacccatgcctgggttagaaaggcaagaagctagttccttcctagctccagaattctcaaagagaataggcttgaagaagtctatattcctcctttcttaagacctacactaaacactaaactctttgactatgctcatgggaatatcacgtagaattccctattgcagaagatgagtagtcttctacatactgtactgctgatggtaagccgacttctcagatagcccccaagatttctgtcccctgttctacacaccctgcataatgccttccattggtgttggcaggactcatgaatatgatgggatagtcactgacttgtttatgttacattatattaaactccatcttaactgacagagagaaactctcctcctggccttaaaggagccaactggtatgtgtggagaaggtcacaggggaaggaacagtgggaagcctctaaatactgagcatgggacttgatggactgccagcaagaaagtgggaagcttcgtcctataactgcaaggaactgaattctgccaacaaccagtgagcttggaaggggcctcagatgagatcagaccatggctgacaccttaatttcagcctcatgaaaccctgttcccaaagcccacctactctatgctgaactcctaaccatggaaactgtgagataataaacgtgggttgctataagtccctatatttctatttatttgttatgcaacaataaaaaatgaatacaattccaatttccaggagcagggtatcaagtctcttagttaataaacaacaaacaaacaacaaccaaaaaaaccactctgtgcacaaccacaccccaagttgtttttgttcaagtaactcacaaaagacttctccgcctcccattatcacagactttcacaaaaccagtgggagcccctttatagctggacatggccatggcctacatgactttctagatgagcctagctgagctattactgatttcgtggagcaattactttgtgtaatcacctgtgactgactgaaagcctattgtttcacacttcttttatgtgtccttataatgattttcttaaggccaattgcaatctcctatgtatttccctaccaaagaataccttgatcttgaatgttcctttatttccatgctgcccccacctttctcccaaatgtacattctaaagggccctttcagcatattgcttatttagagtgaatacatgaagatgccttttatatgcttaggggaagaagaaaagatcatccagtaaaaatttcatattgtttttccacccaagtgtatcttgctcagataaacgggcatcacaaaggccaccctggcattcctgccagcatttcagcattccatgccccatctctctcttaaattggaaaacatttttaccgatttcttaatatgtttgaattcatgtttttcacaacatccctgatatatttgggggtgctggatttgaatatgtaacccttttcttgctaaatagtcgggtttttattaattggcttctgacttatggagctatatttacagctctgtgaggtagataaattcacagcataaaataatatcctcccaatcattcaaggcagtcagtttgcactcacacataacccagatgcacttaaaataaaggtgtctatcaagcagtaagtaacgtgatttctcaattgccctgttcgtagattgagacaagtctatgtggggcaatttttcaagagcgttaggaagggctgtctccataatatttccctactctgtccctttattgatggccaatattccatatttatgtaatgattcctctggcccctataaaaatggaagtaagccgagaaaggagttacctggtatttctcaaactgttatataaaccaagccaccatattttataattctgaaggcgtacagctctcatgttattctatgtgaatggtgccccctggtgatgtgctgtatctatgctgcagtgaacttagtggatgtatgctcaagattctgctttgtttgtacattattcaagtttttaaaaatgttcatattttcatgggaatgagtttatcagttcctctcttgaaagcatgtttgattagaaagagtgcagacttgtttgtgtggttgctttatagtgtcattggcctgaattttttttttttaaaggagctatagctaattaaaacaaaattagcatggccaggtatggtggttcatgcctgtaatcccagcactttgggaggctgaggtggaaggatcatctgaggtcaggagttcgagaccagcctggccaacacagcaaaaccctgtctgttaaaaatacaaaaatcaggcaggcgtggtggtgagtacatgtaatcccagctactggggagactgaggcaggagaattgcttgaacctgcgaggcagaggctgcagtgagccgagatcatgccactacactccagcctgggtgacaacgtgagactccatctcaaaagaataaaaaataagattagcaaaatgttgatattgaaactgcaagatggctacatggggattcactatgcttttctttttacttttgtgtatgtttgaaacgttctacaaaaaaaaaaaaaaaggttaaaacataaaaggaattcagctttagattgttaaaagcacacaaatccttgccatgtaagtcttaaatacttattatacaaaaaatccaaatgcaaaaaatgtttatgtagtagaagaatggaatatgattaaaccttttccaaaatagaagcgtgtgcttacaaatcatagcatttagccatattatgcagcccagaagaataaataagtagatactttttaatatataaaaaagaaagcgtgcagagatcaaaaagacagaagctatgtgagaatgggatccgcaaaaatgcagaataaaagtttactctttttgttttgttctcaaaactcttcctcctgctacttcttttaacagctccctgccatgatccaccatccatttattcattcattcatttacccatccatctattatccatccattcattcattcatccatccacccatccgcctacccatctatctgtccatccatttcttcatccatatattcatcgacccaacaaacatcagttgagtgcctgtcatttgccaagcattaatggatgatccagtacccaatttgaatttctttacataatacctcaatgatccagagagaaagaggacattgaaaaattatctgtcgttcagagattggagagtagtgtgcagcggaatacattcaaacttttgaagacagctttttgcaattgtgccttatacttccttttccccactttctctctccctccccctcttgctgacagaatgtacaaagggtcctagattcagtgtgtactgggtagaggtgcacagaaaattgcctcaagttgtgcaatgtggcagccctatagacttcaggaactttgttttgcaatatacatttttatttgtttcgtttattttaataagctatttttcattaaagcttcaagcttattatctctcctccagaaggctcattttctaacaaggttagatgcagtttttcttcttattgattgattgatttacaggtaagaggagtgaatgtctatatacttggtcaggttcactttgattccttatttctaagatgaattcaaatgtaatgaatctcttgagccagacaggaattcttgttaaatatcacatctctctatttcactttagtcttctacttaatggaaaactgaataggtccaaagattgcaatttctgctttatttggcataatgccgatacaaggatcaattacatcttaatgattatatcccttatacacttgattgcttaggccagtatatgacccattatgtgaagcagtcagaatgctttcaccatctcagaaagagaataacttgagcctgcacaatcaaaaatatatcaccgtaactcttttcttctgaaagatagagccatattcttttgaacagataactgaaatgagaaaagctgacattgtattactaacaaatcccttagacatttgctttagaattaagtgtgacacattgaaagacatggttagagaactgctttagttctctaccagctcaagaacataaacaatatgaactggggttagaaactccttaaagaatccatggaagagaaattcattaaataaggtaaaataacaaggaagctgccatatcatacctttaaaattctcttatgaagttgtatcttgggttcatcatgaaacagtgctcagtgaaagatttgggtgcaaaggatttattatgaatgtgcgttcaggaggaacccctaagggagtgggggaagcaaaattggatatgcggggaaagccaagcaaaggtttgcttttacctgaactcagatctatcccaaaaggtgctctggagcataacttacaagagaccatccatccttaaaggggtgcaggtactaagtatatggaaggtgggtgatgaacacaccatgcttggaaaggaatctacagggagttgcatggggtaccagtactgttcagtgcactgaaatgctgaactcaagattggaaaattttgtcagaggttggtttctgtaaaactctccaagtttgttataacacactctattctggggtcctttggaatagtagtagaaaggaaaacatggctgtggagtcagagaggcctaggattgaatcctaaccctgctatatgccagcaaatagaaaaacctggcctagagtaaatagcaccatccctaaatatatacacattaaatcagcagtgctcctcctcacacacatctgctttctataaaatttaatatttggaactttttcaccataagtcatttaaatctttgtttttgacttttctcctccaggaagattttaattttcaagcttacttctctgcaaaataatgggatttaacctaatttcaaatgattcctggcaacagagaaatacttatggtatgcttatttgtggaaacagaaagtcctttttcttcccagagtcctctctgcagatgcacctgcccactcagcctgcccacaatgcaggccctcttttcacacacccttgaaagaaaattcttcaaggaagtctaaagacaaagacaaattacaagaaagcactgcttttattttcattttttccaaattaagctcctgacctacaattattattttgtgttctttcctcttcctcaaagctggttttactttctctactgcattccctgatcctaaggtatctggcagttagtggtcagcaggctgtcaggcagctcatcatttggtcaggatccaggctaccctctgcatctctcagccaaaaccctccatgtgtaccctcgtggtttttaaaagaagacaaatggcccttctgggacccaggtagccagatggaaaaacatggccctccttggtcttggctggggtgagaaccttcttcccgagtcattcattagctcaagcttctttcaaatcaagagattccaccaattgtggcagggcatggaggcttatgcctgtaatcccagcactttgggaggctgaggctggaagataagttgagcccaggaatttgagaccagtgtaagcaacataacaagacctccttgtttctacaaaaatttttttacaaatttgcaaggcatggaggcatgcaactgtagtcccagctactaaggaggctgtgataggaggattgcttgagtctgggaggtggaggctgcactcagccatgatggtgccactgcactccaacctatatgacaaagcaagacctgtctcaaaaaaaaaaccataaataaaaataaaagaaagaaattctaccaattgcaaaacgttaggctttagaaatctttcaatcataggatattattgctggagggagctttagagatcattttgtcccacctattaatttcagagaagaatggactgaagcttacatagcttagatgttttccgcacaatcacacagtagacaatgctagcaactacacttctatgacaacaatggttgccagacttttattcatttattagcattatagcctctgttttgaaaaaaatcttgctgtgaaatataccaactggacctaattcgtatgaagtgggagatggggagcccaaaatcaaatctatacccctttcttctttttgcagctctgtgccaaattccctcttgaaaaacaaacaaacttttaatggctcttagagacctaattcagtgctttaagtttctgatgggcctttattatggagcttgattaatattgtttagaaagtcctgcacccgatcatgtgtttcaagcttggaatgtcccgtaaaaaagggaagctctggccaaacaggtcagtgtcagtttgggtccagagcctggaaagaggatcagggaagctggagaaagaaccagatagtggctgaacagagccctgagcttccaagccaagtttggagtctaggaaatagtctgcaaggccaagtggaaggggctgaactgaaaagagaatgctgagccaaggttcaggagctgggttagaactggatggaaggaaagttaagggaatggtattcattttccattgctattttttgcagaaattactacagctcaaattactataaatttggtggcctaaaacaacataaaatgtattatctcaaagtttgtatgggtcagaattctgagcatggtttagttaggttgtctgcccagggcctcaccagggttaaatcaaggtgttagccagtttttattcctttgagaagttcagtgttttcttccaagctcctgtggttgttggcagaattcagtatcttgagattatagaatggatattttcactttcttgccagccgttagccaggggctactctttgttcccacccgatgttccttgccacatggttctctccactgtagagcgagttttttaatttattaggagagcatgactttaatgcttgaccatcttttgaaagggctccatagataaggctgggctctcccaggatcatctcttttgcttgaccaaagtaaattgattagtaacctcaacatgggaatgacaatcccgtagtattcatgaatcctttccatactctaggggaggggattatacagggaatgtacaccagagtgcgggaaccttggggtggtcttagaattttgtctacaacatgaatgaagccagagagagcaaggacagtctttctggcttcaaatacagactctaccacatggaacctgaagggccttgggtggggaactctctctaggtctcctttacgccttaccagtaaaatggaattgtaatcatacttagctccggggattgtgatggagattcaatggaggtatacacaaaagttcttcatcactgcctgacctagggtcaattcataatgaataccagctttttaaacacgtggcctgtggctcacctttcaagaaccacctgcactctgttagttgtattggcttaagggttccagtcaggaaagatattttcccttttaagaaatacgaggtcatgaagcagctcagaacttctttattgggacgatgaactgcaggtgctggcgctcctagatgtcccacacatacacccagcagagcactgggtcctttctcatggcttgccttggtggcatgccttacggaggctaatggctaagcagaagattaagccttagccccaagctaaaaagggagcatcatatgttcacattggagaataagaatgaatgaatgaataaatgaataaataaataaagggaacatcagggttggctcaaatttcctgatgacatgaagtttgaattggcatctgaaagcaggtagaatttggattgtcaaagtcaggaagaaagtgttcttgataatttacgtaaagctcccaccccagggctcggcttatctcttggtttgcctaaaggcatttctcttctcacatcaggggagcaagtaacttggagcgagtaactaacgtacattgtgtcaagatcttatctaattttaaaataattaaaacctaattaatttacatattctttaagtctgccattggcctcttaacgtatgtgtgccattagcgtaaattgagatcatgcatatcaacaattgtccacttttctcaaaactgaaagcctatgtctttcttacattgaaggctatggtttatatcagcagtgtggtggatgaaggggaacatgaattaggggtgatatctaaagttccacaacagtgggcatatgtatacttccaatatggagaaagacatttcaagttgttcccaacgtccagtaagcctcatgtacatttccattttctatataacatgcaatagctcaactttgcagataccttgttaactcacttccttccccacaaatatacttggatatgaaaatttccaggtgcttgctttctttagctattcttgctattaaagttagttaaaaagttaactgtaagtgctataccttttttgagaaagctgcagctgtttgatccagttataaaagatctgtaaggcagcctcaagggatatgtggagaattttcatcagctaggcaatttatagttctgtttagtttttactagatgtcacgtattcccaaaaaagttacaacaacatcagcttcagtttattattagcatacacctgaaaactctttggaaacaaagagtcttcaaaagactcagcatgatttacagatacagtgcatgagctattttctgaggaagttagcgtggaagcatcagtggttactagtgggctgcatgactacttgaatgaccaatggaatcagacaactgttagtaacagttactggttagaggagtcgaggaggcttcctggaggaggcagcacttgggctgactcgttaaacgattggtagaagtgagataaaatggaaggtggtcgtggggaaataggttccacacaggaagaccggtgagaaaacaaggctgggcaggcaaaaaataatgttagtgggggacttcaaacaattcagagctgttggaggctgacctgtggggaagtgagaaagggagtgtaagggaggtcaggtcaaagagggaataaggtctacataggtcacaatggcttgttgggcaatttaaaggaatttaaattgggcagtttaaaggagtttgctgtgggcagtggcaaacaactgaagggttttagtcagggcagagttaaagatagaactgcttttcaggtgggttcttattagagtctatcttaaatgctgtgtggaggaaatagattaagtgggacaactctgaaggcaggaggccagtgaggaggctgttgaagtaattcaggctagcaatgaggaagtcataagcaggtctagcgtgggagggatggacaagagttaaagcacagcttctgtacttgttttcccttcatgggaaggaatagagcatgccacttataaaatgactatagaagccagactgccccagtgtgactctttaagaactgcctatgtgacctttgcaaacttccttctctgtaagataggggtgagaatactagtattgcaaagatcacacctattaatacacggaaaagcactaaagagtatttggcacatcttaggtgttcagtatacgttagtgattattgtgatgaaagagtttagccctgaaacttgcatttctcagacaaactccaagagttggaatcctgaatcagatacttgttagggtaccatggcaatttaaccatttcgttccctagtctcctcatctgtaaatgtagataacaatagtatgtacctcatagggttgcagtacgaattaaatgtggaaatacatgtaaagtacttagcaagcgacggatgtatcttaacagccaatgactctttaccactaccaccaccatcatcacctaggcaactcttttatttatcccttttactttttttgagagtagtatatggtggctactagttatatgaaaagtgaaatgctccccacatagtttggttttcttacctatatttgagttctcataatgtaaaactactctgcctgctaaattaacctcgatgtttcaagagaaaaatctatgacacatttactaatcttttaattttatatttgtgtaatacctttaacctatgactatgaagtgaaggtaaaagtgctaattttttctttattgtggctgaaattttattatgaaatatctcttggctttggtattcacataatctattttgtaggaaatgtcattattgtcccccagttggcttgctcactgtcaggaactaaggaataagactcgaatttagcacttagactgggtctctaaattgcaatagaaaatgctcaatgtataatattaccatgctcaatctattatgcaggcattactaagcatccactgagtgcttccatctttgggctaagggttatgaagatggaaacaaatttgagtcaaatagatggctgtcaaggtaggcagactcaactggcattgatgggtgattaatgagcattgagtcctgtgtagggacgttaagcactgtgattgctcagatttggcaagacaggcacttcactgcatcctggagaggcccagacctgggatcagtcctagcaatgaagcctttgccactttagaaaagacatttcctattggatggcctcagttttgctttcattaaattgggttggcactagatgatatctaagttaactcccaacttttacacttgctggttaaatgtgagacgggtactttccagaagctttctaaagaataaacaagtggggctggacacagtggctcatgcccgtaattctagcactttgggaggctgaggaaaggaatggaacaatcacttgaggccaggagttcaacaccagcctgggtaatatggtgaaaccctctctctactaaaaataataataattttaaaaaattagccaggcgtggtgacacacacctgtaatcccagctactcaagaggctgaggcacaagaatagcttgaacccaggaggtagaggtttcagttagcccagatctcacattgtactccagcctggacaacagagccagactgtctcaaaaaatatgacaaacaagtgtatcttaaagttattgttgttcttgttgttttttaaggaatccgtagctttaccctacaacatatggactctctctagtctatattttatctctggatcaactcttatcagaccatgtgtgctaggtcctttatggaataaatttccttgaactgtgctatgggatttatgcaaaaaaaaaaaaaaacaaatttgagattgtgttgattgtgtttatgtagtgaaggaaaccactgacctcctcatacagagttccctccatgaagccatgttccctgaggaattccctgaggaatatgcttctttcctactatttctggcaggtgtgcatctgacatggtctcccctcgactttgcaggctaggaatcttggcccagactagtgattcaatatgtacatgggtgacacatcctcattttattcttcttctttttcgtttatttgatattcatttttatctttgttattttttccatatcattgcatggatgcatctgatctacctctaattatctgtggatcaaaccaagcagcaatgtgtggtaaacagaaggtttaggtgccaaaagcagagtctgtgctcaggaggctgttcactcttctgtgataaaaataacccctcacgtgggtataacacatttcaatttacaaagtactctttgaatttttattactaccttgtgaagtgtgtggtgaagttctttattttcttcattctacagatgcagaaacttgaggctcagggaaggcaagtgatttgctgcatgttgcttggttttgaaaggtgcagcggtctgggtttaacaggaacatttaccagccaaggttcagcaagaggagcttttcagtcccctaatccctcattatccctaagagaggtacactgaggccaggacaatgctgatacaccatgaagtaatactctacggacaagaaattgtcctgctgatgctcttatggtataagtgtgaaaatggccttctgtagggttatctaacatattgagctcagaaaaaaggcagactgaacttggatgtcttctgtctaagagtgtgctaggaaatgccagctgtttggcacctgaaaaccttggggtccgtgggtacttgggaagccaagttcagcacagtactaccaatgagagaaggaggaacccagggcccttctatcacccagggaagatgtggtccccctctgctgagataatggttgtcatcagtcctagctagcttattggcaggtaacctacagtacatgctgaaccaaattggacagtccttgtctccacacattagttataaggtaatagagcttggactggaacgcagggctcctgtcctcagatccattcttcactccactgtcgcattacattggttaaagggccatagatattcaggcttgagaagcagtattccccctggagaaattctcaggacagaaataacagcttcctctgttctactctcattgtacctaatcctttattatgtttgttgacctgcatatacttctgcccctctatagggcaatgcctatgttctattaattttagtagcctgcagcagttagtatagtttatggcatacaacagatatttaataaaacaacatttagcttatgaattcagtatctccctgttaactttcaaaaatgagttccttggtatacttaaacttttttagtctgcctagtcgctcattgatttttatcaccaaaccaaccccacaaaacaccatacagagttcattatgttgatgattactacctgtagagatgtccttctgattatctcatgaagctacttccttctctatgtgccctcttgcttcagacctcatcatctttcatttgaaatatactgttacgtgaagtctccttattgattatctgacacccgtcttaactgagaccatcttgcaccttgtattccacccttgctgacctgcctgtcagattctaaatacatctgatgaagtcttcccattcattcttcaagacccagctcaacaatcaccatagcttcaccttgatatatcatacatgccaatggtttcctgggtcatctctcaagagaatgtattggctttagtttttgcttttgaatatatgctgaaaaaattggtcatattctctgcaatttattgatgatcatttgttatagtggcatttgccattgaaagtaaatcaattttcaggcaagaaacctgaaaaggtataacttttaggtttcagggaaagaatataggatccttgtgacgtgagagttataaaataaaacagtagaatctataatcctggaatagactgacttctgctaaatggtcacgtgtgtcctctaccccttgttccacattcattctctgtatccatagcagaagattcttgtttatatgtttttatcacgttcactcacagtaatgactctgctctttgttatttatctttgttagcaaagagacactgtattgcccttcccagggtacttgcactttaatatcatctctcagggaagggaaggctttggtggcaacttacaaaacaattgcaaagaattgtgagcaactttagagagccaaagtttttgctttgggtatccagtcattctctgggaagtagactaataaattcctgctatattcatccctacctttttatgcctgctgaactatatgtgaatcctcagtatgcatctacttgggtcaacctaaggcaaaattgtaaaaaattcaaaagcataatgagagttttagagatggaaagatattagagatatttttccaggataatttttaccttgtctatcaacatcagtgttacggtttgaagcctttatccaaaacaactgtgaggctacctctaggtactgtgagcaagacgttgggattgttagcattgtctgtcatggttataggtgagttcaaacatgcttgttgtatcttatacaacttctatcccagtgtagggagtgcctcttaaaacagatggtactcttactgctttcttaacacattggtgggccaagactattttattacatgaggtggtggcattgtatattgacaaaatatatatcattgtcaaaatccttgaatctcaaaatagggacatactaaaaatatctgagtgaaaattaaaaggagattcgaagtcacttattttctatagtttacataatctggtagagaatagagtactgtaatactactaaaaattacagaattgtgtccaaggtcaaatttaatagtgataggatatttctgcttttccatataccaactacatatctgtatcttttagaagtagagcatctcctatagtctagaatgattttacaaaatcacttcgttaaaagtatgtaggagggccaggcgtggtggcttatgcctgtaatcccagcactttgggcagccaaggtgggcagataaactgaggtcaggagttcaagaccagcctgaccaacatggtgaaccccgtctctactaaaaatacaaaaattagctgggcatagtggtgggcacctgtaatcccagctacttgggaggctgtggcaggagaatcgcttgaacccaggaggtaaaggttgcagtgagccgagatcacaccactgcactccagcctgggcaacagagcaacactctgtctcaaaaaaaaaaaaaaaaaaaaaaaaaagtatatgggaaaccataatggtgacttttgctctggatttaattctcatctgttagataatgtagatgttttaaaaatatacaaataaatagtcttggaaaaatatgcccataacttcttgaagttcataatagcaaagaaaaggaatatagggcatggaaccttatgtgctgggtagttcacaaaagcagatataaaaataaaacttcaaaggaaaatggtaataattccatggctgagactctggctgtgtaggtttaaaagataaacgttcagactatgttgctgcaaatagtttgaatgagagaaaatgggatgggccttctctgatgagcttctgggccgtgtatagaagatgaaagaagaggctcatggttaccaagactcaggttaacgtttaaaattgtctttaattctggatagcattttagagtgacctggtttattatatatacattttctattttggaaaatatatatggctataaatatttttaaattctttttttttgtttgtttgttttccctccaagaatcactacatttgttcacctatgtcagtgttttttagtatttttttcatcactgtccccttaaggagtctttttaaaacattctttccccgtaatcacctcttatatataatgttaataccacagatatactgcatatctatttatgcactatggccttttggagggccgttgtaatctttaagcttttttggcatccaccaagaatcaatttttgtccctttgaaaatgaaatatctatgctacaactgatttcctctatgcagaatatatagatttgagctattttggggcatcttctctttcccttaacattttgtgttgtagctcccttgcttacacaagagagtatacccacaagtgctcctctcttggtgtgctaaagacacatcctttgctttgcaagatcctgtggtcctgataccagaaactaggttctacatggtccacaccagaggggggtcctacacattaattcatatgcataactattaagatcccattagctcctctttcaggaacataaatgtaaagaacagagaaaaaacaataccacctggcttcttcccttccttcagttttttcctccaggccaaagtctaaagatacagccccagtttctttctttatttttcaagaaataacagttgtttagctgggctttagcaaatgtgtgtgagcactttcttgacagattctctgtaccacctcaggtgtatactacaagaagacaaacactcttattggataccatatcagttttaggtacggttttcttcactttcctcaagagagaatctgtggccactatatagctttgtatttcttttattgaatgtgtggttgcatatcagtcaggataaattaggttatgctgcagtaacaaaacaccttccaaaatcttgatgccatcatctccatctttcttgtcacatgatagatggaacgcatagtctggagggtctcaattttagcaaaggagtaacacgcataatttatcttcccaaattgttaggcagaactagtctcataatcccatccaactgcaagagaggagaaaatgcaactctacttgctgtgaaagaagaggagagttagatcttagcagaactagtgataccataggatagtaccagggttttctctattttctggattcttccctctgcataatagatggatatttcttcttcagtatctataatttctttataacttttctaccatacaaagtcttttcctttcttctcctgaatcacattctttttctcagcaatcatttaccatttgatttgaacgtctctctttctcataatctttatttttatttattttgttgatttagattgatttcctaactagattttatatatctgtcctgtttaggcactcactgtgttaggtaacctggtttattgagggtgatgcaggagtttttctcaacccctttgttggacttgcgatgggggtgctctgattacttggccagccgtgctcaacctcttgaaggagggagtgcatgagtgagcaagtacaggatccagctgtccactttgggtgccagaaggagcaggctctgtgcaggccccctggcagcacccaggttgggtgcctgcgacctctgaagtcccagagggcatgttacaatgctctcttagctcctctgttcgtggacagtggggtgttatcatctcagtgggccccttgccttgtcctgtgtggtggccgccttctaccaatgagtgcaaacggccagtgtgacagccttttctgggtacccacactcggtaagtcccaagctcttgtctggtgtccaagaagaatgaggtcacatggacccttgaaggatgttagatgtggggaattttatttagtgatggaaaaggctctcagaagagaggggagtgggagaggtgaccaggcaggcaggtaaacttccttgaagtcaggccgtctctggccagctcttctccaaagttaagccatctctcctccaaagtccagccgtccctctgaagtcaagtcacctctctccagtcaagccgcttctgtctccctgctgactgagtctgggatctttataggcacaggatggggggtgggacaagctgtaggtagttttggaaaaggcaacatttgattgataaaaagacattattcaaaaagaaccaatcaggagagagagggcacacagggatagaagttctcactttgggccgcaggttttaggctttttggcttgaaggtgcggtttcatcagggacctacccctgtctgtctagaatttctctgccttcttcctctatgaagaggagtgtgtcaagtcctttgatttctccttttgcagggagatttgcagcacacattcttagggtgactaaaagccttcaaacataagaaatggatcttatggtaccaacaatttctaggtgaattgcccatcttttttttttttttcccccttggaaactgctcattttcaggaccattctcatgagtttcaaataggatttttttcttggaattgaattctgtcaactgacccaccatcaccaagagaatgcccagctctgttcttctttgatggaaatttctctttctgtgtctcagggcttcccatatgaaaaaaagataagatgataaattaattgctaatgggagagaacagaagaaggattttcacaatcttctcttttattcccttggatagctcagaatgacataatagtatttctgactcagaagctaaagctgagactcaagaaggagtacctgggtcttagataactttttgagacctcaaagatattattgcctctttattttgctagaaattgattatttcagttgccagaggctgacattgggatcttattctcttgagctgcattagaatgagaaggcattcatccctctctaatgcttaaaagaaacttttgttacatattctttaaatttgaaatgtgttttttattattcaccacatgagctcagatttgtaaagaaacatagaaactgaagacctaatttacttcttgctctgctttgtggaaaataaagcagaaggggatgatggccaaggtctggtggcttcagccgaaatcaattgaggcttcagattccatatgaatggcaaaagcctcagtatcactgaattgcatgtctgtttcatccttacagatgggacaaaaacttgcccaaatccagatcaaaggaaccagttttgatggtttttgctaaggtctgggtgtgtttttccttatccacctctctttcacactattctgtctcttctctctctctttctctactcctttcaggtcaagtgtatagatgacctccttctcattacggacaacagtgggattcattatgcagaacatatctccctgaggcagagtgtgtgaagccacccaagcttaacatctctggggcaggaaggggatgtgctcaggaaagcctttgtgtccagactgagctgattggctaatatgcatcttgcctttggccacctcatgccatgaatatctaagcaacattgggtttttttctcagggcagaagcagagagatggaagataacagaatggtgtttgttacccatatgtaggatgctatttacataaaagccgcagaagctatgtgatttccatgcggtccttaccgttttgcctcagctgggtacctgtgcaggccagggtgactggctgcaaatgagcttcctacttgtctcaccctacacagctctgcctctccccattaatgctccccatctggtcctcaaagcacctcaaataggtccaagattaactctggctgaggggaggaggtcatttttcaaacatggttaagcacgtggcaggggctgagaatatcaacttttctttctcaggaacatgtgaacttttttagtgttaagcaacacctgaaaactattcatcttaatgcagagttagtttataccctgagaaaacaggattaaccattcacagtcctgatcatctatgtttagttctctctgtagtctttggaagttacctgccaaggacagaatttggtctcaagtgagcaagaaatacagacaaattaagtgccagattccacttttctaacaacggtaaattaatagtccttacctaatggtgttctttttacttgagttaaggcataactgaagttttctcttccatgtgaaatcagaagagatttttatttctttgcttcattcctctcatgaggggtaagttaagttttgtttttggtagaaacttctaagttccaattgctttctctcaccccacccctccccagaaaacaatcctcctgtttgtctgaaatgaagaaggaaggcaacttggtgctgcacagaaaggtaaaaagagatggatgggaacatttgtttctgaccttcagcgaaagaattcagttaggcactataaatttgttttctgcaaatgggagagcataagtgtgctccatcagggtggaggaaagcatttgcacccaaaacatggaacacaaaataaatcgatcaaattaatttttggctgtcagccctggaggctcatttcccatcagcagtatcaggaggaaaaggagcagttaacttgtaatgattggggaaggtggggaccacggatggatttgctcaggggcactgcaaagggtgccttgctttcactcttcccaccaagaatttgccttgtctgtaatcacagtggtctgctgctgccatggaggaagtatgtaagttgccctggggcccagctgtgcactgttctgctggccccagtccttgaccttatctgtaggagttactcctttgagttaaaggatgacaggaccacttacaggcgtctattaatcttgtgtaactgtataccttttgccaggcaaggaacattcctaggggatgggtgatgtcaaggaagtgttcattgaggaacttgtagagagaatgtctagagccgagagtaatattggggaatcctgccacaaaatggtgctcaggacaagttttgggccacataaccccaaatcgttttaataacattggaggctttttgcattgcatcaacactgagtcattttctggacaatatttattttactgtttgttgcctaaacttggtctgcatgattactttactgatccaggaaactcattttatgatcagagtgtattgaaaacattggcttgtcagtatggatcacactaaccagatatttgccagaattcacatccctaaagtatgctatttctagggattacaagtaaaacaccttcaggtgacgggcagtaaatgcaagcatttgctccaaggcaagacaccagacttgccattagactgcagatagctggaaatgctgtccttcactcaaagacatttatattaaaagctttgaatttgatctgtgatttgacaatttgaaatctcaatggattattgaggtgattcttcaagcatatttttcatattcagttaagtaaatgatgaaatattatttagttaaaagcagagtgagctgatgatctctagtggatgtggaatgttataatggaataattggatcagtctggtcttctggtattggaacatcatttccccaatctgtcaagttctccccttcttcctacacccacagaagcacagattttggttattacactgggacgtctccaactgtccaagaacattccatgtccttcttgtctttatggatagaggatgatggatgatacccctgccccaacatatacatcatggatattagacatgttgaaatgcacagaagttatattctgttgagtttctgcctaaacctggaatttggttggctctgcttcctggttgcctgtgatactcagtcttcagctggtctgcagtgtcgggttcttagtgatcactattcatctcatcaataattattatatgaatggcatgttgtatataccataaaaacacacttaatgtgttttttgctactagattctcaaatattcttgactatttatatgagtaaatgtgaattagttttaggaaaaatttgattcctgaaggaatctgtaagcttctttttgttaaaaatattttttaaaaaactctatagcccattatttgcctttttgccttagctctcaaggaaccaaatctaaacctagtatctgattgtaatagacttatctgtgcattttcttttcctggtttctgttcacttccacccctggataattaagagggtaagataatttacttactaacacataaatgggatttttttttgaaatctggcattgcttagaagaagggaatccacaattagtaagttttcatggggcagtgaaaaatatgaaacacctggagcttgatttgataagggaatacaagaataaacacctctctttctcttttgtgtgtgtgtgtacgtgtgtgtgtatgtatgtgtgatttatattataaaatcaaggagcatctgagatagaaaaatgtagctgagaaagccaaaaggaaaatgctgtaggaaaacagattagcattgtgaagtcctagaagcattttttgaacactatcatggattgtgctttgtgctgatgaaacaataaaacacagaaacgcattgccaaatccagaccgaaaaagtgacaagatcattggactggtacttagggtgcctggttttgaaatctggtttggtcactaatgaacagagagagcatctttgaaaaaaaatcacactctaggtttccatttggatgctctctacacccccttctagttttcacatcatgagtcacttaaaaatgcttccatattgcataaatattggcaacagcattgttactccccagcatgtgcctgggcacagctctgagcaatagagaataataggtcagaactaattccttgacctgatctattctgacctcctctgaattccacgtcctagaaatttttatatttattcaaaggctgacttttctgtttggtaatatttcccttagattgtagaggacaactacatgctagtatctttactttcctgctgaaatagcccatagcacagtagtttgggaatagctctactgaacttattgaaataactaagtcctaagaggctcagctgctcatcagatgcagacccataatggccaggtgtcctcactttggggaagtgacaccagagaccatcctctggaacaacatgcagtggaccacatcaggagactggtcacgcctgtcacaccttcaccacatggtgcattgtccttcatctttctaagatggggtcacatcattgatccactgttgcttagaagcctctttcctttcaccccacagagtggaacaccccctgtgtttccctgatttcctcatccctcctcctccaggaatgctgttaaaatagaaatttcagctgagtcactttccaaagtgaggtgtgagaccaagagggtgtgtgtttctaagcagctggctaaaagatggtgaatgaactctgaatatactcacccacactagagacataaagggatcaataagcatatactagatgggacacatttttggagaaagctgttggtggcctgtgccatccccttttcattatcaaaaggaaataggccttgatagaagtgcaaggagagaactggaaaaattcccgacctgccagcggggaacacagagaaatagggtttacttcaggctgagggcccttgtcggttcaggtattataacaaaatagcatacactggaagtcctaaacaacagaaatgtgtttctcacagttctggaggctggaagtccaagatcatggtgctagcatggtcgggttctgatgagggcctttttccggagttgcaggtggctaactccttactgtatcctcaccttgcagaaagaaagctagtttgctctgtagtttctgcttataaaggcactattcccattcatgaagactccactctcatgacttaattagcccccaagggctccacctctaaatatcatcacattggaattagggtttccacatactaattttgggggtattgtactgagagactctaaagagcaagaagccggctgcacctgcttccacattgattcggtgaaaagctggctgcattaggattggcctacactgccagagtttgtcagtaaaaaagagtggtattttctgtgagttgagaggtttggtgtggaatgatccaaggtcctgttcaagagggctgtttggagagtggataaacctcagtagaaatattgaggtattactacatggccaggggctgaggcaggggtaccaggtgaatgaggatgagatgcactggccctcagtgagagaaacaaatcactgatgagaaagccagctgtgagcacccacgaagccctgacagcccttgtgctggggccgcgtccctgtgtagtgagcaaagatgttccaatttccccattcttttctcccttcctctacctaaccctggagaccagttagtaagttgagggaacaggatttgaggctaccaagtggaagaacaaaagagaaactgagtgcctcctcgtacctgctatactcaccaaagccccatacagggaaggagatgggagtctttatttccaaacaaaatgcaagttttaactcttacatggaactctatgtagaatcattgctccctgatccccccacagttgctcacatcctaatccctggaacccatgaatatgttacttcatgtggcaaaggggaattaaggttgcaaatggaattaagatttactaatcagctgaatttaaggtcaggacatgagcctggatttatccaggtgggcccaatgtaatcacaagggtctttatatgtgaaagagggaggcaggagagttagagtgatgcaaggagagaaagacttcactagccgttgttagtcttggagataaaaaggagctaggagccaatgggggcagcctctaggagtgggagaagacaagggaacgaattctctcctggagcctccggaaaagaatatagcactgctgacaccttgattttagcccggcgagccccatttcaatcttctgaccttcagaaatgtaagataaattttgtgatgtctgaagccattaaagttgtaatttttaacagtagcagtaggaaattaacacactaaataactaaatcaaaactgcattacttcagaagaagcagaaaagtcataggtagagaaagaattagcctcaaggagtaacttaaatgaagagagggagatcaaaaaatgaagtcactttaagaatatacagccccaagtggtttctcaacctaacagttacatatctaaatcaggttatctgtccatatttctttctagaagctccccacaaggccaacctggatcctgtgtttctcttaagtgtgttgtgcattctctggttctgaacaaaggtcatgtccaaagtccatattcggaaacagttttcatggagctctactcatttgcagagagagtcagctctgtcagggtgattggtagttagtgtgagcctcagctgttctcaaggatcctcaaaagagagtcttaatgagtgctgcagtcttctgtagcaagaggatgggagctgtgatgtgtttgagcaataaagttggagatccaagttggggtcagacagtggaggacttcagatactgtagaaaatagattgcatttaatttcaataattagaatgtgtgttgataaacatttgaactgtgaccgttgcattgaaggggttaggaataaagcggttggagatatcttgctgttaaaggtgacgggactttaattgccgagtaggaatcttagttttctatcctggagatttttgtccccgcccaaatctcatgttgaattgtaatccccagtgttgaagaaggggcctggtgggaggtgattggatcatggggatggtttagtaccatccccttagtgctgcttgtttaagtatgtagcacccagcccccacttcttgccagccacgtgaagacggcttgctttccccctcaccttcctccgtgatggtgagttccctgaggtctccccagaagcagaggcccgtacagcctgcaaaaccatgagctgattaaacctcttttctttataaattacccagtctcaggtatgtctttgtagcagcgtgagaatagactaatacaatatgtcattagctgatagtgacactgagcaggagaagacggggtcctgtggtgcatatgttttgtggaattcatgcatttggggtgattgtgcactgctcaattggagctatcaaccaactcagaaaattacataaaggtaagagtgagaagccagagtctgggataatgagttgtgtattttcaacccagtaatgaaaatagggtcagggtgaatgagatcatctaacaaggaagtattgaataggtgccatacctgtgtattagaggaaaacatttatttaatgaaaaaaaccacttgtagcaatcttgaacatgtcaagcagcctcagtgggagagcagaattcaaatacatgggtgagcagaaaggaaagtgaagttgtaaatgcaacaaaggctgagtaaatatgaagtcggtcccggtgcatggagagaggcaacttttcatagaataaaaaaagatgtctatgagctgtaaattgagagaagaaactccgtatgaatgactggggcactggaaagagaagcaaaaggaggaaaatgttagtgatttggtgataatgttaggcctgcgtgaagagaaagttataaggtagatggaaagaggaagataggctacgacaattcctactgctgatattaaacctaaataacagtatttatgccaccatggggtcttttctattgcagtcctgagtgaatgatggggctgggctctacagcgagctcggctcccctgttgtaagggtgtaagtggtacatggacatgcagccagcagcttgcacacaggaggggctggcgtctgttgtgttctcagtatatttcatgctaaggttaatacagaagaggcaggagatggtccctgactttgaaaagttgataatggggaaggcaagtcttcacagaggacaacgttttaatataaccaatcttgatacaaattctttacactaatgtggtaagatttcagagtaagggaagattacgttgccatacttaggggaaattggttgaggaaggcttcctagatgatgtgaggcatgactttgaccttaggataggcagaggtagaagggtgaatcatataagcaaaagcatagcataagactttttgctcttggcgctgaggagttgtcatacctgcctgtgtagtcctgacaaaagcatagctgctgatggggatgacaggccttcaggagatgtcctgcagggaaatagctggggagagggactgtggcacagtgggaggagcactggtttgggagacagaccattgaatattcctggctctgaacctgaccatttaggtgatcaggggagatgtacttcacctccaagtgttctcatctgtaaattaggggttagaagaggtacctcataagatagtatcttgtatatcctcctccacattccttgttctcttaccttgaatatataatagtgggtgtacgctttccttttcagaagaatctgactccgcctacctgctctttctcattttcttctgattcatcttccaaacaggtgtgcaagtgctctttaggtgacatttgcccagtggtcactcacctgcttaaagttctgcccattgcctacaggtgaaagttgttataacatctttggtgctgacttccatcccagccatattttctgctgactcccctcttgcagactagtcacgttgaactacttgccaatctccaaataccccagtctctttggccatggctcacattctttcttcttccctagaatagtctccctatgccactagcccctaatttttgccattacctccttccccatcttagggtctgccttgttgtaagcctagggacctgtgtatctttgaagcttttcctaaacaactgccctcatacatgctctctcacacacaaaaaaatgctctccacccacttggtggtcccactctgacaagcatagatctctactgtagcacgtttgtatttgacttcattcgctcttttatggtctgtattatctcattagatgtctcccccttgccacccccacctcatacttttaagtttttatttacataggtttttggggaacaggtggtatttggttacatgagtaagttctttagtagtgatttgtgagattttggtgcacccatcactgagcagtatacacttttttttttgtatgacttccagaagcttatgtggtgattaattaaatgtggtgagtgagtgaatgaagcagaagacaagcaatgtcttctcactctttcctcctctggtagttcctgtttgtgctggggcaggattgcacagctagagttttttttttttaatagcaatttttgctaccctgcctccccaacacacacagtctcaggacccctctcctgcctggttggatgggctcagtgtgctcaagagagaatccttgcctggcagctggagtctcatagggcaggtcccggaagtctttggggcctctttcaatctgaatgatctggatttccccttctgtgttggtgatgccctccccagtgactgtgaagtaagggagaaataactactctggtcaagttcagcgactctgaatctgatttggcttgtatctgggtaactctcaggagcaggactggcctcaggcaaaaaaacaaacaacaacaaaaaccctgaattcagctaagcctgactttccaatttccccctcacccatctgctctctaccctcaatatcaaatgtttgcttttgttttctctcctatcgtagcctgtcccttggaaaatgtattttatgctagggtttttctggaggggccttgatcacactcatcatgtcagcttttcctaagcccctcttaagagagtgactgtaacttgaagttgaaaagctgcctcattggtgctccatgatctgtaaggataatgactaccttacgcgctggcaggattgcataaggtgcaatacgtgtgcctgggacctgcaaacagactccaggttcaaacattggctctgccacttattagctgtatgatctgggcaagctattaggttggttcaaaagtaatttcattttttgccattgaaagtaatgtcaaaaaccacagttacttttgcaccaacctaatactctcttagcttctggttattcatctgaaaaataaaaaaatctgtttaatgtttgtggtgagcaataaatgagcatcatatagggatctctagaatgtgctttgaagttaggccactatagttcaaacctgcattttctccttactctggtatgacctcagtaaatctactgaacttctctgtgcctcgattttctttttcttttctttttttgagacagagtctggctctgtcacctaggctggagtgcagtggtgcgatctcagctcactgaaacctccgcctcccgggttcaagggattctcatgcctcagcctcctgagtagctaggattacaggcgtgcatcaccacatctggctaatttttgtatttttagtagagatggagtttcgccatgttggccaggctggtctcgaactcctgaccttgtgatccgcccacctcagcctcccaaagtcctgagattacagatgtgcgtcaccacgcctggctaatttttgtatttttagtagagatggggtttcaccatgttggccaggctggtctcaaactcctgacctcaggtgatccgcccacatcagcctcccaaagtgctgggattacagacgtgagccactgtgccgggcctctctgtgcctcaattttctcatctataaaatgggaatgataatgacagtaccttcttcgtgtggtgttctgaggataaaacaaaaaaagatagagcttataaaaaagtgtttgcacagttaaaactcacacattccaactcttgcgtcatttcaggtgctgtgagaattgaataaaataatattagaacttttgaaagtaccttaagcactgcataggtatccaggatttccttgaatgcaaacttctctaagaatcctgcaagaactatggagttttaaaaaaaatccttttgtcacccttctaacattttttgaaatttgggaggtagtagaatatggtcattgtacaaattgtctatggacatgtctgcatttcaggggaaaaaatttgagcactatgacacagttgatggcaccaccctgagtgctcaggagaatgtgctttttgtgtcaaaacacaaggtctcactcttacccagaatattcatgaaagatgatagtaattaggactttctaattaaaagtgtcagaaaaaattctcagataactcactttcatagagttgtaagaagtgatgacatgaggataattttttaaaaagaaagcaaagcaagtgtagtatgggggaattcctgttggctggactttagaaaacagggcactatttgtcaaaaagtgaagcgtttgtggtaggcctgtgagtctcagacttgagcatgctttggagccaccagaagggctaaaaacacagatgactgggccccacccccatagtttctgatttctgtgtatccggggtgaggcctgagaattcgcatgcctgataagttcccaggtgatgctgatgctgctggacttgtgttagatcagttttacctgaaatctgctttatcttaagtggcagctggggagtcttttagaaacaggaattgtcaggcccattgcagagctctggaatcagaatcttctggtgaaatgtaggtttagcaagcacaccaggtgattcttatgatggggcaaagttgggagtcattgggagagagaggacatctctgaggcctctccctggttggcctctataaaggagaaagcaaagctgatggacccagaccaatgccttagaagagaaagaggcactcatttacctggaaatactctaactgaatttaaagtaaatttaaatgaaatttcaaatagggagacagttctccaccagggctgcatattaggattagctggagaggcttaaaatgcccacgtcttgtccatacacaagggcgagtacatcagaatttatgagtgtgggtcccaggcatcaatatctttaatatttctcagacattttcagtgtgcatccaaatttatgaataacagaaatatggaagcttgtaacttggtctccattttgcagcaaattagctgcatgaccaagggaaaattttcttatagaatcaattcttcttggtaaatggatggagatgtggggcacatgagaaaggaaatgagagtttgtttggaatagatcagtggttctcaaccttagctgtatttttgttgttgttgtttgttcgtttgttttgagatggagtctcgctcagtcgcctaggctggagtacagtggcgtgatcttggctcactgcaacctctgcctcctggggttcaagcaattctcctgcctcagcctcctgagtagctgggactacaggcactcaccaccatgcctggctaattttttgtatttttagtagggatggggtttcaccgtgttagtcaggatggtcttgatctcctgatctcgtgatctgcctgcctcagcctcccaaagtgctgggattacaggcgtgagccaccgtgcccagcccttagccatacatttctaacaagcccccaggtattgcccttgctactggcctgtggacaatgctctgggtaccaaagctgccgtccaaactgtctcacactgaaatgtgagcccaactccacacttcaggcatgatcatgaatctcatgggttctaccacatagaaggtgcaacccccaccaaaaaaataaataaataaataaataaaaataaaaataaattactcattccagagagggcttttttcttcaaagtagaccctttgggagtttttgcccagattggagggctgctgcctctgacatgtttttacactgattcttcgtgagtctctaacatattctttggaacattctcaaactttgtagctcttcagtccctgaggacagattagacttttggaaaagctgtatctggtggaataatgaatggtgacataggggttatgtaaacataaataaacaagtattaagagatgagaaataaaaagatccttctctttgaagaacacaaccagaaaggaacttgggaaatacgagcagagatggcttccttgatcagtggcaaagattgctgggattggagcatctggggcaactcatgtcctggtgggcaggcagacaaacaccagagtagtttttataggtataccatcatactttggggtcagccaacttttattggtaagaatagtaactattttcagatttgtaggccacatggagtctcacagatttttctgtatgtaggtgttttaaccgccctttataagtgtaaaaccattcttagctttaaaaccatacaaaaacgagccactggctatatttggcccatagacatagattgttactcatagtttataactaaataccaatggaaaagtatatctatgtgtacataatctgttgtgaaataataggtattaagacatttgaaagttaaattttctgtcttcagggaatgctaaaacaataattgcaattattgcttatttaactaagcacttacattgatgaagacctccaaatagttttatagccctcttttgttctctccctttctctaggtgcacctgaaaaatattattggtgttcacacaatgagtatgcttgctaaacttggatcccacaaaagattgcagagcctatttgaggcaacagcctggggttaaataacgaaacagccagcctctagagcacaaaactaaacagaagcaagttacatagaatttcattgcttgcttctctctggtactattagtcagaacaccaacttaagctttatttcacgtagcagattgaaaggtcagactggccattcacccagactgattcagcgaggggggtaaaaatgacctactgaggatgagagtaaaacatttcacttgtagagagttgctaaggtgaggcacatttgaagggcaccatggggcttggcctgctcctacgggtgttggttacaagcataactttggctcggggtttgtgtacacttctgaaagtgcagctgcgcctttcatctagagctagccatggtctcctgagagcctgaaggtgaaagcaaatgcatctgtggtccactactgaccatggctctggactgtgagggatgcatctgctgcccaacaaggcagcagtggttactcgaaggtcaccttggaaaaaaagggactccatgtggcagagccctttctgagagggcgtgaaataaccccaggtgacgtgaaataaccctcctgcccacccccggcactgctctgccctgctttctgagcatcatggaaatattagatttcagagctgagcaaggagctgttgcaattgcagccctcagtagcagtttgtggcccataaaaggaagagttgtagggcactcaacaagggagcttccagctcgggagagacttgtgagagcactggttatcaatgaaaaccaggaggccttgtcagactgtgtatgtgttttgcaggacacagacaggaagaaactaatagttgcaggtatgatgaaagtggggagaccttcctgatgggttagtgacattagatagccaggaaacgttgttcataagtggtattaagcagaggagaacttgaagcaggtgtcaggaaccagagtatgaagtcatataaagaaagcagaactgggatgagcctgaccacgtgggaggaggatttgagagtatcagagatggtgctgcaatacttggatggtttcgatagcactgtttaatgagcctaagacagcagatatggagaactctttgattttttccctctctgatgactgagggatctggcctaccacctggtctgggaatggatgggattgctcccaggggaaaagcatggaaaaagggagctgtgctttgcacccaaagaagcttgaacttatacactaaggagagaattaaaacttcatgagagaacatgggggaaaatgcaataaagatctgaaagaaaagaagaggtggcactagagctcaggtaagatggagtgaacaggtttgaggggttgagcttggaaagagtccatgaggcaatgcaggtaataggaggcaggggttacaggttctgagggcagggagggagctgttaaggggaatgagttggttcaaaggtcatttctttagtcagttccctggtgcggtcaaggacagcagtcaggttgtctcccctaccccatattcccattgctgtgatttacttaggaaccctctggagttgtgacacaggttcccaggacttctccttcgggcagtaaccattgcagtggccagaccaggtgtttaccaaggggccaatgaggactagtaccttctattagatatactctagggctttgtcttgggctacccatacagactgctaaagccaggaatggagcagtaagtgataaggaagtggatatccaagaaggatacggccacagatgaaaggctgcacaattggcctcttggttagagaggcctctagagtgatcctccagtttcaggaagaggttgttgatggtgctacattgagaggtaagccagatggcagtactgactcagaattgcttctctgttcacctgcaaacttcttttgtcaatgtttgggatggtggagaatatcctagaggtccttctgggtcttctgctccatgcctatctcctcctggttttttatttgtttgtttgttttctggccccagaactttgtgctttaaggagacctgggaggggcacatatttttattctttaagaacctgtgcttctcctcgatccacttaactttgattttacttgtgtcataaatactataagttgatacttctctcatttcctgctatgacgatgctttggcatatttgacaggtctgaaaaaattaaatggttaaatctcaccaagttttcatctaaactgggggttggcaatcttcttctgtaaagggatagtaagagatcttggcttgtgggtcatatggtctctgtcacaactacccaaatctgccattgtcatgcaaaagcagtcataggcaatatgtataaaagggtaaagatgtgttccaatatgactttatttatagaaacaggtggtcagaggaagaaaagaccaaagaacttttagatagggttgacagagtttaaggaaaaaactccttgtccttatgtatttccccaaaagcctgcctggggagcctgaaatttcaacagtatatggtagtccccccttatccatagttttgctttctggagtttcagttaccagtggtctgaaaatattaaatggaaaatttcagaaataactcatacattttaaattgagtgccattctgaatagcataatgaaatcttgcaccctctagctccatccaccctgaatgtcaatcctcctttgtccagcatatgcactgtagaggctatgtgccccttcgtcacttagtatccttcttggttattagatctgctgtagaggtatcccagtgcttatgttcaattaacccttattttacttaataatggctccaaagtgcaagagtaataatgctgggatatttttacaattgttctattttattactagttattgtcaatctcttactgttcccaggttacaaattaaactttatcgtaggtatgcatgttcaggaaaatacattatgtatatagggcttggtactatttgtggtttcaggtatctgctgaggttcttggaaggtatttcccatggattagaaggaactactgtttggtttgtgtgtgtgttttttttaaagctcgaaagggctcaggaacatcttaattagattaaggtgttatattacctaggagaagaaaatatgaccttagtgaatagttactttgattaatcaattagcatctttttctaggtaaaccaacagcgataagaaagagctgtaccccagaggtaagggcagatgggagcaggaggtaagaaagcacccatgacagggaggctgccttggaactacgtttatagctactgtttacaaggtcttgaacggggagccatgggagccacaaggatgaaaataaaaatacaaccattatcctcaaagatgtggaaatttagttgaagatacatgatagctatgtgtgtatctttgatttatacatctaattccgtgtgtaggtatcctccatccatataataaataatggataaggcaatagtatgtggtaagttgcaatgggtagcacagccagtaagcctgaaggtgtttggaagagatctatttctactggttgtgtgaatgggatgccttcagcaacacgtggattttgaattgaaccttggaagattgctagtttaattggcggaggcatcccctccgcaaaaaaaagaaggcaatgtgggacataaactggggactcctgactgttttccttattctgtgtgaagcgggctgtagtcacagatccaatattggttaggatggttagattcatcctgcattgtggatatggccttgactccacacttccacttgtcatctggaaatgtaggagaccaggttttagagaatagctgcacttacttattcatctggatcttcattctggaaacgttccttggcttccgttaaatgtcaagcaccggatggttcagtgcagccctcctgcattgccagagatggatcctggagttttcatcctgctaatatgcagcccacatatatgaaggtcaacatgttgtattcactggaaataagttgagatttcatttacttacatgagatgctgaaaactaagtaatagtggagagttgcaaggttttagttcctccatgtaaagatggagaaaacaaaatcccctgatgcctttagtaattaaaagggcattacattcccggcatggtttaaggtaagacatgataagcctctcctatccttttcacataaccacacattattgatgagccagcatcaagaaggcattaggtgatgctttattgtattattttaagccactgaggtttttatatatgaagggcatagatttatgctgagtgattcagctatgaagcgggcacatcaatttgttcatgaatgtgagctggtgattacctacattaaagtcaccagggcagactgatcactttaatttgggcagaggcatgcaaacagcatttgctagtggtgtgtgtatccctaagaacacaggcaaaagagctgctcttcatcccagaagagctctagaaaatgcagatttgtgtttttatagatgtataactgtagtcaagggtacaatgcctggtgggaccatgaacaaatttcttcgttgtaccatgtggcaggatgttgtataaggttcacttgatattagctggtgtatgctaatttgatgataaacttatttgattaactgatacagaaaagttatacttcctcctaattctagatcatagaactgagtgccctcctatgtatgactaagttatgacaaattgagtggtcttctatacaacatgaagagagtttgtgggagttagtaaattcaaaaaattggaattcagcaactgtgatcccagatatgtgtggaggggtaaagtagggattctgtcctgcaagaattcagtctagctgggaaaatgtgaagtggctacttgagcaatcctgatttgcacttgtggtttatagaacgaatagttagaaggacattcggatgatatgttggtggagaagtcaagaagaaacagtgttgaggaatatgggatgcaatgctggtagcactggaaaattggcaattcacttattccagggacctttcagcaaggactatggtcacaggtaaacaagtgccataacaattttcctgatgcagaaatttcacttccgacaggagcaaaaactagatgcctaaagatgtgtattactttgtttttggtaatagcaaacattggagactcccctaaatgcatgacagcaaggaattaatttaccaaacaatgaggcaacaacattagggaatcttattcaataattaaaaaatattggttagaagtgtatataaaatctataaaatatttgggatctaacgggttgaaataagcagtgacaaaaagaattataacttgagaattgtaactttatacaaaactaaggggtaaactacgcaagtgatcacatagagctcccttcggtttttatcattgtcttccccttgtttcttttgtaaaactcatcacaatataaacttttaatgcattactttgctaaattctgtcttcccaccaaaatataagctcatctagggcataagtaatattttacttgtatcttccatgtctgtcatatataggcactcaatatttattgaatgagtgatcaatgattggataatgtcattcaaatatattttcacttttatagtgacctttcaataaattgcatcttatggcggtaacatttgtcaagtcattactgggtgctgggttaactaatctcttattgcaacattgtaatattttatatttatattttataactgagacacaattgaggctcagagatgcaacacgtctcacccagctggtgagaataagagtcagaacataaaccctgggctgcttgactgcaaaggccaggtcttaccaattatgatttttaaaattaaactatatagaatgaccaagagtgccagatgccttatagaggtcatttaaaacagaggcaagaaaaagtgattccacttcctcctgtcccccagtgtacttaagcccccagctgctgacatccactgagcatccttccctgatcaaattatccctgctgtttaagtttcctctatcctgtagaactgcagtgactgttaatcaggctgataaacttatgccagtgtgtagctgctcattttaaaatgattccataatacctcagcaggaaagcgagacaactcctacaatattcttctgggcagccagacttgactctcctcaagtccaattttgatggtggccatttagcctattcctatgcccatcttcctggaagctgatcatcgaaggctgagcctgtttttctaccagctgcttctgtcttgcctctcaaaggtttcagggaggtttatcatttccactgttattgaattgtgaaactccatctgtattataggagtcatgttctgtaggaaccttgtggttctctagaagataggcatatatgttaacatcttcgtgtgtactaattacatcagcacagataaatgaataaaccttcagatggagaccgcagcacttttcattgtgatgatagttttagagaaaaatgttttgcgtgaaatctgtgccaccatcctctctgtggttttatatggccacatgactgactataaattcaagtaattccccttgaatttatttaaataaattcattttattctcaaatttacagtgatgatgaaatattaacatgaggagcaagtgctttatggaccttcgaattgctattctgctttatttcaatagtgtgttcttaaaacaccaatatgatacctgaagctgtaaaaattaatgaaatgattcagtgtttgggagttgaatgcagtgaatatttgctggtgtttcaaacagaacagaatcacaaatattaaaaaatgtaatttgatttccgaggccagaaaaagggaaaatgttctcatttttctgatgtacttcatatcacgttggagttaaatgcctaaatactttattagcagaggtttttaatgtctaattgaagctcagccttccaggcattttggcttttcttgtgagtgttcaaacaagactgtggctcttttgagacagagctgcttttctgtggcggtgtccacacaaaactgaattgtacagccacgatgtagtttatcaagatctgtgagctgtgtggggttttctttgtgtgattaaaaaacatcttgcctttttaaatggtcactatacattttactttaacttctgggatacgtgtgcagaatgtgcaggcttgttacataggtatacatgtgccatggtggtttgctgcacccatcaacccatcatctaggttttaagccccacatgcattaggtatttgtcctaatgctttccctccccttgcatcccaccccctgacaggccccagtgtgtgttgttccccctccctgtgtccatgtgttgtcattgttcaactcccacttatgagtgagaacatgcagtgtttggttttctgttcctgtgttagtttgctgagaatgatggctttcagcttcatccatgtccctgaaaagaacatgaacccattcttttttatggctgcatagtattctgtggtgtatatgtgccatattttccttatcaagtctataattgatggacatttggttggtactatgcctttgctattgtaaatagtgctgcattaaacatatgtgtgcatgtgtctttatagtagaatgatttataatcctttgggtatatacccagtaatggaattgctgagtcaaatgatatttctggttctagatccttgaggaatagccacactgtcttccacaatggttgaactaattacactcccaccaacagtgtaaaagcgttccttttctccacagcctcgcaagcatctgttgtttcctgacttttttttttttttgaaacggggttttacttttgttgcccaggctggagtgcaatggcatgatctcagctcactgcaacctctgcctgctggtttcaagcaactctcctgcctcagcctcctgagtagctgggattacaggcatgtgccaccacacctggctaatttagtatttttagtagaggtggggtttctccatgttggtcaggctgttctcgaactcccgacctcagataatccactcaactcggcctcccaaagtgctgggattacaagcatgagccaccacacccgccctgtttcctgactttttaatgatcgccattctaactggcataagatgatatctcactgtggttttaatttgcatttctctaatgaccagtgatgatgagctttttttcatatgtttgttggccgcataaatgtcatcttttgagaagtctctgttcatatcccttgcccactttttgatagggttgtttttttcttgtaaatttaagttccttgtagattctggaaattagatctttgtcagatgggtagattgcaaaaattttctctcattctttaggttgcctgttcactctgatgctagtttattttgttgtgcagaagctctttagtttgattagatccaatttgtcaattttggcttttgttactattgcttttgctgttttttagtcgtgaagcctttgcccatgcctatgtcctgaatggtattgcctaggttttcttctagggtttttatggttttgggttttacatttaagtctttaatccatcttgagttaatttttgtataaggtgtaaggaaggggtccagtttctgttttctgcatatgactagccaattttcccagcaccatttattaaatggggaatcctttccccattgcatgtttttgtcaggtttgtcaaagatcagatggttataggcatgtggtgttatttctgaggtctctgttctgttccattggtctatatgtgtgttttggtaccagcaccatgctgttttggttactgtaaccttgtagtacagtttgaagtcaggtagcctgatgcctccagctttgttctttttgcttaggattgtcttggctatacaggctcttttttgtttccacatgaaatttaaagtagttttttctaattctgcaaagaaagtgaatggtagcttaatgggaatagcattgaatctataagttactttgggcagtatggcaattttcacgatactgattcttcctgtccacgagcatggactgtttttccatttgtttgtgttctctcttatttccttgagcagtggtttgtagttctccttgaagaagtccttcacatcccttgaaaattgtattcctaggtattattttattatctttgtagcgattgggtcacaatgtatttttatgagggatgcatatgtttgttttttgagatgcagtttcactctgttgcccagaccagagtggagtggagcgatctcggctcactgtaacctccacctcctcagttcaagcaattcttgtacctcagcctcctgagttatttttgtcaatttttaactgtcttatcaggaatattgtcactctgcttttggcttcctgaggtgattattaaagagttacaggatagatgccaattgtaatacaaattcaattaatggagttaagttactttcttcaaaaaataggcataggctctccttgcttttttttttttgttgttgttgttgttgttctttctagttctgctaatgatattgttaatgttaagtattcatgtacttacaaagtgtgcccagaagagccaaaaaaaaaaaaaaagttatattcattgagcatctagaaagtagtgctaaacaggcaatcgtaaaataaatcttgcaggatggatagtttacctctccatgatatgtttactgattccacttagcagcactggtctcttctttttctgtaatcctaaagtttttggggtcagcagcacacaatttaatgatggctgctaagcttcctcctttccctcaagataactggttttaaggtactaagtcagagaaagactggcctagtcttctcagcttttacttccccagatccattatgctctcagaagttaagaaggagagctttcctttctaacagattggtaggtatttagtacaattagatcaccaacgagctctaccacctatagtcatgacctattccactttcagaaatcccagatcaatctaaattgctcaaaatttaatacttaatgaaatgctttattgttttctaagcttccaggaaggcgattaaatcttgtggcttcagttaagttgtaaataattcaagagtggagaaggcagaggcggggcccagttgagcaagtatatcccataaacatttcctgcttggttgcatcaagcaagtttcaaaattctatcagatttaattgtattgttcaacatctttggggttgcaatgtattgatgatatattgtctgctttttcactcacattaatcttttcaagtgtctagtaattccagtccaccattcctttcctcctccatacttccccttatcaccctttatcatgagaaactgaccatgtaggagaaaatattagctttgaaaaaataggacatttactttaccacagtttctgatgttgtaacagatatctagttaaagaacaggttgttgaaatcaattatcagatactggcaggtgtggtggctcatgcctgtaatcctagcactttgggaggccgaggcaagtggatcacttgaggctaggagttcgagaccagcctggctagcatggtgaaaccccatctctactaaaaatacaaaaattagccaggcgtagtgttgggtgcctgtaaccccagctactggtgaggctgagacaggagaatcacttgaacctgggaggtggaggttacagtgagctgagatcttgctgctgcactccagcctgggcagcagaatgagactccatctcaaaaaaaaaaaaaaatcaattttgagatacctactgtgtatagttatcttggactgatgtttttgaggttgaggtgttagctggcatttcaagctatattatttttttcttttttggagatggagtctctctctgtcacccaggccacagtgcagtggtgtgatctcagctcactgcaaactgcgcttcccggtctcaagcgattctcctgcttcagcctcctgagtattttggattacaggtgtgtgccaccacaccctggctattttttgtatttttagtagaaatgaagttttgccacatttcccaggctggtcttcaactcctggcttattaggagcctcagcctcccaaattgctgggattataggcgtgagccactgcatctggcccaagctacattattgattggggactgcctcaagctatgaagctaaggatcatttgctgatgaaattctagaaatcaaaatatataaaaccaagttgatagtcaccactgggccattgggtccagtgagaagcagagaaagacaagccaaaagaaaaaagggaaggtagggatttggatagagcccatgaccaacttaaaatatgtaagcctgcctctgaagatactgaaatccttagcatcatattggaaatattttcagaatgtttccaaagaaaatacaaggtgaatgaaattctgggttttaagtggaattaaatagcaggagtacgttgcagagtataggctgccagactttaggatttatggatcagtacaattaaagagaataaataactggaggactatcaagaggtgccagctctttatttttgccaagcattgctagcttggtttccccctactaagattctgttgggtgaggagttaggcctaaggaataatagagtttaatttaaacaaaagatgagaaaacagttcaaaagatacacaaagaaaagtttattttcactatgtggaagttactagttagcgtttccttctgttagagtccagctcttctgagctctaagtcccacagggtcgacttctgccaggtgactcgcagtcagcataagtgggaagctctgcgatctggggagctatgctgtgactgacagagtccagttacagcactcttcatttgtgctcaggtaggtaccctctactgtctgcaagtctcaactccaaaccacactcaggtttccctagcttacactgtgctccctggagacacgcacagatgcaagaaagtgttttccagagctgttgatataatactttgtggctgctactttttttctaaatgttttttaatatggaaaatgctaagcatatcccaaagtaaagaatgtgtaatgaaccatcatacactgtcactcagcttcaacaattataaactaatggcgaatcttgttttttctacatttctacccatttccccaaccccagataattgtgaagcaaattccaaacatcagttcatcaataaacatcttgattatatagctctaaaagctatagattctttttaaaaaaaaagtaccattagcatgctttaaaataataataactcctcagtatcatcaaatgtctagttaatatttaaatttccttgatggtttcataaatgtagtcttatttacttatttatttacatatttatgtgtatatatatattatagtttgttttttctattcaggacacaaatgagatctatgtcttttttccagcagtttttaaccatcaggatttttatgattgcatgtatgtacttttattttacatgtttcttttcctcttgaattttctgtaaattgaaaattgatcctaaatggctgaccttttctttttttggcaagaatatttcatggacagtggtatgtcactcagtcaagaaacacatgatctctggttgtcactctttctttttttaatgttaaccactgatgacttggtctggatccattatttcattaagcgtgttggtattttcttatgctttttacagaaatgcaaataattacctgattcttggggcatttttaagttttcatattgttgtgctaaactctagcaattattcactgtttgcaaaagtgtgatctcaagtcttttgcacagcaagcagggatggtacggggcaaaaacagccatcatctaaaattatcactatttcatagaatgagaggttgttcaaaagcagatataggaaaaatttaattgaatattaaaaggtagaactttaaatacatatatctttctagaagattctccactatcctgattttttcccccccccacatgccactttggacaggggaagctgcattctggactcgtaccacagatcagaatgtaggaaccattggttaacaccataacattggttaacatctgctagaaggtgaacatttgtcttgccaaattaagggtgaagctcaactgtatttttgagggcaccatttatccattgtgtattccaaattactgtctacaataagttacactaagtttacaagctattgtttaatttattaaataaacatgtacaaaacaccaattctgtgtcatgcactgagtcaggcacttggattgtaaaatgaaccagaatatagaatacagatgtaacaaagatgaataaaaatgtggagagaagacattatgatataacaaagaaattgaagttaagagacctgcatcgttggttcctgccccacatctaagaaccttcctgcccatggcatgcagtatctgtgaatggtcctaatgaggcatatgtcttttcacacttattttgaaaactaagtaaaataatgaaaatcaaaggtaaactataaactataagaaattaaatggtaatgtttgaattcacttgtcataatttctcctagtacattttctcactgaaatagctataatgcatcctctttctcccttaaaaactccaaaaccctattctttacactaatggtttattgaagtaatctttaaaagtattctatcaccctcaacccatctcatgttgctgataaggaagcagcaatctaaaatgtgaagtgacttataaagatgcccagtggttgaacttcctgatctccaggcctgtactcttctcactatgtcatactgcctaaggtttctttcacattaggaactataagcatgggtggtacattctaaaatcctagggcattcaggaatgggaggagagcagcccagttttggagactaaacataagcaggataccaaaaaggcaggcggccacaagactccagggattctgtctgctaatcacttgttctgtttgctccatagctcctaccccttgctgtccttctcctcttctttgacttttcatatccccattcttgtgttgtcttgataccagcctgatgggactgattggtcttttgatggtggctttgtggctgttgaccttggctaatcaatctcaccttgaattaccaactctccttcaagagaaggaataacaacaagttgacccccttgacctgggaacttgaattcagtccagctgtttggggtagcatagtgttcctaaaaatcaaatttgaatgtcttgcttccccttccctccttggttcctggccccatccatcttcagagccaactgtttgaagacggaaggggccaggaaccaaggaagaggggaaaagaagacattcaaatttgggccaggaaccaaggagggggaaaaaaaaaactgttggctttgaaaatggaaggtgccagaaaacaaggaggccatcaaatttgaatgtctttatactagatctgcacattgtaatttactatatattccgccattgtgtattgaatgctacgagcctttttgttacattgctcataacagctggcctctaataatatttgagttggctattagtggactaaaattttcaggcagatcgggtattttgggggcagggcaccataattgtcagcttactatgagtctctcaagcccaaataattgcctgtagcattcttctcactcaactctacagggtcagaactgagtactgatatggccgagatcacagggttttgcattttgatgttgagtcttaggaggctccagagagtgtaggcggatcaaggcagttcataagaaaaaacagttcataaaaccctgttaaaacacaaccttgtatatgcttgagagtcgtgaaatgccttttctgacagaaatgcctaaattagcataagaagtagtactagttggttctacatgaaggccagggtacccttatcttatttctgaaagaattctcctggaagagacatctgccagagaaggtccaaggcggagcaacagtatactttccctttgccccaacctaatattcactaaaatcctcttcaatacaggttgccaatttggcctgttccatctccaacaatgaagaaggggtgaaattagttcggatggcagccacccagattgacagcctgtgtccccaggtaagcctcattcactttgtttcaaaagcctgtcagtgaccttctccactccagcccttgtgcccctccttttccttctctatttcctcttgctgaaaaaggctactcatcatttatgagctgtttcaagttctacctttctcagaaagaataaaccataccagtctcttcagaattaccatggcagcttggccaggcatggtggctcacacctataatcccagtgctctgggaggctgaagtgggaggattgattgaggccaggggttcaaggccagcctgggcaacatagtgagactccatctctacaaaaaaataaactagctgggtgtggtgggggcattcctgtagtcccagtttactggggagtctgaggtgagaggattgctggggctcaggagttcgaggctgcagggagctgggattgtgccactatactctccactcctgttgactttgttctatttgttttgggttgtgatttaaatgttccatatctatttaccttgtctcggcagctaaatcataaacttgcacatgtggaaagcaagagttgcatttctgctgtatctgtgctaagtcatgagacttgtccagtaaatactttttgaaacccgaggcaaactattatgtcttaaaaagaagcaaacaaaaattaatggtagttgaaaatctcctttatcttttatgtgtttgattgtccttctgaacaccaagaacccacttatctgtagaacgtacagggtgcatggttttaacatggtctttgaccggcttattcctcttttgaagtgtgtggtcatcatgtccctggattgtttccaacaaataggtcatcaatgccgctctgacactggctgcccggccacagagcaaagttgctcaggataacatggacgtcttcaaagaccagtgggagaagcaggtccgagtgttgacagaggccgtggatgacatcacctcagtggatgacttcctctctgtctcaggtaatcatcacaaacaggtcccttacaaggcagctggaggagggtaactgaacgagataaggaatgtctcgcaaatgtcatggatctgtgtttcaggcgcactccttagatctttgagcttttttgatcatctctgcaaatgtgattataacaccctcttagatgcttcggtgtttatgttatttcaagacacggagtcaaggcattaaaaaggaatacattatttaaggtggcttatattcctttttagtgtttggagtttataaagcaggatggcctttgatgtatctgaatcactcatgtaaaaaagggccagggaatatgggattcattaatctacacagtttatgtcttaaaaataggtgatcagttactccaatttggctatgttaagttttgttttgttttgttttttttccaacaagtgaaggtttgtgataacacaggtagagatatcagccacagaacttaccccttagcagggacttggtagctatcaaggctttgagcacttgtctatgaggttgtagaaggaagcgagtgaaagaaaatagaactgctcatcacttgaaattataactttcttctttgtaaatgaagccagactggaggatgctagtagacatgaataactgcagagacagtctgacctttaacaggactcgtggagtccatttcaagatttgtctaccagccagcaaatggacatttttccaaatgcttttgacctaacttatttggcccagttcacctggaagaatctctgtgaggaggaggtcactggaaacatcagccttctttgtgaggtgttaaaagagccagctgacccttggaaattcaaattggccaggtgttgattctacacaggtgtgtggaactcacacctactgactcaggcagtactagccctgatgacctgctggttcttggctgactgagggctgagggagacattgcatcactgttggtgggaaccaggcagacaggacctctgactgcaacagtgtggaagtgatttctgaggggggctgtcatgtttagaaaatgtttctagttgcagtcttttcttttccggaagaaacataataaattcccactggggcttgtctgagaactgtgtagtcaaatctgtagatttgatggataatcaaaaatccagcttttcaatgatggggcaagccaaggcagatgggaacattgatgtaacatgcggcctgtgactagaatttaccttactctctgctgcttgatttaattctcatcaaaattctataaaataggtactactaattctaggttttgttttaagaaaactaagtcattgagagggtaggtaacttggcagagatggtattaaaatccagatcatcctcttttcagaaactctataattctcaatatgtcaagatagaaaggaaatttcctttggtgcttgctgctttcatttcagcttccctttcccacctctggcattctcattccaatctctaatccctttcagaaacctgtcttgttttttattcccaaggtctttgtttttgatgacttgtgaaagcaactattcatttaaatatcaccatatctagagcttagctgataaaagaactcaatatattgtcacttctgcttttttttttttttttgagatggagtttcactcttgttgcccaggctggagtgcaatggcgcgatcttgactcatagcaacttccgcctcccggattcaagctgttttcccgcctcagcctccagagtagctgggattacaggcgtgagccactatgcccggctaattttgtatttgtggtagtagagacggggtttctccgtgttggtcaggctggtctcaaactccggacctcaggtgatccgcccgccttggtctcccaaagtgctggtattacaggcgtgagccatcgcgcccagcccatttctgcttttttatttttattttttgctttgctgatagctgagtcctaatcttgtaaaagatacctccacaaaatgaatctctcataaggtatttggaaattgcttagataggtatgttcgtaatttggttgatggggaatagaaaggtggccactgatactaatctttatagtatatggtcagtttttttccaggataactatggtgctccaaataggagccctttccaaccagcctcagatcacacagccatcctgacagcccctggaaatcttctgcatccccttctaccttcaaatcaataggaaatacctatacattgcctttttcagagaggaatcattttagaacttacaacttttccaacctattctttaaatgcatgcataaacatttctgagggtggggacaagcaaggtgaggaggtcttatctcagactttttcaataggacaaagcttttgctaattttcctcccccgagccctgcctctttgctcccttttctccttgtcattcctttgtgcatctcattattaccagcaacaagaaaaggcttttgcttctgctgataacactgtgcagtccaaccccagtggtacaagtgccacggcatgccatggcaggaaaatgaacaggcgctgtcagagagccagcttggcagggcctgctggagcatgcctttggagttgacaatcagaggcagcaggcacctttccgcagacggggtttgacaaataatgatacagcccactctgtcctgctggtaggctgtggacacagcccaatagctagggaaactacttctcatcttctctctgagctacagccaaacatttacataagtaaactgcaagtttggcccaagagatattttgaagtggcattaatgatattttatgtatcagtttcttcttaggggaatatctctttggtcaggaaactctatttaaaaaacaataaaaacagatctttgtttttaaaagattgtagtttttttaatgctaccctaacttctgtatctgatattaaatttgtccatatgaaatgcaacaagtttggggagcaatgatgctagctattaacattacaggagcaaaaccaattttaagatgtggcctatgcacataaaaaagtgaaatgactgtgtgataacagtcaaactttttcccactttggaaaacctacaatttttaatagtattttaaaataagcatcttggcattaatcatgtgacagtttaattcttggatttggctcacaaagtagtaggaagctaagatctgaaaaagctattaacttgatctcataatgcccaagagttttgctttttaacttttcctatttttttttaactctacagtcttaagtttattttcttttaaaaattcaccgtgaactttattgctttgaatctgtagccttatggtttacaacagtcaaatagtttggtcatcactgattttttttcataacaaaattatatcatttctaaaatagtaatgttgccaaatataaggaagtttacaataaaatatgttgcaatcaaatgtttcatgacatgtttaaataccacacttgatattagagtgtgccacccaaacattgcagtttttcacagcaatggaataatctctaggatacttttgccttttattactattttcatctcttttcctttctagttgcaacattcctctctctctttacttcatgaattctttctcttcaaaacacctcagaataaaagtgtgtaattgatcgccccttctcaatgggcatgttcattcagtgtctgtcttttgattgcctgctgcctataggccactgtcaggaatgcaaatgtgaatgaagtgtgtattctgcctttaaataattgactgccctccttgatatatactagattagcgtgcttactaactgttaagtcctagacctgaaggcacagggtatgggggtgaggaagttattacagggggttcaaaaatccatatatacaccaagtatggtcttctgaccaaaaagttcatgttcatgtctatgtaaacaggtatggcttttttccaaacacaggcaaacctcgaacgtattgctggttctgttccaactactgcagtaaaatgccaattgcaataaggtgaatcatacaaatcttttttgattcccagtgcatataagttatgtttacagtgcagtgtagtccattaactgtgcagtaggattatgtttaaaaactgtacatacctttatttagaaatacttcatttctaaaaaatgctaaagatcattctgagccttcagccagccataatctctttgatggtagggggggtttccttgatgttgatcagagtggtggttcctgtgtggttcctgaaggatggcgtggctgtggcaatttcttgaagtaagataacaatgaagtttgatgcgttgattgactattcctttacaaaagattctctgtagcatgtgagatgctgtttgacagcactttatccacagtagaacttctttcaaattggagtcagtcctctcaaactctgctgctgctttatgcactacatttatataatattttaaatcctttgttgtcatttcaacaatgttcacactatcatagctagggatagattacatctcaagaagccgctttgctcatacataagcaattcctcatccatgaagtttgatcatgacattgcagattcagtcacatctttaggctccacttctaattctagttctcttgctatttccactagataagcactttcttcctccactgaagtcttgaacccttcaaagtcgactatgagggttgggatcaactttttccaaactcctgttaatgttgatattttgactttctccggtgaatcaatcatggatgttcttagtggcaactaggatggcgaattctttccagaaggcctttaatttactttgcccagatccatcaggagaatcactatctattgcagctatagccttaaaaagtgaattttctaaataataagacttgaaagtcaaaatgactccttgatacatctgctgcagaatagatgtgttagcaagcaggaaagcactattaatctctgtgtatatctccatcagagctcttgggtgaccaggtgcattttcaatgagcaataacattttgaaaagaattatttttattctgaacagtaggtttcaagagtggacttgaaatattcagtaaaccatgctataaacagatgtgctgtcttcagtcttcgttgttccatttatagagcacaggcagagtagatttagcataactcttagggccctgggattttcaaagtggtaaatgagcatttggttcaacctaaaaatcaactgtattagccactaataagagactcagcctgtcctttgaagccagctatgaaagttgtaaatggcaccgtcttccagtagaaggctgtcttgtcaacattgaaaacttgtttgcccccttaatcaatgatcttagctagatctttaggataacttggcacaggttctatctacatcagcacttgctggtttaccttgcacttttatgttatggagatgacttctttcttaaacatcatgaaccaacctctgctagcttccagcttttcttctgcagcttccttacctctctcagccttcatagaattaaagagcattaggatcttggtcaagattgggctttggcttaaaggaatgctgtggccgatatgatcttctatttagaccactcaaactttctccatattagcaataaggctgcttcattttcttatctgggtgttcattggagtagcacttttaatttctttcaagaactttttcttgtacttacaagttggctgtttggcctctcttgacttgtgacatgtcttcctcactaagcttaatcatttctagcttttgatttcaagtgagaaatgtgtgacccttcctttcacttgaatacttaaaggtcattgtagggttgttaataggcctaattttaatattgttgcgtctcagggaataagaagcttgagaagagggagagagatggcaaacggccgtcttggtggagcaggcggaacacgcccgacatttattgtttgccttcttaagtgaacatggttcctgatgccccaaaacaattgcaatagtgacaaagatcactgatcacagatcatcaaaacgataatgaaaaaattttgaaatattgcaacaattgcaaaactgtcatacagagacaggaaatgagcacatgctgttggaacaatggcaccaacagacttgcttgacgcagagttgcaacaaaccttcaatttgtatttgggggggaagaaaaaaaaacccaccaatctgtgatacacaataaaacaagacatgcctgtagattgtttttaataaagtacaaatctatttgaaaacattctgaaccgtagtagcttttacatgtctgccatccatcaatataactactatcatgaagaaactgtgactcattttttcataaaaagggacctgaattggagaaggttgaaaaacactgagtaaactgtaattatatgttgcttgacgacaggcatatgttctgggaaatgcatcgttgggcaatttcatcactgtgtgaacatcacatactgtatttacacacctagatggtattgcttactgcatacctacactacatggtataacctattactcttaggctacaaacttgtacagcacgttactgtactgaatactgtaagcaattggaatacaatagtaagttttgtgtatctaaacatgtataaatattttaaaagtacggtaaaaatatgacataatcttatgggactacctttaagtatgtggtctgttattgactgaaatgatttatgttgcatgactatatcttaaaattttaaaaatttatttataaaaattagtcaattaggccgggcctagtgggtcatgcctgtaatcccagcactttgggaggccaaggcaggcagatcatttgaggtcaggagttcaagagcagcttgaccaacatggtgaaaccctgtctttactaaaaagacaaaaaaaaaaaaaaatccaggtgtgatggtgcatgcctgtaatcccatctacttgggaggctgaggcaggagaatctcctgaacttggcagactgaggttgtggtgagctgggattgcgtcactgcactccagcctgggcgacagagggagactccgtctcaaaaaaaaaaataaaataaaataaaataaaattagtcaattagtaaattataaaactaatactttgtacaacattattaacctgactatgtaacagatttgctgatgatttgagtaattaatagcaatgtttttgttatggatttctagcctgtgctggtttattttaaataggtataataatacctataaaaacatatttcttgcctcttaaattagttgcatatttctacttttggatagtcctattaaaaatacgttttcattttaacatattgggtcatgaatgggtttcttagaatttaaaaacaaacttattaactccagaaggattagtatctaatataattaacagacgtctcactatttttttctcaactccaaagtaccgtttctaaactctgcactgaaactttgtccattcttgtattactgttatacaaagaaaatagcagccggatgtgtgattttgacacaaatccttttctagttacttactctcaagggccaggacacattttaattgtcttaagaaattctacaggacagaaagagaagcttcttttaatcaaagttttacatttagaattctctgtcaatattcatttgagtaaacatttctctcagatgtccttttaggtatatactgtgttcacatgtttaatcatgttttcattaaaatgtcatgtctcaagaaaatgtcatgatttgggaagtactactttttgtgagttttagaaatcgaaatactaaaatttaaacgtttcattatttttctattctaatttatagttgaaattaaagaaatggagaatgtagaaatcagcaatttataatggtttgagtgaagaaatcacactgtatgaggtcaaaatggatgttctttatgaaaagtcagttataacttgcaattttctatcctgtgtcctaaaaatataaattttctttctaagtgcttaatttagtaaaagtaggggagatcggtagtggagactaggatttgctggatactctctttctttctttaggaaatttaaaatcagaactagccctaaaagcttcttaaagaggtaatattttattttaactatttatgaactattggttggatttggcagttataattttaaaatattaacaggttacttaagactttaaaaatatatttatcaaaagcacatatttttatgtgttcatgtcttggtgtgttttggagaatactgtaaactgtgttgcttataatcaatagaaatttatgtctcatggttctggaggctgggaagtccaagacaaaggactctgctttctcatagtcttctcactggaaccttgataggaagaggatagaaagagggtagaaagagggagggatctctgaggtctcttttataaggacactaattccattccttaagattctgccctcataacacaatcacctcctaaagtctgcacctcttaatactacccctttgggagttagaattttaacatatgaattttaagggaataaaaacatgcagtttattagttggtgtgtgtgcatgtatgtgtgtgttcagcttatttacaaagagcactaaactttttgaacatttccttagaattctgcttctaaagaatgcacaaggaatagaattacagatctcacactggacatgaaaaatacaaaattacacacttgttaaaactgcaagggaataaataatgtgttttctctatgccattagagagtgaagcctcccctctatgcctgcttgatttctactttgggcaatcatatgaaagttatgcagatcttgactataatctgagggaaccagccacaagactggattgtattttaattgtgggaaactgatcgtcttcacctaatcagttttcccattgcatataccgtgtgcatgacataattttaaaagaccaactgcgtgatatttatttttcctcaaatgttttcgtaatgaaaacatgattaaagaaacatgtgtccaaagctttgactctggttttatttatggacatttatacttggtcagattgacttcatgttggctgctacaacttctaaaaggccctgtcgtgtgtaagtatcaaacttcaaaacaaaggaagggatattctttaagtcagtggtcctcagaatgttgtcttcaaaccagtggcattagcatcacctgggaacttgacagaaactcaatttcttgggctctaccccagacttactgaattggaaactctaggagtggcacctagcgatctatgtgatgctaccagccctctggctgatgctcaggtttgagaaccactgttgtaattataaactatgtcctttacatacaattttagtattattaggcatgcattgagatgtgtccaaggcaagggctcatgagagttgaatcaattttaattggttaagttctgagttatgtaaagtcatctaaatgtgtatgtgtcctctccatagaaaatcacatcttggaggatgtgaacaagtgtgtgatagccctccaagagggcgatgtggacactctggaccggactgcaggggccatcaggggccgggcagctcgagtcatacacatcatcaatgctgagatggagaactatgaagctggggtttatactgagaaggtgttggaagctacaaaattgctttctgaaacaggtaagcatgggtattgggtctggccaaaatgttaatgccttgattagtttctataactgaataaatctgtttcattgatttctgtaggcctttatgcttctaaattgcacataattgtggaatgggtggaatacttgagtgttctctttgttttttgagtttgaatttgaataatattaggagaatgacagttgtactgctttgcatgcatatatttctttatacttttcatatagatcatttgattctcacaaacaataaaatttttctgcttacttaattatctccaattatggatgagataattttatgacttgagaaaattatggtttgaattggctaagagactggaatgaggtcacaaggttagaaaatagtgcagatgtgataagaacttggaatctgtaatttaaccttttcttcatttattgcttgagaggataggaccttaaggaagaactctgaaccagccagtggaaagcataaaggttttagatagtgagtggatatgacgtgctcaaagaaaggtggtggctgctgacaaagagttaggctttcagcatattccctttctttctaggaaagctttacatgcccttcttcaggggcatgtggctgctcacaggactcactgctatggtcaggtatggttacttatgggagcttgtcagagcttgcagatgcattggggtaaaaaaaaatgcttccactgaattagaacaatctacaactctggagaatatataagactggcctgtttttagtagttctcccctcttgaccaatgtcttttggcttcctcaggccttgatttatatatatgagataagatatatagtccaaggaatgagaggaaactagggaatagaaaaagagaatgtaagtccacattggataaggttgttaatgaataatgaattggtgcatatatatgcacagaagggcctctcccctcaaaccctaagggggaccttcataggtttgcctatgagctttggatgccaccaggcatttttaaaatagccatctctgaaaggtcagatatagccatgttccaagttctgcatgatgagatgtgttggtagaaatatgttgctttttatggggaaaagattatttacaaagagttctgtaggtatttgttagcctggaatagcaagtaaaacacaatacataaacacaggtattggtcattctctttaaaatataagcagaaacagaatagtgtggtatcatgttataaagagcacatctagagactgttgcccttggaacatccttacagacttagacttagacataataacaaaaataatgacaagatatgactgcatttgaattagctgagagtcagcactgctttctttcacataagcttgccctttgcattcaattgagcaacacaaagcaagccatacagtatttctttcctcacttggaagagttataaaaaggtatttttttccctaattctccaaattaaggactttttcattagtaacctttagggagaccatctcacatttctgtggcttacagttcccagcccatcagctctattcttgtacaaagtctcagcttcatgtgagatatctgacagagtaacactcacctgggtctgtcactagataaataataccagagaagtgttgaagacctagagacaggactcagttcctgcccactcatgactggtgggaaggacacttgtggcagatgaaagatacagagcatattgccaattttcatgtgactttctacccacagataactcaggcactgttcaaatgacattttagaactttttcttattgtatcttggactgctttgacaacaggagtgccacttactaggtcaaaatctaaaggcaaggacaattgcttagttgattgtaatattttaacataattttcacccaaagtcttgatatgtaaataatgttctggttgatttttctacttttaaaaaaacaaatagtcgttcatcctggattgttgttgctaatcaagatttttgctcttacttgttctgagtttttacaatttttatcctggcttgcaatgattgagcactctgggggcttaactaaaggcacctttcttattttgatgcccatatccaattcctaattgaatacggtagatgagcaggacatttaaattctacttttcaggatttattgaagttaactaggaaagtaaccaggcagagactgaaatagacagcttatatataactttaattgaaaatataggaataagtgtcaaggaaaagtgggtgtcagtggactaagagctagaatacaaaggtatacaatttctttggtatttgtccccaattgttcttctctttctgaaacaggaataatgttactattttgtgaataactagagaggttgccaaagaaatgaaagaaaaaaacttcagctattaactcactgactgctaatgagaattgctggggaatgtgcttgcataaagtagacacgtggagtttgaggatgaccacaggatcagttctgtaattatggttgtacaaagttttgttggtgtgtgtgtgtgtgtatatatgtgtgtgtgtgtgtgtgtgtgtatatatatatgttgtctaaagtgatttacttctaatgtcattgtatgtctgtgctaaggagacataagatatatgtcctcaaaatagaaaccctgtgcatgtccctgatgccaaattatctaccttttgcttagttttgtttctgacttaaacaattttagagccatgttgaattggccacttttctatgtgaatctatcaaattttgtcatgagagtacattgtagggtgagagagggtggtagtgggaaaaaagggaaaaatgccaagaggaaagatgaggagaaagaagacaaaatgtcatggtttttgttgttgttgttgttgccacacctactaggttctgcccattgatttttttgtttgatattttatttttaaaaaattctgtgccattagattcaagaccttgagtcagacatgctcaacctctgtactgttgacactttggtctgaacagttgtttcttggggagagttctggggactgttttgtccattatgggatgcttagaagcatccctggactccacctgctaaatgtttgtagcatctctttcttctacatgccaagttgtaaccaccaagatgtctctagacattgccagatatccttgaaggaagtgggtcctggtgggcaaaataatgtgcactgagcattactgccctaaagtaaagaaataacccaaaatagggacaagttcaaacaggacagattggagcccatgtactgtggacatagtgaaaagggagtggggttgggagtatattacaaagaagaatctgtaaaagggcagaataatcaaacagccttgactgaactggatgttgctgctgaaggtgtttacacacaggcaaacccctgtgtagacagatgaatggctgcatgggtaggtcactgtagggagactcccactttaccacttggctgccctcgctgagtggctggaaaattgagaggtgcccaaagagtgataacacatctgtggtttattttccatgaattattttctttccttagtaaagacagtgctttgcttaagagtgcttcttgtcttgatatgaatgctgaattaaatttaagaaaattttgtagattattagtatgctaagaattatagggtagcattatgtacaaatttacctgttcattttctataaaacaatctaggctgatgaaaacacaataaattggatctacagcagacccattaaatacttacatggcatatttgatgggctcttcaataaaacctgaattataacaaattgccaaacagcttagtagtaagtacacgcttgaccagacccatcttcatagatctcgtttacaaagttgggttgctgcaggaggctgaggaggggtgaaagcacattcagcgatatcatatttatatatatatatacacacacatacagtagctcattcttcactgaatggattatattgaaatgtcatttttgtaaatttgatagctgactcaagtttgtggccatgtgagcgtgactaggttaaaagatctgtgagattctgccagatattttttcttcagaggaaacaatagaccaaaaaaaaaaaaaaaaaagaaaaaagcatattttaaaaagggttctatgttatggagcactctgtatgcagagattaaaattccattattttggaaaatacgtgggccaagcagatggtataatttttacttccatgctctataacctaaagttttatacgaatgggaaggtttttcgttttacaacatttctatatatttttgcttagaaagtataaaaggaccaacaaatacaaagcatccaaactggaaatcttattgagagggtacatttgggccaggacaatgcagtagaatgaatccaaggttaggattcagaagaactgttatttgactgctaccaactaactgtgaccttaaacaaatcagttagtgcctctgggacttgggttttttcctgtattgcccaatgttttgtcattcaagaatgggtcggtattaattgcgtaatatatgcatcactgtttctggcttcctggtgactgcacttggcataagcaattattgcccatgagtcccctgtataaaccctctgcaccatctggacgagggccttcattattctccaggcaaaacatatccatgctgctccctctgtcctccctgcaacgttcttcatctcctcctcctcctgctttacatctgtttattgagattcacctttaaaatatagctctagtctcagttggagaccacagaaaactattagtcttttgacatttagtatggtatgtcctcttcagtgtaaatgactgcttacaacaggattgtctgtttttagaggcaagtgtttctataggtacccacagcctagaatggtgttttcagtaacacatttaatacgtaagtattgattaaatgaataccaaaaatgagaactttacactttgtcttttttttctgtagaaaatatgtctaccagcagcctcaggtttgcagctcaagaccaatttctgtgtatcaatgggaaatcatctgattggctttctggcctatgcttccttcagttggactgatttctgttgctagtggaatagagttttatgattggacaggtctgagtgacctgcctatctctctggctggaatatgggggactggagtatgagattgatgtcagaaggaggtggtaggggcagcttattgggaagacaaactattaagtattagagataggaaggactatccacagtctaagttacttcggcatgactaattttaagtcggaagtgtaggaagaatgagaaagaagcctcatccagtaaagagcccttaaatagataacgtataatttgtctcaatgtcttttttatatgactaaaacctatatactctaagtattgtagaaatctgataagtttttgaagatctgtataatttttcctaaaagcaaatgcaaggttttggggctcagaaaacaaacgttactttgcacagtaagcatgtcagtttcccatgttccattcccgctcttggagcaatgtgatgagggcagatggattctgcacatacagtggaggtctgtgctacaggtggggaaccacaccattatgaatctaggagcttatttagaaattggtgctcctcctgagggcaggaaagaaacacttcctctctctttttttgagatgaagttttgttcttgttgcccaggctggagtgcaatggcagtctctgctcactgcaacctctgcctcctgggttcaagtgattctattgcctcagcttcccaagtagctgtgattacaggcggtcgccaccacgcctggctaattttttttttttttttttttgtattttcagtagagatggggtttcaccatgttggccaggctgatctcaaacccctgacctcaggtaatctgcctacctcggcctctcaaagtgctgggattacaggcatgagccaccgcgcctggccacgttttttatgtaaacaaattctgtccaggaggtagccaagtggttaaaaacttttggaatataaatgcatggttcctagttttatccctcttttgaaatgtaaacatatctggagaagctgtctataaatctctctccaggttatttcactatcttaggactgttaacctttgaaccaggttaccagtattttcattcagacagggttgaccatgcagaaacatgaaaatatttcctatacactggtgtgtttgtgaatgatgtgttctcccacaattcagacatggtcagctctctcagcataagaggctgaagaaccacctcagaaaatacgaccataaccagatagcttacaatatagaaatgtaaatgattcctcctcaaaagaaaagttgcttgaactctctcataagataaatgcaaattaaaaactacgctgagaaaccattacccatcagaatggcaaaaatccaaaagttctataatatatatactctgttaaggattaggaaaagtcatcttatattttgcttgtagatgtgcaaaatggaggaaatttgacatcttctgtcaacagaacatatttaacatttggaaagcaatctcacttttaaaaatctgttcttcagatgtactggcaaaaaatataaaaacgtatgcacaagattatttattacaagactgtaggctagaaacaacacaaatatctagctttagggcactggttgaataaattatggtctaatcacacagtggagtagtatgcagctataaaacagaatggggaataactatacaatctctgactatatttttaggttaaaaaatgaggtggaaaaagtatgtataacatgttccatttattttcaaaaaaggtaaattatataacacaggaagagaaagtaagatacaaaattttattctaacaataaaacccttaacgtgaaggtggagatagggtacggtaaacataggaagattcacaactgcatgtgtgtataggccataaatttggggtgacacagcagaacaaacagcacttctctagtgcctgtttgtcaaagtacaaccaaaaaaaaaaaaaagaaagacatgaatctccagttcttcatggattcagaatcctgggaactggagagtacatgtgcttctttgtcacttcaaggacatcagagaccagcatctgtggtaatggcagtgtagtaaattaggggcctacatattgtgtctagcagagtcagtgctggtgtccactggaattggtggtctggatgctttaattgtgcacaactgaggctgtagtaatgtcctgtcacccagattctctgacggaggggaaactgccacatcagtgataggtgtttgaatcagaggaagaatatgctaacagccactcatttggaagcacatgtggtacatccttggagtattccagaaatagttttggtaatgaaaaaatgggaacctttgcatgtagccggagggcctgaaataacaggtgaacaaaagaacaacagaagtactgtatatggccagagtagtctccagatgacctccttgccaaattttaaatttgttttgtagagacaggtcttgctatactggctagagtggtctccaactcctagcctcatgtgattctccccacctcagtctcccaaaatgctgggattacaggcatgagcccatcccacttggctcctggtttgcctttctgtattttacctttcctctaattctacctgatttcttccttgtcagtgaagtcccctttctaaccagaccagagaagcccactcttcggtgtacctgttactcttattatctgtgttactcatttggaacctaccatatactgccaagtatttcatactccttgttacccacttttctacttacgtttatatctgtcctagtgtttatatctgtcttctgtccatcttagtacctgaggcatgtgtgtatgtattgactttttgcatgtttttgttaaattttaacctcttaagatctgagtctacctctccattacctgcagctttaactaagagttgaaactcaaagatgtcattaatataaatgagtaacataatgacacagttaccttattctgggggattaaaccctccttaaatcgcatacttaatgatcaagataagaatcttttaagttatgtgcaataaatttttagcaagcactttattacatcttaatgcaatctaagtatttaaacatcacagatgccaaattagactgtatttattaagctaggttttgacaaacactaagctaaataaggcatcatgctcatgctcaatactttattcgttccttaagtttcagaattaaatgtgccatccttttaagttataaaccatttgtgattatttttgaaatgcttattttaaaatagaagaaaactttccaagcaagcattttctttcctcaggaaaaggaatttgtgtctagacaagagcagatggatgctccctgattcttttagggtagttgtcgtgaatggaatttagagagtttttttttttttttttaccccctccttctaggcagtccttcttcatcttttatcaaacaattcatctcatgggttatgtattgccttctggaacttaaatttgatttatgtttgaaatatacatttataattttcccaacatgaatttatggaaatggcagcctttagaaactcccacagaggtaacagatgattgactcggatgaaagaaagtccaagaatgtatgcaggaagaattgggactggccaagatgatgatagttgtctggagaggtagaaacagctgacaaatagcagcaaatagggagcagattaagccagggtactgttgttcttgctcctggattccaattttcaacttcgaacctgatgtctcaagacagaagagaagctagtatatcattggtctaggcagaggaagattgaaatttagagaaagtatgtaaggtttatttctacattgcctctgctacattttaaaaaagcatttgaagacacttaagatttaaattcaatcaagtgatgtaaattaaataattaaagtggtgtaaatatgagatagaaaggaaatagtttcaagagaatattggatgaaactgggtggctgagtagaaactgtgtttctactgggctaggcaagctgagtttgaattgttttgtttttattttctggaagttactactttgttggtaaaggctttcaaagactttctttcctcatggatctggggaggtcataatggaacaccatgtttaacattggccttcttggcaagcaagataaaaagcaaagttctaggagcaagtttatcaaatcttgtcctgagggcagattatttcacaggaaattccttattaaaaatgcaacactgtcaccaggatgatacggggctgctgaggggagagaagggcatagaactggggaagctcagtttgcaaaacaaattgtaccaacttcccggttttcagattcagcactaattggtgtgctgtgtcccattatgctcaccttttttttttttccatggtgaatcgtgtggttgtacctccaagttctttccaaaagagactaggtgattttgcctggtagaaacagtgtgtgcatgggtaaatgcagaaagtcatggtgtgaagacagccccaagaagcatttactatggctctttcatgtgctaggcagtgtggtaatcatctgacatgcatcctacttgtttgtaagtgcctccaaagcataatgtatttgtgttatttaccactcgattcccgattcccggtgcctagagtactgcttagatttgcatataaaatttagtaataaacttgttgaatgtatttctgatctttatgtaaaccctgaagggcaatgatcattatttctgttttatactgagtaaactgaggcttaaattggtttaataacgtgtaaaattaaatatcaagattcatttacacattttcctggaaccaataaatatgcttgaaacgtagatcaagcatcgttgctacaattaaacagaaattttcatgtgtcctgctagctagttttttaccaatatttttacttagggcatagctatttttactgatagttttacttatggcatagcatactacattagttatatatttctgtgtaacaaattacccgcaaatttaacttgccacgtgggcttttctttagagcagcttacaacatggcaactgtcttccatcagagttaagtaaccaagatagtaagaaaacagaagccagcatcatttttcatttcagaagtggcatcccatctttttttgccatattctgttggttagaagtgaattactagttccagctcacattcaaggttgaggggattacacaaaggcatgaataccaggagaagaggaatcactgggggccctctcagaggcatctgtcacacatacatatttgcaaatacatgaggataggagagaccataagggtaatgaatggcataactggataaaacagtcctagggtgtgtggacaaatcccacaacatggacttaataaggacatattcaaatgctggtataatagccctattaccttgtgcagtggcatttagagcacaaaagatccactgaggcaatatgaagccatacagtatgtggacaggaggggacagaggaataacagagctagatcgtggagaaggaagggcctagattcattcaaggtgattggagaagtgggttggagtcaaagagaacagataagagtcagggaatggtacatagacaaagctggtacataattcaaagatcagtgtgcatgccaaagggaataaaaaactaatggcatcatcaggaaaaattctatttgacttaggtttagagattcgaacattaattgaagaagctctttagcctgtggtgtcagaagtcataaccaagattcgagtgcatgtgtgtaaaattaggggtggaagtgaaagctctgaacagtgtacgaacccttagccaagggctttaatgagattccagccatcctcgtacctcctagggaaggcacacacctataaatacatatggaaatgaaatagtcactatttgcgaagtagacgtatagatccatttgcctagtaggtaatgctcccacccaaacatctctaaaaagattctgagctgaggatttttaaagtcccccgtgtaggggtgaattgggggaatacttaaagaccttctattaatttatgatcatgacattcgttactaaaatcactaatataaaatggtggccagcttctatgatttgtcatctgttcttaagtggaactaaagggagagatgtgttatggcttcagtttggggtagtttctacttctacattgactgtgaattggaacttcagactcggtcttcttacaactgattatgcttcatggatgtgtggaattgtcaaggcacaccccgtgccttatagatgccagtcagagtcccctttgggcaactttagggccccagtagttgatatcacactctcttttacccttttttcctctcttctgtcatctaattagggggcctcctgaataatcccttagcagtgtctgacaggaaccatttttgggaaagaatactttacctgtagaaataacatcaaacatcacttacctggtataggggacactggaatggccccacagtgatcctccaaattaatattttctggctccaattactctgatttttccctaatctttaccgaattccaactgttacagtagaggctcagtgactgtctgtgatggggggaggatattgtactaattcctgcacaggaattagctgcaattccatccctgtcgtgatattttatgttatttttagattcctttcaatgctcttttttttattttatgttaacagttactaaactgtttatctctctcgaacaggggctttgtctattttcttttctctatgctccataataaaatttgtgcaagaaacacactcagagtgtgttggatgactgcatcaccacagttgggtgacccctgtgcatgcagatgtgcttgactggccttggcgaactagttgagaatagaattatgaatctttcttgctcaatggtgatgctccttctgaagaagcagagtcctgaaagaatcctgagctcaggtttctgaaaggtccctacagaccaaacccagaatgcccactaatcacttgttaaatgactcgtgatactttttaataaaattactgaaccaatgctaaatgatgggcagaaaaagagagacttgttatgtgaaatgtgatgctactcactttgtccgtgaaatactggatgacaaaggagttcttcatcttaattttccccatttattcctgtcctattcttttacttcttatccttctctacccaactggatagattgtctgtgctagaagcaggacaagggtttaaatgcaaagaatgaagcagagatggtctctgcctgaaggcgattcatatgtgaaacagttgacatacagaaataccgatgaactagcctaatacagtatactgagtgctataatggtgtgcgtgtgtgtgtgtgtgtgtgtgtgtgtgtgtgagattaggatgctataaaattacagagaattgtagagaactgtctactttgggttctgaggattaaagaaggcttcacaatggcaattagttctacactggagattgaagattgagtaggagttcacctgggccaaagacgagtatgtacatttcagtatgagaaaataaatcattcatggatatgttgctgtgggtccatttcatatttggagatattgaagttaaagtctgtctaactggaacatttgagaatatgtggtaataaggggtgagacagaaagacacaagaaccatataggcagataatagatgctttttgtgtttgtttcttgataaagaggttttatagttctctgtagtatagggaatcattggaatacttaaagcaggggtaaggaccttttatatacctgagggtagcgaggttacctgactcttcatctctgctacctttggttgaccttgcattttgccctttgggttgtcagcagtcctatttgaatatttaacacaacttctcattcatttaactgactcaccctgtgttctgaaacttcatccctgacgtctctcaggagaatttattccagaactttctcacctctggtttaggatctcgatcaacactagaatgatgcgaccttgatttttatatgcatacttaactctgatttcattactcctagggatatcatcgttttgtggcctagtgtgtgcgctgcatacagaaatatagctagaattcaaaagtttatctctgaatttgatcaccctttcagacataagctattaagaacaaatcagcatttctgataaataactgtaaagtggtgcctacagtttttggatgtaattcagaaagcagaaagaagcttctatttatattcctatatcaaaaactctgttaatacacaatgtgtgcatcacaaaggcaatgctgcgttttgtcctaattagtgagaggcagaagcagcatcatatttgaggaagtttgaaactttttctgtctcagtattacttttggggtatttaggtttttttttttttttttttttttttttgagatggagtcttgctctgttgcccaggctggagtgcagtggcaccacctcggctcactgcaagctctgcctcccagattcatgccattctcctgcctcagcctcccaagtagctgggactacaggcacccgccaccacacccagctaattttttgtatttttagtagagacggggtttcactgtgttacccaggatggtctcgatctcctgacctcgtgatccaccctcctcggcctcccaaagtgctgggattacaggcatgagccaaggcgcctggcctagattttttagacattaccaaagtattagaaaaattaatagtcaacctaacatcttaggttctgtcaagatgggtcattgttctataaacttttgtttttatgtctcatcactctttctgttttgagacggagtctcgctctgttgcccaggctgaagttcagtggtgcgatcttggttcactgcaacctctgcctcctgggttcaagcgattctcatgcctcagcctctcgagtagctgggattacaggcacctgccaccatgcctggctatgttttgtatttttagtagaggtggggtttcaccatgttgcccaggctattcttgaactccagacctcaggtgatccacccaccttggcttcccaaagtgctggaattacacgtgtgagccaccgtgcccagcctcatcactcttaaaggcagaataggataagaccgaatgagcgaagagcagcaatgtggagagcagaggtattggtgattaaagaacagtagcagttgaccaatccctaaataaatattgaactgtgcttaggattggtctcagagaaagagtttcttaggggtcagacccagaaaaacactgacttatggtaaggaaaaaaatagatgtcttgtcagttacagtaaatataatgaattgaatgagttcgagttttatgttttactggccaaagaatataataagatggtttaaatattaaggctcaattgcactctgagcctctattttaaaaataaagaacttgtaccctctcccctatcgtttttttcttccttgaaaggtcgatggtagttctgttccaatctcttcataaaaattcattgtttctgccacttctgacaaccccaggtcaataacactgttgtttataccaaaatcctaccatccaaatctcactagagagataatgtatgccatgctggtgcaaatagaatcctcttctccaaactgtatgtcacagcattactagatgtattctgagttgcagagcatcccctatgaagtccatttaggttttagctttctcctctcacccttgcgggaagtatcaggccaggaggtggttttagcgagatggcaaaaaccgcatttatttttgcaccaacctaatagcatgtcaccttctacgttgtcctcctccccatctcttcctcagggtgaccttgccacaaacaaagcaacaccataacctttttcacccctttatattcgagaaaggtcttcatgcaaatagaggtgtgttcatgcaggttggggtctgagcggtgggcattttcccactcaacttcttagttggcagttactaaggcagaatattaagtgtttgatcacagtcataatgtctgagggacttcctcacttaatgatattgttcagatcggtttctatcatgttgtgggccatgtgatagaactttattttttcagagcccagttctataagaagtacaaccttgagaataatttgatttctttttaaacatgtgaattatgaaaagattcaaagatacaaaaagaacaaagactaataaaacaaatgtctctccttccatctcaaaggtaactactatatttaaagtggtatatatccttttagaacatgtaagaacatgtacaaatgtatatgtttaaataatgcacagttttcatttgtgtatttaaaaatttttcacaaacgatgtttcttttcctactcacacgatattgtttttcccactcgaactttgacctcagggcttattcactttaatatattgactgtcccctgactcacatccctaagtctgttttatcccacccagatgtactgtctgtggatctgcagttagcatatcaaagtggttcctgagttggaggattcagaatagggctggggtagagcctgtagacagagctcccttaaagcaattattttcattctcaggttttgtataattttcttcttaactctttgaatatataacctagcaggaaacaactgtctctatggttatagagacacaaaaacatttttgtgactccaatgtacaattacttacccctcctaatcagcatttctttagaagttaatatttggccaagcccctagagaatgccccaaatcacagggagtggattttactagattttgtcaaagcacttgccgaaatgatgtgtaaccattgttctcccatctgtagtagaagggtaccattgtgtctgcatgctcaatatgattaatattattatgctttaatttgtttacctatgcctataagtatgaaattacatctcattgtttgcattatttctctgattatgggtgaagtcttactgtgtatttatcagcaatatggattgcttttctgtgaactgagtgtactaattctttgtcaatttttaatatttttccgtattgatttgtgggattagtctatttattttatatacatgtaggagtactaattctttatcagttatatccatagggataaacagttttatgcctctgaaagctcccttgtagtattacatagaactataacatcactgatggtcatacttatggcaacgtagacaccgtggagtggcattaatataactcagtttaagaaagagggaacttgtaattatatttaagaagatacttattctcaaattctaatatgtacaaaaataatttcatgctcactattgagtcatttaaaaaagtttattcccaacacgaataactcaaatagtctgagtttaatgcagtggtttttagaaatatagttttatttgattcatatttgtggcagtacagcttaatatttcccaaattcttttatctaaatatagcttaaaagcccaaatgaaaaattcaagtaatatagagaaccaattatagtaattcatccatagaaggagatttccccatgcatgctgtggtttcggtaatttctactaaagtgtgggcacacagttttcctctaaccctgctgtctccccctccttttttaagtctgtcttttcctggtagaaatacatttttccaggaatgttttatcttgaatactctgaccctacagagtaaagtaatttagcagaatttctcacagagggattaaaatggatattaaagtatccacagaggatgaaagtgagtataaagaggaatcaggcatgaaagttcaggaatggaaatagatgaatgatgtttctattttatcatccttgtaaataaaacgaatatgcttttggctttcatttactatacaaattgattgttacaggataaaagctgagaaaattgaattataatttttgagaatcagtgaatcagcagcatcttttaagaagttagtggaggtgttccagacgctccgctgagtttactttccactaatctctagggtgtgtgcaggatccctgtgaaaataacgaagtgtcagcattttagaaatttatatacgtatgctctttcacatccgggtggtcctggtaagatggaacactttatctttgagcccattggtcttctctttccataggacattctgctgaaatgtcccgtgtctgtctccctcttttctattacacactccttccccatcttcccttgctccaccctcccctcccccatgtctcaagtccagcatttctgacaaaagtgggaagggttgtatcatttcatccacatttgattgtgaagccatttgggttaaggtctgctactcaccagctatgactgtaacatccgatattagttaaatatttattgatacttccaaagggccagattccacccaaaacttttttgcattttcccactgaatcacgaagtagaattttattacattttatagacaaagaaacaggttaaaacgtggccaaggatttacagtaaccagtaaccagcagcaaccagcagaaatgcaactcagtttggggttagggtaacatgaaaactatattcacacactacaccacactactgtgggcaggttttaaaaactttgtcttttgcaaaccatcaccatgcatagaataacaattgggaaagtttcctttccctgctcctgaggtaactgtcataaagactactaaattgggctcacttcaaactggacagatgagtgtcttgctccacttaacttttagaatgcccgaggacctgccacttcgcccaagagctggaataagaggtagtgagagagaaattgcctaatcctctgctttttatttttaacccagtgatgccacgcttcgctgaacaagtagaggttgccattgaagccctgagtgccaacgttcctcaaccgtttgaggagaatgagttcatcgatgcctctcgcctggtgtatgatggcgttcgggacatcagaaaggctgtgctgatgatcagggtatgtgaggcctctgtagctcagagctggtcagatctcctagtaggaaactaaagagctaactgtcttatttattatttattttgtaattactgagtttaacttggtaagctgtttggctccttattagtcagacaaggtgagctttatacttatgaagggatgagtaatatcaacaagctcaagtgagcactgaatattctgaagggcaacaccctgcctacttgttgcatgcattacttcctcagtttcatacaacctttaggcatacccctgctattttccatttgtatctcttgctaacactcttcccatcaggatctgaagaccatgggctggaaagaaatgaagattacacagcatagtagtgtttataataacacataatagtaacagttattatcatgcaactatgaagtgatacataattacattctctttgtataaaaataattcagacattataaataaggctggatagcctaacatcaaacctcttattacccactccactatcttcccatcttcagacttctgttgttaggtaggtgtgtcttccaaaatgttgtctaaataattaatatatatattcacaggcctagaaaatatatattgtagttgatttaaaaactcatacagcatcatttgcaactttttgttcacccacaaggcacattcacatatgtctgttaagacatctagctaacctcattttatttaactgctgtataatccattataagatgacttttttctccttatcttaccaacagtttagcatagtaatgtccaaacatatttattagccacataataatctttatttcttcaaatatactgcatatgcaaaagcacatttattgctattatatttgaagcagaggtggggcttctgcagttctaatcccaaaagcatgctgtccagtagaatggtatccacacttgtaacttaaaatattctagtaaacacactacaaaagcaaaaagatgaaattaattataattttaaaaatttatttaaccaaatgtatccaaaatatcattttgtggcacactatggtgttttgtttggcacggagcctaaatctttctctctctttctttctgggtgtgtgtgcgtgtatgtgtgtgtaagagagggagagagatgcctagaaatatgggagggggacagagaaaagagatataagaattggaagagagggcaaggaaagatagtcagccttttaggcccataagaaattagatcatttttgtactaacttgtgaaataaagtaatagaccatgagaattgtattttcaaagcatttggtactaaatcccactgtaatcctcaagatatattccctcttttgccatttttctgctttgctggccttcacatgtttgtcacaaccattcacctaggaggatgagaaagtttatagccatcattcacttactaattcatgagctgtaacacacacacacacatacacacacacaattttagataaaatgtcgtatctttgtcacataaagtgtcatttctctatctcgacatttcaagtagtttgattagacggatttcacaccacttaaaatttaggaggagagaaatgtacagtatgtacaaattgttatttttaaaatccttctccattcagcacccaaatggcttcattttgcacttaaataatttcttggttttctttctgaatgtaatgattgagtctactttaaaaaatcccttgtgctaaggaagataaacaataagacaagtagaattgtttctttcccaaaacatttgaccatacctccttccctcccaaaggctgcaaagaaagatttttcttttcccaaaaacaatacagaaaggatcctgaagggtcaaattctttatcatcttgtctcttggcagtcaatacatatttaatggtgatgttggtatccaagtgcttgaggccagctccaggcaaccctctgaagtagacaaagcttgttcttactgtattccagcctcagctgtcaggacctcccttttctgttggagcaatctacccctcttccatgaaaccattttttttttttttgcttcttcctgaggcttgtccattgggatctgttaggcacataggaattttctgattatccccacaaagtggcttaaaaatatatatgcaaatctggcagaccaacatatagtcatttttcatttcttacagtagttagtgttctacaaattcactgtgaacacgaaatttgtgaatcttgaatcattgcttctaggagaaatacagggttaggttactgtgagcttctggccacacttttatcaactgatcaatacttaaccttgttttatgtgagtttgtgttcaaagacaccttctttaatatgtattgttttttgggggagccgaggcaggtggatcacctgaggtcgggagtttaagaccagcctggccaacatggtgaaaccctgtctctactgaaaaaaaaaaaaaaaaaaaaatacaaaaatcagccaggcatgttggcgtgcatctgtaatcctagctacttgggaggctgtgggaggagaattgcttgaacctgggaggcggaggttacagtttaacttcacgtctcccaaactgtgtatcaaggtgccctggagcattgccagatattttaaaatttcaagggtagcacatagacatctcttgaattctgtatgaaatatgttaatcaacgtggcctcttaaggtgtctagttttattaattagaaatagttcagtatgattaaaaattggtaattctgtcttggttattcatttatttgctgaaagcttattagatgtccaaacttttggagttgccctgaatacaggatgaacaaagcagacaaaagtctctaccctcacaggatttctattcctctggtaggagacagagaataaacaaggaaatataatgtcaaacattatgccacagagaaaaccaaagtatcctaaaggggatagagcttctggtgggcatggatctcatgaaaggaggtacctgggtggcatttgagaagatactgggagaaggaagaagaaataagccctaacggtactcaggtggagcatgtttccggcggaggaaatgtcaagtgcaaaggttggagccaggaacttgacctagagacctaaggaccttattgaatgagttgggagccactggagggttctgagcaggggaatagtgtgatctgacttagaccttaaaaggaccaccatggccatgctggtgagaacagaatgtatggggcaagagcagaagcaagatcagttaggaacctccagaataatccaggccaggccagacttgctggtcgccaatcactcctgactagggagttttttcattttgttgttgttgttgttttgtttttacctttggatctctaatttgattttctagtctgcagcccattccagtggtgttgagctctgttgggaaatcctacctcatgcatctctcaagctctcctgccaacctatattctcagccttctcccagtgaaattctcatacacatttgggccgtttctttcaatggttcttattacattttatgaaaaatgagaaaatactgaaggattcagagtcatttcaccgggactcatttgtaaaatttactcaacaactcacatgtccaggtgaaatgactgaatccttcaatactttctcactttgtttctctatagaggctgttgcagaggaatagagcaccagcagcaggtgaacgggtcctgttttgcaactgacatgtggtatgaccctggtcaagccacatgatctccctgggcccctgtaatgggcacaagttaatctcatagacttttaggagagaatctggagtctgaatacttggtgccattttacagatatgacccacttccataacaaaacataaaatagtggaaccacgaaactaggagtagactttaaatagtttctgtttattgaaaaaagccttcccaaagagcacatagaactttcaccctcagtctctatcctccagtacagcgaactgtttattttatttattcctttaccctgtaacactatctaatgatagaagcgtaatcttcctgggcccatttgcagaccctctgtaattttccatgtttcctttaattcatggaggtctttgaccaactaaaaaatagcactcatagttttaaaaatgtgtaattcaaaaaagaatgccacgagtaggagacacactcacatgcaattagcaaactgcacatgcacagaactttttatatggatgggctggatgggtttgttgcgtgtttaaggtacatgtaaatagcttaagctcatctatttgcctggtggtatttgtgatggttaaaatcatgggctctgaaaccgtcaacttgttgcccgcctccatcacttgctaggtgtgatgctttggaaaatatactcaacagttctgagcctgttcacacacctataaaatggtgattacatttatttcattaggtttttgtaaggatcaaattctttagctgaatgcctgtcccatagtgggtggtaaacaatgattgccattattattgctgttgttgttattaggtgttatattttattattaagcacagtaattatcaccatcatttatgaatttagttaatttttatggttcctaaagcattttcctatacatctaagcttaggagtcctgtggggcagaaagtgcatatagcaattataatctccgttttatgagcagggagacacagaagtagtgaaactaagtgacttgccaaagacatatagcttgtgaatggcagagttaggtcaaaacatgcaggtcccctgagtcctcgtccaggttaatacctcttttgattttaatgtttttctttattttggttcttgggccattgtctcttgaataaaaactcatcattattagccttatgctgccaggttgggtttgtcattgactcatctactgaatgcacagatcactgaaatgtttgggcacagtactataagaactgtcatattctgcttatttttgttgaatgagatttttcgatttactttttctctttcaagaacttatgacaaaaagcgcttgtaatcttgtcatctcatctgtcagctgaatttaccaacttgctataattgtcccacagtacactgcaaaagagggagaaatgatcagagaatattgtctctgtccacaataaaaatacaaccagttacttgaactgggctctgcctactgtagccctgctttagttaataaaatatgagaacaaaacctctttcttctctccttattttaatattcctatgaaagtaaacatctgtagatgactgagtgaatgttaataaggttgatggtgagagagaaggaaaaacaagagtgatatgccaaagcttggaaaattactaggcataacgtgctattggcacgaaggaccccattttatgcctgtctgaccaatctcaagccttcatcaataaccacacctgattaattacactgtggtagccaaagaaaccagcagaataaaaatgtgcccttttggatggggaatgggcaactacatcatcggtattccttgtggtctgctcttttcttttgaaagacaaagccctggaatgtggtcctactgtatgccaagaggcagtctgtggaagaccatcacctgtcaggctaatctcacactgattcactcactcacttttgtgcaccatccttactaccgttcgaatttaacctcatagagttagcaaagccttagagcaagctataacgtctcatgcctcagttttcctacctggaaaatggagaaaataatgtctacatcatacgagtgttaagaaacctgcgtgagttagtgcctgtaaagcacttagaaaaaacgttgacagacacatacatggtaagcacttaatgcacagttatctattattattgccattgaagatggaaaggtgttttgttcctgggcttatggattctttcttatcttttccttatcactgactttatagattggaaaggatcttgatctaactctactctttttaagcaattttataacttcagttcttgctaaatttgtaacgtgaataaactacaacaaaaactaataatgagaagtatgtttggagtcagacacacctgggtgtttagatctaacttctggttctttattaactaatttagggatatggggcaaatggcttaacttctttgcaccttgtattacttacctctaaatagagaatgatccctaatgtcactgtgctcatctgagctaaattgataatacatatgtaaaagttatttaatcctttatgggtatgtggtaatcagtagcttcatttcataaactttgttgaatgaattgatttaaaaatcctaataataatgatgggccaggcacagtgactcatgcttgtaatcctagcaatttgggaggccaatgcgggcagatcacttcaggccaggagttccagaccagcctggccaacgtggtgaaaccttgtctctactaaaaaatacaaaaattagccaagcatgatggtgtacacctgtaatcccagctacttgggtggctgaggtacaagaataacttgaacctgggaggtggaagttatagtgagccaagatcccactgctgcactccagcctgggctacacagtgagaccctgtctcaaaacaacaaaccctaagtaataatgatgacaaacatttaaaaaatacctactctgtgtctgatactatacagataatacattgcctaatcttcacagcaatcatagaggtagctactattatcaacctcaatttacagaggaagtcaaactaagagaggtaagatagtttatttatgagcacataggggctcatattcaggcagtcttgactctagagcctgtgcttataaccgttataccttatggctttgtgaccaaatcagatattccatcaggtctagcctttggcctggagataatcaacttttttgtttatagagcaaaagtggcattatagaagtataggtgtaaattttgttgttgatggatcttttctttcaatagatttggatgggtggaaataatacacagatatcatttttcttaaaattagcatatcactgcaagttagacttactatacctgtatgaggaaataataaataaaatatattttttaaagtaaattagggcagcttgatttttctgactgcattccggctaatactcacccacatagctgtgtgggtgctatgtaggatgctataagctctgtttgctgggggatatttagcctttgcaatgaagtgtgtggatgggggtgaagattatcaatttaagtatgctgacttatatctttttgtctttagaccccagaagaactagaggatgattctgactttgagcaggaagattatgatgtgcgtagcaggacaagtgttcagactgaggatgaccagctcattgcagggcagagcgcacgggtgagtggacacctaagactttggcttggcacacagggaccgtgtttactaaaatggtttgagggtatttctaaactccagacacgtggtaccccagagattcatgggtcagaaatctgtgctctcatctgaggttgtttatagcaaatcacattttacacagtgaaaataaccaccactgctcctgattcctctaactcctctcttttgctatcactggaaacatagcaaccacatcacagcaagcttttatgtgtataattgattttgttgggtttgggtactagaattagatgatagactgataggggacactggaatactcaaattttgcattggcacagtcaccattgttcttcctgaagtctccaagcttgtcaacacaagaggcaatgacaaatgaggaatcagggcactactttgtttatagctgggctgttgctccatacaatggcctatgttctatgatatctaagaccgtatcttttgaaattggttcaaggccattagatagagaactttttctttcctcatgatgcctgtctactcccatggtggtattcctagatctgtctgccatatgatagaaaaatagagacaaattagaaatattcaagtttaaggcaaggatcaggaagcaacagagagagtaccagctctgcctgacatttgagtactccatgatactgttcaccaatgcatttggtctaaagagcatcctaaatttggatcaatctgatttgctgtatcacccagagagtaggtgtacgtaatcaaggccggtggtaagagatgaaatctttagagactgcataggacgatgaaattttcctccccttaagggctcagtttccaaagagtaaaaacaatcagattatagtataactgagaattagatattctaattttctttgttaagttttatttaaataaaagataatgaatagaaagcaagaggttgagaaagagaaggtaatttaaaatagaaattgggaaacgccagaaagcccacactgccttaagaattatgaaagaaaaataatcagaggttaaaataaagaggacttgagggagatgtttagtcaagaaagactttgtgtctaaaacccagtttctcttatgtgctttatgccctgatattctcactcaacaatcaagtgacccaaaagatataaacaaacattaataggagggatgtgaaggttaaagaatattaaagacaaagcctttgatttcagacagatttggttttgaattataaagggcagcattagaaccatgctcaaagctacatgttgcttgatttttcagtttcagacctctctctaaaatgcgaataacagggttacctgataggattcttatgaagatttaattacttaatatttgtaaaataataggcacaatattagacattcagtaagtgctcgataaagatgaccgtgataattatcatcctttctaagagaaatcctttccgatcacatgatggtgggacaacagaaaagttggcatagagccccctatttcaaaaattccttgcagactctatttaatcccccctaaaatgttgaaaattggaaaggtcagtaacttgaaaatcttttgactctgtgttggcaaaacgtcagatgaattaaacagtcaattcatcttcagaattaagtaaaaccagcattgttatgtcactgacaaagggcaattttgagtaattcatccaaacatgaagcaattcaaagtcaatttaattgactaactgcaactcagtatacatacagcctagtatccactgactagttttcttaaagacaaagacaggttgtacaactcatcttgctttataagcaccatcttgtcaaaatggcatgaacagtcccacttttacaaggaagaatagagtcgcaatatacttctgtttcattgggaacctaattctagtctcatttacattagacttcaagtcaatgatgatgggtggaaatacaatttggagactcctgtctttatcatctattatttcttcacactagtgtcttttctgagagtttttttcagcatgaattataaacagggtccaagatagtaagaacagagcactcctacaaattcagcacttgctcatttgactttgaggtctatcatgtggtctgtacgattaagttgcagcagacagcattacttactgagtcagcctattttagcctgtaattatatgatgacaaatcagagacatggaattatggctgttaagttggaaataagagggtgcattgaattgctgaaatgatagatggtcagacttttgaccagcaaagtgtgctaagttggtccaaattttgaaggaggcgaactttgtctttgacagaggcatttgctcttccctgcagcaagtcctcccatgttaatgatattactttgtgttcacatttagagaaagtctccctttctaaaaatggtaaattaatctataagaaggtttgagtgggagataagcttttagtaaccccatccaacattgctctcaaattctggaattaaagtatttcaaaaatgtcctttatatgcccatatctgctgcttgcctacaacattctgagggagaggagatagggggcggggggcggtttaggaggggggaatgaatgggaatcaatatggatggtggtgatctgataaaatatggaggtgatcttaccctttgatcctagacatgacataatataaactgtttctccacagtctggcatagttaaaataggttagtgacaattgctaggcacttaaccttggtgatacaatatattatttggagtcacacagacctgattttaaatatggacttagtgaagctgtgtgactttggggcaactttcttaacctctccacacttcatctcctcgtatgctaccacataaggtcgtagggagaattccatgataaaatgtatcacaggatttatcatataaatatgtaataattaagttggtggtaatggtgatgatgcttgtggcttgagctaatcattcattagaaggctgactaaataatttcacctaaaagagttggatcattcaggcaatcatgagagtttttacttgagttaatgggacaactacctcaattttccaattcacttcacagctagagactggtaagaatcaaaggacccactccttaactacttattatactgctttaaagtcaagtaagtagaaacaggcacattgagttttagtccctttaattgttatttataaacattcttgtacttgaaacttaatgttagcctcttgctctaggctaagaaatgaacacttgtcagtttggggacccatagacgttaaaaatcatttttttctctggaaattggaagataattatatcaaaatctccttgagatttaaattgaagaatggattcagtgctatctgaatggttgtttccttttatcagtgattttcacttttagtgtaataggtatagtttataacaatcaccgaaaaatggttggtggttcagaggaaaggctgggagggactctggggtagggggaaggaatccttttggattaatatctctgataccactaatttggaaccccacatcaggcagatcaacaatttggagagctgtgctttgctactgtgaaaagcagaaacttcaacctgtcctgggtaatcatatcatacaaacaaaatctgatatgttccctttcctcttggccatgaagataatttttctcatgttcccttagtttgagggaatgaacaattgcatgttatgtattttatattgagtttgatttcaatgtagctggcttctatttttttctagctagaatggccttaatgtgttaacatttcaaactgctgagttacattgataagacctaattaaaactcatgtgttgaattctaatttgattaacttgcaaatttcacagtttgtgatctactgtttatagataacctttttttaaattccagtttcagaaaaggtcaattatgaatttttaaaagcaagagcattttaagaatatttaggaagagacttcagctcattgatagctacataagcagaagcaaatggaaagatgctttcacccaagtcacacaccattaagtgtattatgcaggtcgagcacccctagagtcaaaataatatcttcctttgcaaacttgcattggaggggatagtttttcttcagaattgtgtccttagaatgtgtgtgtccgttctggcaacttctcttgagttatgttaatgcagtgagtggaaaaatgtttaagcagtcaaaagatgtttattaagcttctactctgggcaggatatggcagcctaaaccctagggaagcatataaagaagttagcagtagggcattaataggaattaattagagagcaaagcaaagcagttaatattcaagtgctaaattgtattatggagatgcaagtgctatagttgacagagaagtatacacttttcagtgcacaaattaaccttgtgttgggacaatgaaatgtgcattgcttttcatctggggattgaacattgagtctgggagtctgctggtagttttacggattctttttcagagaagcacctagcgaatgttttaaatgatgctggtttaggacctgtgaggtctaagtaaagcatgattcgctcttctgtatgaggaggacaataaaccaaaaacagcaataggtcatcagaaaggaatagttaaggaaaaaagtgcatatataatttctgtaaatcaaacatatctcaaatatagtggaatagctgtcttgctatgaacacaacattgcaaatgtgagcttacaataaactcttgtatatcaagcaccttttcaaatacagtttttaaagctactttatctttcaagatatagtattttagatatcttaatagtattcatacaagtctggatttttaaatatggattaaaatttacacgtacacacgcatatccaaacatacatacacatgctatttaaagccacatacatgtatccatggaagtcagtagatgtggctactagtaagaagcatctgggcagccacgggttcaaggatacctttagtcaaatcagacaccataggcaactcatgtctatggcatccaccaggatgcacagtgtggcgagcagtgctagtgatatcagtgacccttgccccacttggttgaggaccccaggacagtgggtaagttgcatggccaggcacaactgatgatccagttgtgtagagtggttaagaatgatcttagttcaggtgggtttgaatcctattcctagagcctattgtgtgatattaggaattctatgaatttctctaggcctagatattattattaaaatggggatagtaatagtatcagaatgattaagtagattgttatttgacatacataagcctcagcacagtacccagtacttgtggatatacataaggaatcataacaatcttctatttgtagatagttgcatagaccccgagcccatccctttccctatagcaactaagaaatgagccagaggggtagttggaaaggcaaattaatggcagcagttataatataatgttaatgataattctatacatgcttactttcattttatttgaaaaaacacatattatttaatttgctgcccaccatcaccttttgaggtaattatttactatgcccatattctatctgaagagatcaacgatagatccatgtaacagtgaagtcttaacccatgtcagctacagagcccctgttgaacccagttcttctgagctcacattgcctgatacctctattagaccttagttatagtccttccaaatttattcactcacacagggagaagatttataatttaggaagcatttttcttgtgttattttacttgttcattgcagaaactgcagtcccccaaactgtaccctcttggtctgtcttatggaaaatatgtgcatcctagaagcaggggaattggaagtacctattcacattcccctgtctgtgaagcaggttgcatacagttttgggaggatgtgatacggtgatgacagacatttcattcggggcttgctacctaaatggtgtttaacaaatatagttgattctcattactcctgatagttatgttctataaagtcatcatgaacatttaattagcaaatatttaatcattggtcctaggggaaatacagcagtagattcctcagagctgccagtcaagacattttcttcaactgatcaataagtaactatgtttaatgggtgtttctgtttagacactttatatttttgattcattaacattgaactcacagccaataactctgtaactcatgcctgattgaagcttaactaacacatgtgttttctccataaggcacatgcccgccttctcgtgctcggggacactagacgcacttcagcaccatgcttggagccattttaaacagcaaagttactaacaaaaagcacaaagatatgaaaaatgtagcattaaatagactgcaaaaagtacacttgtttacagtacgagagctgaaaaaggaaggcagagcattgccttgttcaacctcatctgggaatgtgcatgtcacgcaactcaatttttttgctgctctgcccacatttgcaaatgaccacgaaaatgctacaagccttgattttggggttacaagtatattttagagagtaggcaaattggcaaatgaagaatccatgaataagaagactgcagttctcctttttctacattttcttacctagcagttattgaaaatgaacccatgcttcctaattttatcctttatcccattataacttttctgcctacgtactcaaaggctttaacaaggagccgcaggcatgccaccaccctaaaggagatgggggagggctgagagtaggcacaccgtccctggagtgccctgggcaggggatttttgttgggcatctctctgtagacaccttcacttacactcatagaaagtagccccatcctcccccacttggatgctcagatagtgtttaaaattcctatcctttccagcgacagaaggccgtttttctttttttcccttctctgaacagatttcagtgttgaaagaggtgcattctttcatctggtaaaagtttcctgagaccaaatataaaaattgtcaagaatagcttcttttgaacaaacatatgccatcaaagcggcagagaagttctgttattgccagtgcgcacgtagctttggatatctctgtatttttcatatatgggagtgggacggggactttggggagcttatcagcctgtgctcgtggcctccctggaatggagaaagacgtgctttccggaatggcagggtagctcataagcctttgcagggtctggctctgccatccgcagaaggcagagtcaacatacggtctgtacttcctttgtcaccgtcactcacgctttttctgtaacccacgcaggccatcatggcgcaactaccgcaggaggagaaggcaaaaatagctgagcaggtggagatattccatcaagagaaaagcaagctggatgcagaagtggccaaatgggacgacagcggcaatgatatcattgtactggccaagcagatgtgtatgatcatgatggaaatgacagacttcacaaggtgaggcccagagccagggagctgaagattttttcattaaacccagaagtgtagcagtgtgtattagcatgtgaaagcctgctgaaaaattaaaatataccaacgcaaggtggtggtattataaatttacatgtataagtcaaaatgatctgcacttaattcctagcagataggtatatctttttggtcaaggagaatagattcaatgttgtaattattgttgttataattatctaccctaaggcagtcataaaatcaaaccccgagggacgggtgactcatctttggtctgtgctattttgcaatatgcttaagtattattctgaagataaagtgaatgatttgttaatatacctttggaaaaatatgtacctctgtgtgtgtgtgtgtgtgtgtgtgtgtgtgtgtgtgtgtgtgtgtgcgcgcgcgcgcatgtatacatatagtatgttgtaatattagcttgtgatctagcattaatttaagctcacattttattcttacatattaagaatcagatacaacaatctaagattccattgttttcacagagaaattaaagttgtataagatttatttcctttagctctgagctagtacctttgacaaatcaagtgaccagtcagaattttgtcaggagacttttcttcaacaagggttagtgctcttttctatcattgcattttggtctcttctttaaaagaagatgatatctctgccctttcaacacaaaggacaaaccaagggagagcaaaactcagtaggaacctccctgaattttgagtcagaatatcaggtgatttgggggcaagtctcttactctctatttgcgaaatggtgaaataacacttgtcttatcaacttcagaagagagttttaaaatccaaagagataatgcaagtataaattatgctgttatacagatataaactatggttttactgtagtgtttttttttctggaaaacacacatatgcaaagatgttttaatgatttaacgtggcatttgttattgaaataatgtaagatatatgggaatgtcaagacatcatctgatgggtgacaactttttttaatggttgttgaatgcttctaatgagaaaaggctagaattgattataagttataatttaatatggaacatctctgcgtcaccccctttgcctctggccaatatgtactaatgacatagcttggccctttttcccaatattttaaaattgttttttttacttcagtggaatgattttactgttatgaaggagccctttgagacttttaaatgtcattgtattcattagaagttcatatttgtacatttggttagtctttgtggacttcacacatttatttcacaaagcgtaacagcaggaaaaaagtctgagccattatttcagcctgaaacttctacaaatcagacgattatggcagcctcagtcactgtttctcaaggcctgtgatgacttaatttgcttgctttcaacattttattagtactttacctgatggttattatccagtccattaatagcatcacttgaacaaataatctcagtaaagtgaataatgactctggtcatgttactagttttgatcaggagcacattttataattctctagattatataactgtggtcaaggcacagttatgaaagatatatttgaggggtcttgttacatggtgttaaataagacacatgtctgttagtcaaagtatagttttaaaagtgagaagaaggtgtcttcagtttcatagggatttcatatcattatgctgatttaaataatgaaatgtctagggagctactagttacaatttttcccactgcatgatgagtcgttttgtgttctttttgttagggcaaagggaggagtatagtaatgaatgactggagaaccagagtagactgtgcgtttgaaatgcaacacaggaagttgaggcttcattgctgcctccatctgcacagcctgtttttttttttttttttttttgcaaacagacagctgactagtgcctttctttgtggcctctcacctaagttcactatatttgaccttatacattgttattattgcccttccacttgcatattccacttcaaggaggaataattttagctccataactctaaacattcttaagtaccattttctcttatttaaagaatggatgtagctgattaggaattgaaacttggccactctccataatgtgtatgtgtaaagggcatgtgggtacacaataccctggcatttattatcttgttgttttattcttatcactagctaattcattaatttgattcagtaatctcaatgatattcactccattgttattaaaattgggagggttctgcctcattatatgtgtaataacttcttcatggaagataaaactgattaggcctcatgtctttttcccactcagttcttgacttccatctcatggacaatggcagaagcaccatcctgcatggagtgaatgcatgcttttcttttcatgtcatttttcagaaagaaatcgcatgttgctagtcttgtgtcccaataacaaaaggcgtgcagatagcaacagctcaagtttaattgtacagcaaagagcaaagctgtttttagaatcaaacttaagttctaatcttcaacagttttgagactaagaaaaaaaaactttcagagtacaactgactgtaaaatactgagcactagactcaaaaatcatataatcattctatatttcccaaacttgattttctggcttacttcacatgctcagtacctcagcttagggagcgctttactggtctttcagttccaattctctactcatccaggccacatctgctcagtgaagggcaaccatccagcttcctttgcaccaaaagtttcgttagttcctgttttcacaaaataaaaatccttgtgtttgctctccaaggcctacctttcttgacctttaggcttctgtcctaattttgtacatgtttaacatctgaccttacaacctattccaaaaagtacctggaatagttcaacttgtgattctgcagttccacctgagttctcgaaattccccagattcactcagctgttctactgtgctgtcttcatactgcttcagctgattagtgaaatgcagctcattagtaaaatttcccaaacatattcagaagcctctgaaaagtgacttttatggttcgatacatttgcaaataccctttttatgtgctatatctcattggagagtcacatttggtattaacatgttagaggtattgagaaggcataaaaaatacgttggattaactcagaatttgaattttgaatattaactatattaactcagaatatactgaggcatagatttttcaccttagtacttattaccttctcacaaaataaatgtgaattagttcataaatggtgatgtgacagcagtaatgcggtaatacttttccttgactttcttttttggagtgaccacttcacgggaaagactccagatactgacctttgcatcagaattacctatgtcctaaagagagaaggtttcaagaatctatataagtagagataattatatgacttgatgctctttccaaggaaactaaaaacatactccagatgggacaatatgattgctcctgcattaagaacatgagattacccatagcatcttttacaaacccacaaaatagaaaatctggtctaaggtaggaaaacacaagggctgtgggtcgcaattttaaaatggggagatacaaccaacgtggccagtcttcttgtcgatattgtcttccacggataggaagactcaaacttctgacgctttcatggatgtgattttttttttcttttgtttttttgtttgtttgtttgttttgctgttggctatttgtttcttgtttcagtccccacctcacattatctaaatgactgtagctcattttgacttgtgctgtccaatacagtagccactagccatatatgactacttaaattgtttttctattatggtatacatcatgaagtttaccatctcaatcctttgtaagtgtacatttctatggcattcagtacatttacactgttgtgcaaccattaccaccctccatctccagaacatgttcatcttcctcaacagatactctgtacttactgaatgtaaactccccatctgccttccatttctatgaatttgactaatacaggtatctcacatcagttgagtcacacaatatttgtccttttgtgactggcttatttcatttagcataatgtcttcaaagttcatgcatatattgtagcatatactcaaatgcgtttccttttaaaggtttaataatgttccattgaatgcatgtaccacccacattttctttatccactcatctcttaataagcacttgggttgcttccaccttttggctattatgaataatgctgcactgtacatgagtgtataagtatgtaagttcctgctttcatttcttttaagtgtatacccagaagtggaattgcaggatcatatagtaattcttttaaatgtttgaggaatcacaatattatttttcacagtggctgcaccattttacattcccaccagcaatacacaagtgttcaaatttttccacaatggtcaaatttctccacatccttgccaaaacttgttttctgtttttttcttgatagtagccatcctaatggatgtgaagtggtgtctcatggtggttttaatttgtatttccctaatgattaattatgttgaacaactttcctatgcttattggcattgtatatctcctttggaacaatgtctatccaagtcttttgcccattttttagttgggttgtttgtttgcttttttgttgttgagttgtaggagtccttggtatattccggatattaatttcttatcaggaattacaaattcctgataaagaattactattttctctcattttattggtttctttttcactatttgttgatagtgttctttgacacacacaagtttttaatcttgaagttcaacatctttttttttcttttgttgcttatacttttggtgtcatatgcaagaaattattaccaaatccaatgtcatgaagttttctcctgtgttttcttctttgagttttatactttagttcttatggttaggtctttcatccatttttagttaatttttaaatgaggtataacatgaggactgctgctgcttttgcatgtagataatccagttttaccagcaccatttattgaaaacactgcccttttccaagacccaaatcttagcaaaaatcttagtacctttgtggaaaatcatttgaccttatatatatatataaggatctatttctgaactccattctattccattggtctctatgtctgtctgtatgccagtatgacactattttgattatagtaagttttaaaatcaaaaattgtgaggtctccaatttttgttcttttcaagattgctttggctatttgtgttgccttgagagtccatgtgaattttaggatggatttttaaattttggccaaaatgcctttgggttttgatagggattacagtgaatctgtagatctctttcagtagtattgacatcttaatattaagtcttccaatccacatttattgaatgactttccatttatttttgtaatttcaacaatattttgtagttttcagcatgcaagtcttctgactccatggttaagcttattcctaaacattttatttttttgatactgttctaaatggagttattttcttcattttcttttaggatttttttatttactagtgtctagaaacattttgtatcctgcaacttgcctgaattcaattattagttttaccaggactttttttaaagaatcttaagcattttctacatgtaagatcatgtcacctgttaacagagataattttgcttcttcctttccaatttgaatgccttttagttctttaacttgcctgattgcactggctgggatttccggtactatgttgaataggagtggcaagagcaggcatccttgctttgatcctggtcttagaggtaaagcttttattattcaccattgagtatgaataaagtaagctgtgggttttaaaattttcattaagatgaaataaaactgaaacactgtttgacagttttttttaaagctaaaaacctgtggtggtatttctgaggtctctgttatgttctgttggtgtatatgtgtgttttggtaccagtaccatgctgttttggttactgtagctttgtagtttagtttgaagtcaggtagcatgatgcctccagctttgtcctttttgcttaggatcgtcttggctatacaggctttttttgtttcacatgaaatttaaagtagtttttttctaattctgtgaagaaagtcaatggaagcttgatgggaatagcattgaatctataaattactttgggcagtgtggccattgtcacagtattgattcttcctatccatgagcatggaatgtttttccatttgtttgtgtcctctcttatttccttgagcagtggtttgtagttctcatagaagaggttcttcacattacttataagttgtattcctagttattttattatctttgtagtaattgtgaatggaagttcactcatgatttggctctctgcttgtctattgttgatgtgtaggaatgcctgtgatttttgcacattgattttgcatcctgagactttactgaagttgcttatcgacttaaggagtttttttgggctgagacaaggttgttttttttttttttttttttttttttttttttttttttttttttttttgagacggagtctcgctctgttgccaaggctggagtgcagtggcgtgatctcggctcactgcaagctccacctcccgggttcatgccattctcctgcctcagcctcccgagtagctgggactacaggtgcccgccaccatgcccggctaatttttttgtgtgtttttagtagagacggggcttcaccgtgttcgccaggatggtcttgatctcctgacctcgtgatctgcccaccttggcctctcaaagtgctgggattacaggcctgagccaccgcaccaggccaacaaggggtttttctaagtacacaatcatgtcatctgcaaacagagacaatttgacttcttttctttctatttgaatacactttatttctttttgttgcctgattgccctggccagaacttccaatactatgttgaataggagtgatgagaaagggcatccttgtcttgtgtccggttttcaaagggaatacttccagcttttgcccattcagtttgatattgggtatgggtttgtcataaatagctctcactattctgaggtatgttccatcaatgcctagtttgttaagagttttcaacatgaagtgatgttgaattttatcgaaggccttttctgcttctattaagataatcatggtttttgtcactggttctgtttatgtgattaattacatttattgatttgcctgtgttgaaccaaccttgcatcccagggatgaactcaacttgatcatggtggataagctttttgatgtgctgctggattcagtttgccagtatttaactgaggatttttgcatcgatgttcatcagggatattggcctcgacaaccatctgatctttgacaaaccagacaaaaacaagcaatgtggaaaggattccctatttaataaatgggtactgggaaaactggctagccatatgcagaaaactgaaactggaccccttccttacaccttatacaaaaattaactcaacgtggactaaagacttaaatgtaaaacccaaaaccaaacaaacaaacaaacaaaaaccctagaagaaaacctaggcacaaccattcaggacataggcgtgggcaaagacttcatgactaaaacaccaaaagcaattgtaacaaaaaccaaaattgacaaatgggatcgaattaatctaaagagcttctccacagcaaaagaaactagcatcagagtgaacaggcaacctacagaatgggataaattttttataaattacccatctggcaagggtctaatatccagaatctacaagaaacttaaacacatttacaagaaaaaaaacaccaccttcaaaaagtgggcaaaggatatgaacagacacttgtcaaaagaagacatttatgtggccaacaaacataaaaaaagctcatcatcactgatcattagagaaatgcaattcaaaaccacaatgagataccatctcatgccagtcagaatggcgatcattaaaaagtcaggaaacaatagatgctggcaaggctgtggtgaaataggaatgtttttacactgttggtgggagtgtaaattagttgaaccattgtggaagacagtgtggtgattactcaaagatctagaaccagaaataataccattactggacatacacccaaaggattataaatcattctactacaaagacacttgcatatatgtatgtttattgcagcactatttacaatagcatagacttggaaccaactcagatgcccatcaatgatagactggataaagaaaatctagcacatatacaccatggaatagtatccagccataaagaagaatgagatcatattaattgcagggacatggatgaagctggaagccatcattctcagcaaactaacaaaggaacaaaaaaacaccacatgttctcactcataagtaggagttgaacaatgaaaacacatggacacagggaggggaacaacacacactggggcctgtcaagggttggggagcaagggaaggaagagcattaggacaaatacctaacacatgcggggcttaaaacctagatgacaggttgataggtgctgcaaactaccatgccacatataaagctatgtaacctgtacattctgcacacatagcgtagaacttaaagtataaaaaaaaaaagaatctcaaaaaactaaaaagggatttactacaggacccagatattttgctctcagacatttatccagagacgtaaaaacttgtattcaccccaaaccctataccataaacaattacgtcaggtttatttgtaatagtcccacactggaaactactcaaatgtccttcattgggcaaatggttaaatggttaagcaaactatgttacatctatgccacagactactactcagcaataaaaatgcatgcaatgatttggataaacctttagataattatgctgagtgaaaaacagttatctcaaatatttcatactgtatgattccatttggatggcattcctgacataacaaacttgtagaggtggagaagagattcatgattaggaatatgttaggagtgggttaaatggtataaacagtatgagagaaacttgtggtaatagtacggttctgtgtctcaattgtagtagttacatgaagctatacttacacaagtgcataaaaaatagtgaaagatgaatattccctatggattttaccggtatcaatttcctggttttgctattgtactgcagtcatacaagatattaacatgagaaaggctgggagaagagtgaataggacatttctatacatatctctgaatttccacagaatctgtaatatttcaaaataaaaagttaaaaatagaagacaaacttaaataaaattaaacttagttcctcagccacactagccatattttaagtgttctataattacatgtggctagtgactccatattggatagtgcagaattatagaatgaacatcattacagaaattctgttaaaattgctataggcactcggatgtctgaaggagctttagaatccacttgaaacctatgcgatgatagcattaaaagaacatgctacccttgctacataagccaaattcaaggtcttctcttttaaagatatggttattattccacagttattcttcagctaccagtaagggcagccacacaatctgttatgtaagcaaaaggaaatgagtaactttggtcccctacctccagaaatggcacaactattttttttctatttcccttctcttctgttcatgatgtggggaaactgggtcatgtcactaactttgtgctcatttaaagaaacctgggccttgaaactttcttagaagggtgttgcatcatgctcagaacacatatgagatattcaggatttcccagatgattcaaataattttctttattttacacatgactttaactgcattttagtagttcaaaattttttttaatgtttatttatttttatactttttagggtacacgtgcacaatgtgccgattagttacatatgtatacatgtgccatgctggtgtgctgcacccattaactcgtcatttagcattaggtatatctcctaatgctatccctccccactccccccaccccaagtagttcaaatttttatgaatatttagacaatagaatttggtagttgacaatttttctcatgttatttttctgggtatttttgcattctgtgtttatattttatagtaatacatttacttatacagaatttaaagataaaagggaataaaatttaaaaataaaattgttcgggaaaggattaacttttcaatgtattgtccagggacaattggttactggttggaaaaataaagagtgtgattcctatctcaccctatacaaaaggcataaactgtaggtggatttaatatctaaatataaaaaggaaactttaaaattttagaataaaatggaaggatattttcaattaccttgggataaggaagagcttcttaaaggaatgtatgaaaagcacaaacagtagtgtaaatgatgaatacatttgactacaataaaattaaaatttatattttaaaaactgtaaaaaaaagaaacctaacatatagaccaagactaggagtaatttgcagtataacaaaagatcagaatccaaaatatctgaagagcttagataagcaatttagaaagagtcaatagaaacatatgcaaaagatttgaaaagacaactcagagaaaatatataaatcattaataatgatcaataaatgatgaagagactcagtctcctctgtcataacagaaatgaaaattatttttttaataaccatcagcttgacaagaaaaagtaaatacattttaacgtctaaacgactgaacatatctacagaaaaataaatatgccactttccgcctccttctgggctcaagcaaacctctcacatcagcctccgagtagctgggactataggatggtcttgagcccctggcaagtgatctaccagcctctgcctcccaaagtgctgggattacaggtgtgaggcacctgtcagtatacgactttaattaaagtaacttgtacaactatcacccagctcaagaaaccttcataaaccttttctaagtcccaatacctttattctcgactagttgtaactattaccttgagctttttcaagatctgatgacggtctacaggggaaaaagccctgaactttgtagcatttgctgatgtccaggaagtaaatattcccattatggcagatttcaagctcccaacatttcaactggcttgcccagttcctaaaaacctaacaaataattctcgtatgtataagcctactccagcactcatgtcaattctgtcatttctttgggttttttcttctttttgtctgtgtgtgtgtaccacctaagtgagcatctttaaatagttttgttttagttgcttctgggaatatcaatattatgtaactgaatgaaattactttccttctgatattctggaagagtttaaatagcattgagattatcttctctttaaaggtttagttaactcctgtaagaaaccacctggatttaatgacttttttctttctttctttctttttttttttttttgatgagttctatctgacaactttgtttcttccatggaaatcagactgttttgatttttcagaatctcctttctggtctgttttgataatttatattctcctagaaacttatttcatctgttttcacatttacttacatatatttgagaaagcagctttgtgatacatttttttgttttctaaggttattgctgtcttatcttttttacttttggatatttttctcctattatttcttgatagtgttctaaatatattttctatatctttttggtttagagctagttttaggatttatccataatttctagtgttttgttttctgacacattaatatctgtttgtaattttattagtttttttccaacctcttctttctgaattcttgagccatctatttagttagtgttttttgtaacttcgtgtgtattaatgtatgtagttaaggctacttgtttttctctgagcacgttactttagctgttaagaatgaatcatatttagaaaaaaagtgtactaaattatgattcaggacacacagacttccatcctgtttctctctgtgcgtagcagtgtcatttgggcatgttactttgtcttcctccctagatttcagcttccccaactggaaaatgagaaaatatttgatctcagaacttctattttggtctctaattttatgaaatataccctcatacccatgttgcgactccagtaatttgaattgagtctacaacatgaattctaaagtctcaaactttttttttcctaacatactagtaagtctatgaactgtagtctccggtgtaatcaaaaagacatgcttcttttcattctttgtctacaatatgggggcctgagcatcaagcagattcaggatctatatagacattcttcattaacttggaacattttgtcagaatcaatcagctggtggaagttattatggaacgttcatgaggaagcattttccaagatcctttgaaattcttgaaatacacaattgttagcaatgcagaatcaaacagaatgcagtcttattgaatgggttaagatgaagttacaacaaatattgtgtcagagtaaacatcagaaaatagattttctaaggtctagaagttacaaagaaatatgcaataatgagaatattattaaacattgacagattctgtatccaagtgttccttaaaaaataaaaaccatttattttgcgctaataaaaatatgttagggaatagcaaacagattgtcacagaatgtttaactcatccatattacataaaattcacaagtgaaattactgtctgcattttaaaatctaagtagcaactgcaaaatcaaactactttgtggaagagttaacgtcactacaacaaaatgaaataccttaagttgtgtgtctgtctttgtatttaaacattaatagaaacccagtatattttacttatactgactaatgtagaaaaatccaagaaggtgagttagtagagaaatggaacaaaatatcattcatttacattagtttactgaaagacattttgtcttctattttataaaatgttattatgtaacaatagcaatcattgccctctctgtataaccctacacggtctgaataaatcccttctgaatagtttttctgtacagctcaccacatttctaactacaggaatgtaatcttacagccttaaaaaacacattgatttttatgcacataaagagaccaggttaattaacgatgctaaaaatgataaacataatttattctttacctctcacaataagggaaagaaaagttattacatgctatattttgtttaaagatttatgatgcagcataatttccatttcccttataataaatatttaaaagacatataatattaaacacttcacctaattgcaaaccttatatgaaaatattagggtgatggtttggaagcacaaaaacatttactgtcactcagtgctttgtacgttctttcataaatcagtatcggaagcccacaggccaacaaaactctgaaattctggccaaacagttcccagttatgtgcaagagataattgcttctcaaagtgccaaactggacttaaaatttaaataatagaatataaatatgctggacatgagtaggaagataaagcatatgcatttattttggctagagtctgcttaaaattttgaattttttacttatgacctgtataagcttggataagttactagatcattttgggctcattttattttctaaatgggagtgatgatacctactttgtagagttgttataaagtcagaatgaggtagtctgtacaacagcttttggtacacggtaagcaactataaaattttcatttctcttgtgatgatcttttataactggccattgtttagaaatatagaacttaatgtaaaagataaaatgtgaacatgcacataaaaatatgggaaaatatttccaaaaacgactactaatatagaaactggagttaagcaggaaaatattcaaaattcgactaatgtggccagtgccaaataaaatacaacactagactcctggacaaaggatatggtaggttggtctctttcccgtcattaagtggatttctaattatgttgtatatgttgtttcagaggcaaaggcccattgaaaaatacatctgatgtcattaatgctgccaagaaaattgccgaagcaggttctcgaatggacaaattagctcgtgctgtggctgatcaggtaatagaagagggaagggtgggcacatgctgagtggagtcactaattagcacttgggttttgtaactagttttatgcaccctataaaatgcctctgaagaatgaatcagaggggagaatcactgatattttacacactggtatctgcctctcctgacactgtgctagtggcaaacgtagatttagctcaggagagaatgctaaggcttctgaccaaaattccttgagaaagaagaacatactacttaggagacatcagcccctgaagagtcacggattgtcccaggcttccccattcagaaaggcaactatactgcataatgaaggggggaaaagcaggtttttaaattttcattgttaggctcttggtttaaatatattttcagagattcctacctaatgccctcttttgtttacttcatggtgcttatcacatttaaaaaatatatatttattattgctttacttttattttctgttgcccccaggaaatttaggttgcacattttaactgcctgacagaatgaataaaggagagaaaagagcaacctgccttgtggtcagggaactgaattagcagagctttagggatgtgatgggtcatgatttgatggtttctttaaaaagttgtcgcggactctaccaggagtagaatggaaactgggggtaggacagtcaggggcatttggagatcaaagggcagaaacaggttgcagaatctgggagaacatcatgtttttaaatgtagaaataagaaactagaacttcaccttttcttatttaatatggctctcactctaatgatattcttcataataacttatgctccaccataaacgggattattccacatgatcaagaaccttcagatttcagctttattctaacccagactcagaagcatcagagataaatgaaattctcagagtatctcttaatgctttcaaaccaaactaggatatacattaaaagagttctcaccttgaatgtttatttccatacttttcgttttatttggcttgaattggaactttaaaatcctgttctaaatgttttgttgcaattatggtccatttcttttaagagtgctttaggtagtagacttttccaggtaactaacagttatccctataagcaatagtgatttacagtttgaaccactttggatggattgtatcataaaatataagttttggaaataaaatattatatatgctactatctacatggaaatattaacatgaatttgcttagtatactgcagtacattgatgcaagctggagatactgaaagagaattgcatccttctccatatatggctctagtctctgatgatctgatgatttttgagtctttgtgttgcttattgtagttttcctccctcattcctatatataagggttgctcctctaaatacttactgcctcagcatcccaggctctaacatccttcattcaagtcaataccaaattcacacacctttaaaggctgaaaaaacaaaacaaacaaaacccctcatgattttactatcaggattgcacttaagagtcaagagtcaacgaattctcattttaattttattttacatttaagatggctaatccaagaaatttttttaacttttgacttttggagaaatgcttattggttgagataactcaagtactatgagaatttgagaactgcttacaatttgtaggtgttgagtgttaacccattgctattgcctaatttcagggcaatatcaaccatgaggcttcacagcataaactgagggttttttttgacagacttccataagtattccagaaagttcatgtagaggagggaagagacaatgaatttacttgaaagtatgcatacaaaaaaattaccaactagaaaaggccacattctttttctgcagatgttgagaagagttgggacgtgtagagtgaccagaaattggccatccaccaatttgttaggaaggacttcttgggagtgaaaatgagcggagtttgaatggctgtttcattacactttaaatctcaatggtcaaaagtatttctcggcatctttaggcccttcaagttcaatagttttggttgtgacttttgtttttgattttacctttttgggcttttattttcaactatgcaacctaaagcataactcaaaacagttgatatgtgaaaaacacatcaaacacacacacacacacacacacacacacacacacacacacacacaccccccaggatacatttattttgagattcagtgacagagtatttaaatgctactatttcacagtgactcaaaataaacggattaagtttaaacctaatcctctttgtggcattattattgtcattagctgtgaaataacttgcaatttttgataaagaaatcttcagaaaaaaatgttatcaaattctgcacctatttccatgatttaggagttattttccttgattcaacatgcctttttaaatgtgtattttaactgctttggtttaaataatagaatagaatgagtattatcaaggactggattggttacatttattttgccggaaaatattttataaagatttgagatatgcatgccatataaactttttacggactgttgcatttttaattactgttccattgagatagaactttcagtttaatttgctgcaaggtatttgtatcaaaagccttgtcagccctctggggagatatcattttaaagttaatccctttccgtgtatgggtccctggagtaggataaatattacagtatgaagtacttgtaagaagctaaaaacagtctctgtggaattctttcttgataaatgcagttagtgaaaaaataccacaatggtaagtgttaaatataaaaaatatccctttatcatttattcagtagatggttatatgtaatcactggctttacagtattgataaaagaatttcctttcttgagcttgagggaaacttagctcagagtctttctcccatcctctcattctaaataagatacttcagttgtggctgtaggtacttatttcttatagtattaaggatctggtgattttatgtcctttacaagtaccaaattgatacagaacaattaaatggcctggaagtagctcaagctgaacctttgatagcaaaagaaatatgtaggcatctcaattcctcggtagccattggcaatgaagcctcagaaatgttttcaggagtcatgtcaatgtctctagaagtgttcagccaagctctgtgtgtgcttgatggacacccgcctacttcggtcataatgaaaatccaaactccttagccagagttgactccggtgcgtccatcaaaggactctgttgctactcttatgaacttctttcagctggcttcagatacattctgtcaaatctgtttttcttacagtagtcatgaaccatttcagtctctcatttaaaggcaggttattatgttgcttacattttgataaatattaaattccaaaaagtgtaatagattttttataagtgaatgatacatttattagagaacaaaggaaacaaattgattttcttcccccaactaactggattgaaactgtccattatgcttggcagagagtgccacacaaagtgatttacttttagcatcctttggtcctctgcattaaaataacatttcacatagtgaaagttgaaggaaactgtaaaatatttaggtttctttagagtttagaagacagcaggtaaaaatactcataaacatgtatagaagtcccaataaaactttctggaatatcttcaattttcttctgataaaattttattaaagtagagccaaccattctaaactacagtctgtggcctttctaaaatgcactgtgaaaaagttaagttaaatgaatgtaattaaggtatatgacactgaaaacttttcttcctgcagcttttctataacaaatgttagaaactgaagagtacttactaatcaagatcactcttttaatgttttatagtgtcctgattcagcatgtaagcaggatttattagcctaccttcaacgaattgccttgtattgccatcagcttaatatctgcagcaaggtgaaggcagaagtgcagaatctgggaggagagctcattgtgtcaggggtaagctggacttgggcttcacaatgtaaagttcccaccgttgcacttccaaggcaaacattcttggcaacagtactgctaaaaacaccaaactacagtgatttatagggagggctttttttaaataaatgttatcaccattattccagaccttacaataactcacaaagagcaatttgattttccaattaccctgtgtttattctagccttgtaaaatctccattcttcacaagaaaactaattttgtagtctggaaactcattgccaagctgtgactattgtaattatttggggcttttgtatatttactcattgtgagtctacttccttttgttagtcctagtaattttcattctctgttcaggagccagcctctctatgtgtggattgtgttcacatgttagagatgatgaaaacaataggaattcattcatcaggttccaatgcatactaggttatcagtaacccttgaaagccagaagatgtttgaatttaatacaggttgatgtgctgttgccaaaaactaacataattgtcgaacactaacaattatatattctttgctcaatcactgcagtgtttcctttctcatgaaaatataattatctggtccatttttatcaaatgcatagaaataagttcaatgaatatttagaagaatcacaatttcttggcaagatttccaaatatgtgttgaggttcttcaccttggcttcttctcctccctcaacccctttctctcaacacagggtgccatttgttgcaaattatttgcaagtccagaaatgtggctctgacaccttagttcttttcccagtcagacatgatgatgctaccatttcaagtgagtaattaccaggcacgtaatattatcagcgtggtgaataccttatgaaaatcagactagtcacaaagctcaggtcttcctgaagccatttttggaaatttagaagtttggccatttggtaaaaacacgtgaacaaatcattcttgaacccaactgtttttgttcccatattgtttgagttgcagaaaacatagctgggaaaagaactgatctggcttgcatagagacaccatctggaaagcctgtttcatgcagtcccacctagagcccagtaaattggctattttgtgcctcttcccaaagcacagtcacctctttgcatttccaaaatgatcctgcttcaacattcttcagcaaccaagagcaatctgtcttgcaatgtgtcctttctgccaagctggtaattaccaagattctctcgccaagaagtgatcaaatcattgcatcttccttgctgcctttcttatcttcagccttgatggtatagtttcccataccactcagctttcatgtccatctgtatatagcccctgtggaactgagtgctttttgttcagcttgccttgtgtgctttcatttgttactttccaatcttattatttacatggatgcgcaaagcatctttgtggatctcagactccacaacctcatctgggcaatttttactagcagagccgctctccatcatcctctcagtacccattgtttgtcactgcctccaaagcttcatttccattgtctttttctcatttagatgtagtccaaaccatcactggcttttatcacttgcactgttggcttttatagaggtgtttgagattgggaacaccatcaagaagcctgttcccttctttgagtcttgttggtaaagttcataaatccttgcatgggagaaggcttcttttagaagaatgttgttcaacttgataattattctgaggcaaatgcattataaatatttgctatatatgctctgtcatgggcctgctcttggcttcctcatgatttattccaagcttgattgctgtttggtgccacacctacatctatagtctgctgtctttgccaattctgcctccatctttttcttcatgctccttcactgatggccaatggagaaaaaaaatgaatatgcttactgtgcaaaatagccacaaatgactgctttcaaagttctgaaagagtcaagaatgtgagaccccatacacacacattttcaatgattttgccaagaaaattacacccatttattctgtcatgtggcatggcaaagttgctgttttttttcagaagaagccatcatagtttaatgtacaatcaaaaaagaaatacttaaatcttctttcttttttccctgtgtttatacacatgggattcaaagccacggcttctctgaaatatatgaaagcccccaggaaagttacatttgttagaagtcaacctctctacccaaacagaagagatttggacatattatttccattttgccaagaaaaatgattttgatgtcaaaacagagagccacgtttttagtcttatgctggcatgatgaacatatgttaagcaaaatgcgcaattatgtcttatgtcagcgtgtttttgttttatgtgattctatgtatacaaactgagaaaggcctcttgtcttgtgtctgcttttggcttgagaggtggggacagataattcaacaggtcacggaggagaatggatacaaaagctctccaggcatcatgacggcgatctggagaaataaagcagtccaggatgtgtttctgtgtatgctcatccacacaactgctatctaagaaataccattggtttcctacctggcaattaggtttttttttttgtcattggcttaaacctgtctcaaccaaaaagtgacattcttattaaatctcaaagtagaaaatgcatttgtgagccaattcagcttaacccggttactaagggagtaatggaaaagaaaaaatatgatagaattgttaaagtgaaagtagaggaaactgagtttcagaagattaaaccgtctataaattggctttatttatttgcttagtttaatgtttgcttgaattcttaagccagtttacaggcttttttgagaaaaagaatattgaaagcagaaagaaagataaggaggggaggggagggtagaagagaagaggcataaaagaagaaggtagaagaaaagaaaaaagaaagagaaagttaaagataacatgtcttgaattagtttagtgcaagtaatgtccattaaatgtgacagcattatcttatgggagaaaagttaagccatatattttttagtatgtaaatactattttgaatacaaatatgttccagtatcataatatgggtattacctgtatatttaattatcatgtttttgactaatttttgtttgctaggtttcacagggtttaatcagcacctttaaagttaaaaatggagatgtatacatggatctggaaaaataaaaatcattccatgacctttaatattttttagctacccaaagatttatacagagcgtatgattctgaacaatattagaaatactaatgtaggacttttaaattagcatactgaatatcaaacattctgataaacctaataaagcctacctaaactgtttttttaaagttaaaagataacaggagcttcattataacaatgaagtcagaacataacagcaataaccctactttgatgaggaattcaatgttcaggatgtaatttatggccaaatgtacacaaaaatggtacaaattttaatagattttattacatataaatgtctctgtattaacaaaatatttgagtcaagtttggaggtgaggaatgctagttgcttaagtccttgggctgaatgaatggattactgacctattcctgagagattgagaagcttgccctaatatgtacttttgttctttgccatttaaatatctcttttccaaatctgaattcctctcaattgggtttaggggagaggtttgacaaggtgagcaagtttaacttgggacactggtaggatttgaattggtaaagagaagattggagactgaggggtcaattatagtaattcttattgcccacgtttcacattattttaaaaaattggactctaattacaatcaacatgaatattcatgatataggtaatatacattcctaaaaatgttggaaactgataatattcaaatcaactctacctgacactgtcatatattcaaagatgcatatgtgcatacaaacatacaaacacagagcacaattgatttgatatttactcttataccctcaataaaccttagtgaagtggtcaggaactgaacaagattgataagtataaactatctgatccaatacaaattagggaaaagaaaatgtgggatatattttgtacaataatatatatatggtttgttgagatgagaattacattgtatttgaagagcgttgtgttccttttatttttaaaaagtgccagtattttgtaatgagctaaaacagccattgaaacaagaattgcatctaattgtgtagacctgtacattaagcaacctttttttcttaatttttatatcttctattttgtctatagtcaattcttcatgatctccatggatcaaagtgtaacagtaatgaaaaaaatctaaagtgctagctatttcaatttgggtttggaatgcatgttagtgtttcatttgaacaaaagggtagatgttctaggaattcatagcagttcaaaataattttatccagaccttccgtgcttaaaggaccttcccttatgtaggaaaagttgcagtgtccaaacctagagagagtaagataaaaacaaacttcagattgtaaatctggatgttaggcatagtggagaaattgtgacaaatgaaatgagtagttaccttttacagagtaaatggcagtagttctttgcatatactttgctagtaaaatgagttgttgcatgattccatattttccccaaaatccattccccaatctgttgatagtgaaactataaccatttaaattctgattcctgcattaagtcttccttagttacattcataccagtatgaatggtcattgatttctgcacaacccaaattatagacaccctcagagggaaataacctttctatggtttttttcactgaacattcattcccccagagtgttaaaagtgacagtttaccaattcaagacttgtttttggaagaaatgggaagttaataggaattttaatgagaaagtaaaaatttctttgggtgctgggcatcatagaaagctttgtgtcttttgcactgcacctgtgtctgttctctgaattcagacagtcttgtacgaaggagtctggtatactgctccactatagaaagtgactcttcagttacattttctgtgatggtcaccctaaacttaccaatataatcagttatggccattaaaaaaaatcagttattcattgatggaattaaagcagttggttatctaactgaattgtttaatgcatagggaaatactatgttccaatatactcattttaaaataagaaaacatactgtgttgtggcaaagctaggatgcaaatcaagcaaataactcttcttaccttaactggagacatggattgaccttaattcgatctactactctgtggatggatttgattgtgtcacctaaacttgtgggctgacgagtaatttctattttagtttgagggcattactgcttgtaacagcaggagttagtagctttaagaagagtgtcccctgagatatcagtgccattacttgtcattcaatcagtaaaatttcattcctttgggtcttagaattttttcaagttttgagatgctctaattaaaagaagaaaggtaaataattgacaacttaatttattatcaattaatgccttagatttcagttgatattctgagaatgatttagtagccaattagcagtaatactttttgaaaacttggaaattggacacatgggaggtacctggatgaggggaggtgattgcatatacagttggccttctgtatctgtgagttctatatctgagaatgcaaccaacctgggattgaaaatatttggaaaaaaataaaagtaacaatacagcaataaaaatagtacagataaaacacaatgtagtacttatataatatttatgtaacatttgcatcataataggtataagtgatctggagaggatttaaagtatacaggaggatgtgtgtaggtttcatgtaaatactatgccattttatatcagagacttgagcatccttgaattctggtatctgctagggtcctagaaccaatcccccatggataccaagggatgactgtatcttgggatatgtgtaaaacccagacaaacctatttaagaagtattattttataaagcttccccataagacatatcctaattttgactacttgttcatatatgagaatagtctgatttcattccaagattttttttaaataatttaaaaatacttcaaataatgtttcaaattattattgctttgagaagtgtcttaaaagctaccctctccccagttttgaaccagttttggatctgtaagagcaaatccaaatacgttcaatgtaatgtttccttacattgaaccaaataattatgggaagccaaagtgttgagtgaagacctttatttagaaatggtgtctgtaaattcagcccctgtaaacacttgaatttttcagttctcagctctagtcaagaaacagattatttagaattggttacttaaatgcattgtgattttttttttcttgtttctactggggcttaccccaggaattcctggactgaagtctgttgaagaaaaaagttgatatgtgaacaaggtgatataatgtgaataggcaaaagagaagggatattgaaatcatatgctaaagattatctggggattttgtcattgattttacacatctttccattaccttagctggttaaaaataagatagaatccatagcaaaactgagtcaggatttttttattcagtactggatttgataacattttgacaataatatttttcttaaaatacatcagtttccataagtcgtttctaatttccaatggcaaacaatcagagattcaaagagctgcatttatttgttgttcacataagaatattttctgattcattcactgaattcaacatttccattgcatccctactatgtaaaaggcacggtgatatattttgactgagttgggaatttaaagtctctttatctctaataccaaataattttcatgaaaaggataaatttttctgtcccttgtgtttttattagactgtgtagtctatgtttattttttttccatttagtttctcagcttactgaaatagggttttcagctagaatagcagagtatctgttgatggctatttctgtgcattcgttgttttcttggtttactatatgctagaaataaaagtgtgtttaacttactgttgtctacattctgtccctgcagattattttgtcaagtgctttttccagcctaagttaaatcatttataaaatatgactttgagtgcagcccttagaaaagaaatatgtgccactttatggcccatgtatcttacaaataagaaagtttccggatgggcaatgtggagtttctttgttcagatttcttttactgcatcggaacacattgtcttactctatcttaaatagtaattttccttctgggctataaatatatctcaaatacttcatcctaattctattttcttgaaggcaagctttcttaattcagacttttaatcttttcttttatcatcaatactgtatcttgttttattagttttctctgaacaccttcatctgtgcagatgccttgctgataatgaaattgactggaactctggctagatgtcctgtcaaatcggaacaacctgtctcttgacctctttcatccattttctttggcaaatctcttttgcaactgagaatatcctggagaagttatggtcaacatcgtcttttaagaaccatgtacgtttgtcagcccaaatttctgtatgtgagacgctaccataaaacaaaatcaaaacatctctttatccgagaacttccaatttgaatctgctgctatccacatttattggagcccctcttattgagatatttctcttcaattataacattttgatcaacttacatgaaaaaaatgcctgaccttgtcttccatgatgaatgcatctgcagattgttcttttggaatgcacatgttattccacctgacttttctcaatcttttgtgctaagaagctaaacaactttttattaacctcaaagatttgagaccagccctacatctgtctggtcagaatgaaattactaccgtgactataataatggagtcttgactactgaaatcttgcaaacacttcatatcttgtcttaaagggctacttacccatttctgaaatatcatgggaagtatacagctaatctacagttggagtagagcttagttttcatgaaaaatgtcaagaggctagatcctgagatttggaaattatctgatcctggcattgcatcctgtatcaaaggcagttttattattttaactaatatcatatataaaggcattattataatatcacaatcaatcatactaaattcacctaagaggtcagcacagttcaccactctgcatccttttgatgcagcctagttttgcattgggttcctgaagtcattttccatttccaaagagacaataggcaattataagaaatgccaatagacaatctaagttcagtttgttttatttcaatattttaaaagtgtttaactccatttttattttaatatcttaatgctgggagaattgtaccatctgtattgggtagtaaaaacttaaggtgtttattggaagaatggacaattgcatcattaatcttaatgaactttaaattttttatgagatgatccaagtaagtttctaatacgtaataatttttaaaactgagaaattgtgctaagtgactaatttatttcctacaatgggaaaaatcagaaaatccctaacttataaaaccaaatgagattgttataaaaaatcaaagataagccaactagtcaatgatccaatatgtaaaagtggagagaaaataaaacttcatagggccattaattgcaaaatctcacacacaaaaaaagctgttgaatatataatttgaatttagacttagaattgttgaaaataaaaataataaatgatacagcaaggaaaatatatgcagagtatcattgcctcttctgttaagtacagaaaaagtcaaatataggcaaaacacccatctttttatatgcaagacttttttttcttttctatttactttaattctttaaagacattctttaaatgtctctaacatttattttgaagtgaaaaatggacatgatgttgccaaatccataatcagtttgaatttagtagcttctgtgtttcaaactgctctctcatctgccaattttgcttaattttaaattgcaattattgtaatacacttatgtatttagtacgctaagaatgatgggcttagaaatagaattatattggcttaaaacagaaaaatcccaaattaagatttttgtttatctgtatatagaaacaggctttggtttttagccatttatgatgccataatttgcaagctattgttttgaatgtctaggtttcctaaatttttttctgtggaaagagatggtttcacttttcatgtattccactagtcagatgaaggccttttatgtggatggtttcaggatgtgcctgctcttcaatagtgtctgttacttttgttttgccataatcaataactttgagtattctattttaaactcctaaattttcattgaaaaaaaatactttagtggtctacatactattctcatgccttttcttgtttttctatgaaaactagacttggtaaataaagctatgactagagcagaaatcgtccatgacaaaaacattttggtcagttggcatcactgggtcatgtaacttgacctctgagagtgacagtgcatttttttatgattgcagaaaacttgccatttgattttttctacagttctgaagatgaactctaactactccttttagttgtatatttgatacacgcagaaaaagtcaagattgtaacattttatattgaaagaatcttatgaaaagactctaaaggtagaaaagggcattggttattggcttatcctttaaattatgcccctcacacaatccacccttgggttaaaaggaacagtcaaaagagttgcaattgtagcaacaatgaatgcattagtccttcagtgatcccaatgaaagaggtaagtatccccttagtagaggaccatgtacagaggttggatgtgcagaggccaaaggcttaaggaaggtcacacagcagggcgatggaacttccaagaaagacatcagggatccccacataccgttccaggctttaagagctgcagcccttgccttctctcttggtgatcttcaacactttaaataggggattcaccccctttgagccccactatagttgtcccattcagtgcctgacaaggcagggtgcatcttcattctcctcccacatggttcctttatctgttcaagagccaatgagaaatcgaaatggccaggccgcttaatgtcaagaaagcccatatgtatatctctttcagcacgtaattccttcatatacctcttttttcccaattacccattccctcttccactccctaatcccttcccaagtagggtactttttttttttttcttttgctctctctctcattctctcttttctgtatctctcggaaatcagacaggagttcagagcactttcactaccttttatgaggtagattgtgatgtcatagatgggggcagggctagtcaactttctacccacctcccaacctgtgctgagggagctccgatcgggagtggaagcagtgattcctccatggtgagtaaattgactttctaatctaatgtctttcattgtaatcatgaattctgaaggcaggggggattggattttagggaaataaaaatgtgcccactgaaggcctcttaatattaaccaactttgggcaaaggacttatttattctttatgtgggtcagaaattccacagcacagatatatcttcaattgtggtctaaacttgagaagtgaaaaaggtatttttatttctttatttctcagtctttcttcccattgggactgaaagtcatggcatatgtggaatgaatccattctatagtctctttgtgagcttcactaaggaagggtagtcagaaggatgtattcttctttgtttggaagatttcagggtcatgaaatatcctttactcatgtttgccatgagaatcagtgggcccttctaaaactgtggaggttaaaatgtgcatgaggatgatacatgaggattatcaacaaatactttgggtgttaacaaataaaagctttctaatgcagtgactaaaatgttcattttttgaaaaaagttacaactcctgcaagtttaaggtcacagccatttcaaggtgtcacagccagatttactacccatttttgttgttgcacgtcctaaccctgatgctgtttcatagggtctcttgctagttaagaggcatgaaaagctgctattgtttcatttgggtttctatatattgctgattagttcttttatatgccttagtatttagaaagaaaagatcaactggagcgggcacttttctccacttctttcctcgttctctcctgggtacctattaaaactatcaagatgcaagcttttgtataaaagggtaaagggagttcatggaggtggttgactttttaagggatatcaaagcactagggtgggtgttcttagaagggtttgaccaccagaatgtgaaaccctgtttttttcttagggtgggatgaaagcatcctggtgtggattatgagtattataaaatatataaagagggtatcatcccttttttttttcctaaatatacatccctggttggctagccatgatgaacatttgtgttggagaattggtttcggtttaaaaatgaagagtcctttctgtctcatcaacggcttctttgttatgcataaatccctgacccccaaagttatacacttttatatttaaaagcactacagctgatactgccctctttagtaccctggggctggggaatgggttttgaagttatttgatacctaagttttctaacctaaataagtgactataacagtaaagatttcaggcctgataaagaaaggtagggccataactggccaataggaagattttgatgacagtcccctgcaggcaacttaatattgcaatgtgggcaataatgccagagtcttatatgttggtttatccctcttaagtctctgacctaccttccattaaaagtactagacccctgaaacccaggtagaagcaaaccttcagtgacagaaaaatctgatgtctaatcatagctcaagtttttaatgtcttttatcaacccctcatacagctgccaggtaagaaatgctcatattttcaaacccttgggacacaatcatctttaaacttcgtgagttaagaacggttgtgttgtgcgcttgtgcaaattcagagagtctatcatggaatgcattgtgcatgcacttatttatcttcatgtgcatgtttcatttatagtgatgttcagtgttttttaaattcatttcgtatgtattaaaagtttaattttaaaatacatacatatattgtgctctaaaggagacagtgaaatggagtggaggttgcattaatttggggtctgaacacttgctatgctagttctatctctgcgcttgacttgttaggtaactcaaagcaaattacttagatctctcgggcctcagtttttctcatctgtaaaatgatggtagatgatcaaaaagagatattctaatgcatccctgctctaaaaatctatggttttatggtatattattgaagaaatggtttatgagaaaatgactgaatagttgatgaaatacagtttttattttgtacatacaattattaaatccagaaaaaacattcagtttaaacaaggttttaaaatgtgctgcctacctgatatactgctatttggttaataatagatgtggctgagccatttcttttaaatagacaacgtcatttgattaatctgctaaatctaaaccacttagaaagttatatataaattgatacctgaagagaggcagaatccatgataggtagctacataatgattttggaagaccgattcatgttttaactccatacctttgtgttattctaattattggggatgtaaaaaacatttactaggtaatagatgtagctgatcttactggggcttcaaagtttaaaattacctatgtaatattgcaggaaatcccaggtggttttggaagggttgataagtagggaattggtgagtatggaactatgtactatgggggataaaaaagtgtaaagccttgctcctgaatttgaggaatgtgcaacctctttgaggagtctgtacatgtgccaagtgccgacttggaagtgaatacagtaagtgccaaaataaatatccctgtggcctgggtgggctggattgcactggggagtcttataaaaagctgatacttttagctagctgagaacagaacggtttagatgtttgtgttattgtatataaaaaggacagggaagcgttccaggtcttcaagaccacagaattgtaaatggagctgaagatatatcttgtgttcagacatgacatgtgtcaaaatcaaaatgtattgcttacagttcaacctcatactttttctgaacccctttcccctaaatcatatgctgactgtactagaggagatacatgtctttggaagaatttaggaggcagcaagtgagtgaattgagtaattataaagatataatcaggcaggcatttggtcagttacacaaaactccacatgatcactcacagccacaactatgcaagagaaatacataacaggcagaggaaggaaagaggaagactctagcttggagatattctggtattgtgataaaagtggaaagagatcatcatttgggggtatcattaacagatttagaaacgtcagatggtgatggaaatgtccatcagctaatgagaatccgtgtaaccaagatgactttataaagcaaacaatttccttgggcactaagcaagaataacatcagtttctccatcctttaacagccaatattgacaaggttttaacactaagtaaaactgaacatgattatgcaagtctccttcccatatactcttgggaataggttattgatttgggtatgatttattcacactgacgaagaacacttaatttgaaagcctctctgttgctgtagacttgcagaagatttgcggtggatattttgcctcacgtagggaaaactgtttttgtatttcttgccattcgagtctcttccaagttattaccttggccattctaaaagactggaattccacgattagaactgctttgttacctagcccctttaccagattataagaacttagtaagtaaacaaggactcagtttagatcacccagtgacatggcttctaatttcctattgtgacatcagaattagcttctagaatttgttttctcaggaaatcactttcaaaggctaaatttttctgtttggggatggtgaagtagtatgatcaaaggtagtttaacaaagcaagactactagcgctagtttctaaaaaaaaaaaaaaaaaaagttcaagcagaagttagattatgtttgtttcaagagaaaaatgatgaggatgacaactgttctcctttcttcctcctaagtgtctctggaggtcattttagaaataaagcatcagtcagagctataattcaacaaattcattgagtatgtaatatgggatattccctgttctacgtatgatgcattcatagaattagcatggaaaacaagcacgtgaactagtaactatgatgatagtaatcattttaaaagacatattgtgaccatttttgtagaaaaggataaaggggtgtaattttttttgagccttcacacataactgaataggagttttccaggtggaaggagagggaggaatatctcagaaaagaaacgaaacatccataacattgaggtatataagtattccaggataactgaagctgaaaatgtcagagagggctggaaagatggagaaaagtaaaagatgtgaggttggtgttggacatcaaagaaattcttctgaccatgctgagtttaatgagtagcattgaaaatgatcaggattatctgcatgccagctaagcaaggggtttgggggagactactaaaatgcacgatcctgggccatgttgcaaaaacttcttgaatcaggaatggtagggagtaggttcttggagtctgtaattaactaccccatcccactccccagcacacaacaggtgattcattttcacaccaaagttttagaatccctgcaaggcaacagaactgactcattctgtttctatgttgttagaagcagtttcagagtaaaaaattaaagtatcatgttattaaaagattttgggaaaaatagtttagggtagtataagcatattctcaagaaaattggtttaaattgtggttaagcatgagaactaagaaagatggttattaaatataaataatcagtgatgctattgaatctccttgaaagtgagacaagaaactgtaaacattcaagagaccatccttcatttttctttgtcatgctccaatacaaggagttaatgaagattgaagctaagttgttctacatcttccaagttgtgccaagataagagataggggcaataatccagagtaacatttgtttggggatggtattcttttgtagggccatttgacttctttaattaagtgaacttccttggaaaaaaaacgtgtatgtcagcattctcatcatgactggaagaaccgaactttcatgcccatgcagtatatgacctatatggtctatgttgaaaatgttaattatgtatgtttaaatcaatagtcacttacaagtgctaaattctttgttgtttgtttttctttttttcgtgaacaacagctgttaccttacacccatcaatctgtgtagaaagttagagaagtggtaaaagacctaaggagagggagatactagaaaggaattttacattttactgagacatgaaaatgagccctggttgagaagaaagtgagtcttagttcacagcaacaaggattgattctaatttagccccctaattgctttgcatacaacgtatcatttccagattgccagaatcttctgtatttattttttttatttgagaatagctttgtttggaagtcgaggattgatggggaaccctatttttaattgttttctgccgttaatttcagtgtcttctcttgggtatagatactgtcactttctagaatcagttgactggtaggaggcagtgcctgccattaagtgaacaaactaaggttgacgacctaaggatatatgtatctatatctaggtatctagatatagatatatgtagttaattttagttcttacagatatctcttgccaatgatctgtggctctgtcattgcccttgttacaccaactaaagcaaatacaaccttgggtggttctaaaaagatgttccaggcaaaattatttacctcaaggcctattcttttacctaaataaatgccaagcagagaacagcaacagctatgtggttttgattgttacagatctgaagaatataagttaaataatgttaaaattataagagtgatattgctattaggtgtgaatttagaaaccaactctcttgtacaattgatgaaactgggcaacattcttaacctccctgggcttttgctttttattagaatagcaatagctactcagagggataattgcccatggtaaatatcaaaatatcaacagttacattaacataaactgaaggattagtatgtgccaggcattgtatgaagcatttaaaatgcactatgaaatatgttttttcaattgtgctctggaggaaatactatcatccccattgaaaatattagaataatgaggttcagaggagttcagaaacttcctggaggtcacaaagtcagtgtttggtacacactagtgcttcaggaagacttctttgatattctccaacagcatggtgtactctttctgtcattttttgtatgacacttaaatgtcattatatttctctcaactagtctgtaagctagttataacagggaatatgtttgaatgctcatttttttccctggttccctgcataatgaacacataatctatgcttaacacattagcttctttatcatcctttcttccattgtagtgagttatcacacccaaaaagtcccaataattgattttgaagtctatcagtcattcatactttcattcatttatttctatgtgaaagcatctgacttcaaatgctagatttcgaaatgcactgtttaactaggatttggggccaaaaatcaagtaattaaatgcaattatttttctagttaacttaatttctttataatttactctgttaaattttcagatatattaaaccctttttaagaaaagattatgccatagaaacctacagaattttttcccaaaaagctgaatgaatcaaattagtaatttattgtaaaaagaaatttgaaagtaacatggttgatttcatttgcccccttatgcaaaggttatgacacacaaattgttatataattatatataaatatgaaatattttaacttaagtctactaaatatttaatgcccactattgtattaaaaatttgtatatagtttcaactacaaatgatgaaacatacaactagagttatttctctctcacatggaatacatctgtctgtagttcagggagagtagagtgaacacagagtcatcaaggactttgacacctcctaactttatggcccatctattctcaagttcatcttttggtctaagatgactgctagtgttccacctttccaattttcatgtaggaagaagaggtgagagggttaaaccaggtgcttcctagctatgttagtaccctctaaggaggcttcctggaaacttccacccctctgcccttcttcagtttccactttcatcaccatacatatggtttgctgcaagagagactggtaaacacaatgttttagctcagcacattgctgctctgattaagattgagatgccactaaataaagagaagggcaaatgaatattagatgagcaaccaagacaggatgctaagaataagaattaaattacccttataagattcaattcgaagtaagcaagaatttggggaatggaaatcaaaatctattcttttttttaattattagactttaagttctggggtacatgtgcagaacgtacaggtttgttacataggtatacatatgccatggtggtttgctgcacccatcaacctgtcatctactttagatatttctcctaatgctatccctccccgagccccctaccccctgacaggccccagtgtgtgatgttcccttccctgtgtccatgtgttctcattgttcaactcccacttatggtgagaatgtgcggtgtttggttttctgttcttgtgttagtttgctgagaatgatggtttccaacttcaaccatgtccctgtaaaggacatgaactcattctttgtttatggctgcatagtattccatggtgtatatgtgccacattttcttaacccattctatcattgatgggcatttgggttggttccaagtctttgctattgtgaacagtgctgcaataaacatacgtgtgtgtgtgtgtctttatagtaaaatgatttataatcctttgggcatttacccagtaatgggatggctaggtcaaatggtatttctagttctagatccttgaagaatcgccacactgtcttccacaatggttgaattagtttatagttccaccaacattgtaaaagcgttcctatttctccacatcctctccagcatctgttgtttcctgactttttaatgatcgccattctaactggtgtgagatggtatctcattgtggctttgatttgcatttctctaatgatcagtgatgatgagcattatttcatatgtttgttggctgcataaatgtcttcttttgagaagtgtctgttcatatcctttgcccactttttgatggtttttttcttcttgtaaatttaagttctttgtaggttctgaatattagccctttgtcagatggatagattgcaaaaattttctcccattttgtaggttgcatgttcactctgatgatagtttcctttgctgtgcagaagttcattagtttaattagatcccatttatctattttggcttttgttgcctttgctttttgtgttttagtcataaagtctttgtccatgcctgtgtcctgaatggtattgcctaggttttcctctagggtttttatgatttttaagtcctacatttaagtctttagtccatcgtctcagccccaaatctccttaagctgataagcaacttcagcaaagtctcagggtacaaaatcaatgtgcaaaaattgcaagcattcctatttaccaataagagacaaacagagagccaagtcatgagtgaactcccattcacaattgctacaaagagaataaaatacctagcaatacaacttgcaagggatataaaggacctcttcaaggagaactacaaaccactgctcaaggaaacaagagaggacacaaacaaatggaaaagcattccatgctcatggataggaaggatcaatattgtgaaaatggccatcatgcccaaggtagtttgtagattcaatgctatccccatcaagctaccattgactttcttcacagaattggaaaaaaaaacactttaaatttcatgtggaaccaaaaaagagcccacatagccaagacaatcctaagcaaaaagaacaaagctggaggcatcacgttacctgacttcaaactactacaaggctacagtaacaaaaacagcatggtactggtaccaaaccagagatatcaaccaatggaacagaacagaggcctcagaaataacaccacacatctacaaccagttttcccaacactatttattaataaatagtgttgggaaaactggctaaccatatgcagaaagctgaagttggatcccttccttacaccttacacaaaacctattcttacaccttatacaaaacctattctttgtagttttttgaaactcaatactcatatttagttgttccgcaaacagtttaaaaggcttttttttctacagtttttagggaattaagataggtaactcctgcctacagcataccagcttttctgggaggtagagggctttgtttcccagtagccttcccttgctgagttatactggcagatagaagctgccaatgaaggctttgagtggcacgatgatccccatcatatgaggaatctgaaaagcactgggaagagttaggcttggggtgcagttcttgcaagtgtatgccctccattgagtggaacaagaactgaatgctgactttcagtagctggctatatgacctgagcaagttgcctcacctctctgagccccattttctcagctgtaaagtgaaaatgatattagtatctacttcattgagttattgttaggattaatggtattgatgtgcaccatacattgagcacagggtccagaatgtaggtgtactaaataaatgagtaggtattttttgttatcttctctccccacaaaagactatatagtcttttggataatattggtgccctccggttcttatatcatgtctaccccaaggaaggtgctggacataacagcagtgagcaaccaacgaatcaaggtctctgctgtcatcaagattgcattcttttgtcactgggagtccttgaggaatcaccgacagagaggggatagttgaaaatacagaaaggaataacctcaatagaagtgaaacagtgattgtcacatttcactctgtaaaacgaatctcatgggtagccaaccaaaatggagattcctgaaatccacagttctgaaactcagctctgagaagggatcaggaatctgcattttattcctaaatctttcggatacagatgattcatggatcacacttttaaaaaaacactggtctaggaagtggaggaaagagaaacctataggctatagtgagaatttctccagacagtttaatccctttcctagtcccttttctaggaaaactgggtttgcttcttcaggctggttcagtctagcctcgtttggataattctttactatagggagcttgttgtagttatccactgtaggatgtttaagaacatctttggcttctcccaactagatgcctgtagcaacttttcttctccagtagtgataatcacaaacatctccaaactttgctgaacgtatcctggagtgggtggcaaaattacccctagatgagaaccataggactggttgaaatcttgacctttcacctaggataaacatactgctttaaatggagcctttcaagtcttccctctggaagggtggaagatggcagataagatagttccagatttagctgccaacctcgtttccagccaggtgtcagtgggtggaggtacacttctctaaaagtcaggcccctgagagcccaccacagtaatcctctagacataacctttctacaaagtacagaggtctagatctacctctttgcctggttatccccaaatcttcctgtcttagagcttatgtatttctattcccaacggtaattaagggtttcagtgaaaatattgtctgaaataaaagtttaaacaaggtaaaatggctttcacttcttactttttacaaacaagagtattgaagttaaaacaattgttttcctaccgcttttttagaaaaccttttcatatgtcattacatatttacctagtctctctgtctctctgtacattttaaaatttttgctcatgcctgtaatcccagcactttgggaggccgaggcgggtggatcacaaactcaagagatcaagaccatactggccaacatggtaaaaccccgtctctactaaaaataaaaaaattagctgggcatggtggggcatgcctgtaatcccagctacttgggagactgaggcaggagaatcgcttgaacccaagaggtggaggttgcagtgagccgagattgcgccgctacactccagcctggcaacggagcaagactccgtctcaaaaataaataaataaaaataaatagttaaaataaaatttttacatggtgagagaatgagtaactacattttaaaaaataagaaaaaactaaagtgatagttaaaataatcattttaataatgttaagaacataaggctaaggatccccttgagattcaaattgcttctgtgtttgttaatatatattatgatgatgagtaactctgccatgttgaaattagtgctgggtgagcccttcaaaccaagcaagttgtaggtagaagctgaagaagttgcatggcttagcattcgttttttaaaagaaaattggagaactgtaacaggcagtgacttcagatgtaacagaaatcatgctttctttcaaagatataccttcggtataattgaagaatttttcctggcattttttaatgtatcagataaaggaataatgatgcaacctttacatcttgtaataaatatggaggtgatttaactttgtcaaaggctagattcacagggactctaagatagcaattgtgccatgaggaaactttcatcttaatattaagcatgatttttagtaggtacaagatactgtatcataccatctccagccctttaatgtttatctttgttccttggttaaaagttgtcatcttattggaagttaaaggtagtacttttttttcaaagaagttttccaattgcatgaacttgaggctttctttcaaagaaaccactaatttttttttttttttttttagcaacactattatgcatttccagtccgctgaggattcgattcctttaatctgttgttttgaaagtttcttgtataactcagcctcgttgcaagggaacagacaatatgttgtccatccatggaggctctttgttggaccaaagagatgatatttccagttttagattgaagggaaccctttggcgcttttgctgaattttccctgaagtacattcactccaggagaaacagactagaaggttccaattaggccaagccctggcaggcacctatatggagaagtatcctggcttattaggagaaccaccttaaatgccctttatttcatcttttatttaaaggcagttggaactgtggtatattgataaatgcactatacctgaggatacaggtcatgcgcttgaatccctggtaattgtctattagctagcaagttcttcctccctaagcctcagtttcctatctgtagaatgatgcgcctaaagtgatgtagtactttttgttgttgttgttgttgagaattaagtgatagtagcatataggagagatctaattggttgggagggtcaatatgttttgaatctggaaaaaaaataaagtatattaaccaatagagaagtactaatcaacttttattgattattaaattgatgcataagaccacctgactgataaataattgatgttcaggggcagcctgcaccaaggaaacataagagaatccttcacagaacagaccatccataatctccatttgtacagcgaatcccagcatgatttatgtggttctagccttagtggagaacataccagcataccagtaaaggtgggcaagaagctacttattcataaagactcagaaatctagctatggcaacatgaccccccccaccccaacacacacacacacacacagtcttggaggacaatgcagtaaataagtaactaaagatttgattccagaataaatggcaaccagatttaaggtggaatcaccaaggacaggctcatcaatgagctgacagctcctattgtaagaatggtctaccttcagtttttggttgaatttctttgtctttttgtgctgcactccaaagccaaatttgagggccccaagcatgtttcctgtgttctatagtttggaaactgtatttcctgaccattctctgtaactggaaaaaaataagatcgtaactaggctaccccacgagtacttcaggtagaagaagaaaacttcttttagaagtacttttctcttgttttgctagggcttatcatgccctcatgctatgctggtcatctgttggaataccctctcctgtggagccaagaccctgggactgaggcaccgaggagttctaataaattaaaatgaagatcccaaaagaacttcccaaaggtacccagaggtgatgtaataatcttttatagtcacagacttctctaaaatttaacaagtattttattttctcacttggacctcagaataactcacaaaagtatattgttattaacccccttttacagttgaaaaaataaatagaaactcaaagagattacagagtgtccaaactttcacagccagtaagtgggacagccaagacttagagccagtttctctaatgtattatcttgtgctttgtgcagtgtaaggatggtgctggtatctctgtgctctgtagactagtggttgaacaagaaatacagggaatagcatgtttcagatggtatagatgataacaggtaatatgtattaggttcttataaattatattatcagcctcacatcatttcgtggtgtgtgctgcatgacacattaaaagattatgttttaaaagtttttaaattttttgataaataagtggtatataacgtttagggataaggagaattagaagttgtatttaattgtatttaatcaagttttctgtgaacatgtagacagcttttttggctgctggcaagaaaatgaaaaagtggaagatgatgttccctgcaatttgactaattcatatctcaggtgaatcctgatggcaagattgggagtttgtacaacttttctccccttatggcttaaggaagttcacctcatgactgcttcgtcacatgactcacgcttgtgaacagttaaaacacatcataaggcatgtttccctccacataaatggcatcaatagccaggaataaagacttagggcaggaaaagcctatggtagatctgcctggtcaaagaagactgcatgttctacccagaaatgaattttatgagccttcaagtagaccaaaaaaagttaacttttctctatttcggttttctcatatataaagcagcaatgatggtattcaacttgtacatgttatgaagattaatttattaaggcaccagcactatacctagcaaacataattctgtgcctcttagatgctggtgctattaatggaggagatggtttttaaattgtggctgtcttttgagcaaagactgatcttgaaatgcttacatgcaaggtacagtaagaggaagaagacatagatacgtattgcaatttggctgaagtttactttctcttttatttctccaaattttactctcctgacaatctcatgtatttgcaagaatgaataggtagtaagaatggatactgaactaggcattgtgccctagctttgtgtctttggacaagcctttcacgtcctatttccccacccataaaattacaatgcttcaacatctcggcaaatatttatggaggactcatatgctaggcactgttttagatgtttgggatataatgggaggtggtgaacaagaaacataaaaatatgagtatataagaatattaaaatagagaaagaatggcaaattaaggcatgaggatggaaatggagctgcaatttgaaaagtatggcttgggtagttttcaccaagatgctgatatttggataaagttcagatggatgtgagggagcaagccttacaggtatctcaggtggggaagagttttctaggcagaagaaatagtaagcgctaaggccttacattgcaaacatgactggtctttctgagcagtaaacaagaaaccagtatttaggaattgagttaatgagagcaaaatcagaagtattgggccccatgtgaagaccattttgatagatttggatttaactcagtctgtgattgggaagccactcaaggttgttgataagataagtgatattgagttcatgtaacaggatcgttctcgcttccatttgagaataaacggggtaaagggtgggaagcaaggaaactagttaggggaagcttttgtaacaagccagtaagaggttctgagaagttggccaagtggataagagtgaagaagatgaaaagagatcaagtaatagatatgttttgaaaatattgctgacaggacatgatggcagattagatgttgagttggagaaaacaggtatagcataagattctgggtgtttaaccaaagcattgggaagaactgtgttgccaataactgagatgaagaggcatgcacgagggtcaggttaggggcaagggtggagttaatcatagagctctcactgtctctggaaggttgggaacagtctacaagaaaaggcttacggatgcttagatcattctcttcatgtcaagaggtggtctttgtgaagataactcttgcaagaacctgaagtataatttagatggaagatagataatagaatggttacaactcattgttaaaagtaataggaaacccctacctgcatctgtgatcgtgtacacagtaatcatttgaaaattatttgaatgtgtgttaatgttagtggtggatttacagctcacaatggaaaaagcagtgaccaggaaaaaagaaaatgatttggagggcattattctgtgtcaactcaaaaaatattttaaagaagacagaaaaagttcaattattaaaaacccatggatcgactgctcaaatttaaaactaatttagttaaaattactgatttttaaactattatactaaagacctcttatgagcccttaaatgatgatagcatttcctcttaattctaatttctgtaatgaaaaaagagttgaaattttaggttaatgtagtgaattattttatatagctacatatgtgtctaacattttacttcaattttctgtgctatagttaagagctcattcgttatgaattatgtgaggagaaattatattagaggtagaagtgatattaatatactcttaattggagcaatgattgcacaggtgacatgagtcaaatcatagccctctcctgtgcagttctgttagttagaaggcccacactggatatggtaaatggttttatgatgattgctaactctcatcaattgctagtgtttgactgagctatgtgttgagaagaatgctgagaccatggctaggatcagtaggaaaaaaggacctgattgattgggcatatctgttaaggataccaatgaagaaatggcagtaaatgtgtcacacactaatcatccttgttttattggttctagaaagggcttagagtattgacaagtatgggttgtcttaaggatgcccattgctttttttttttttttttttgatatatatcttcttgccttttcctggcttttacacccattagcccaggcactgtccttttcaataaccttggatttgttctttggaaggtcttttcatataacctgccatttgctactttatttggttagtaaatgtgtgcagagcaggaccaaaggcagcaagattgttgtacttatgttctggaaagctagttggatgagattttcaagtaatcctaaagaatatgtagattcgaaactgggaatttattggtagacttagatgctgagataaggtcagtcttagttagagatggcaggtgctggcttcagtggtttaagaccgaataaaagattaaaaattatgcatttataacccactttgtagcaaaatacagttaaagatttaggaaacagtgctagggaacccaagtgtttgtgttttgaaggagataaacacagagctttgggagatttggccttcagtgtttggtaggcacttccaaacaagaagggggctcccttttaggggtagtgagggatctcagctggggtctaacagtgtatacctgagaatcgaatgaggtaaggtggtgtcatcctttaccaggtaacaccatttggtttttaatatgagatatttataaatgatattcttaaccaaaatgaatagctggaatttggggaatttaaggtccttgaagtggtcgtataaaatattttatatagactatttattttgatgcttcccaaattacatgtttaaacatcagcttcccaggctagattgcctttcctacaccttctagtagagccaccttgactctctattatcaatattccttaccaagtcctaaatgttcttagatattttaggtgtcacatttttacataaaattcctatgttttcttgcactcagtcttgactacccctttattccatctaaaggattcagtagtgctagaaaagatacataagtgttggtattttcctattcccctcatgaacttctccattccttatccctaaaactgtaatattcaggcactgagaccaagccaagatggtggtagcttcagtaagaagagagtttaaaaaaatctaaaatgctgaatgggggaaactttgaaaggaaaagaaggatgaagatgtaggaaaagagaaacataaattttttaagaccatgtttggactcacctggtgatttaaggaaagatgggtcataataataataaaagctgagatgtattaagggcttaccatgtgccaggcactcaacttcagtggcattatctcatttaatgctttataatactagaaagtgctattttcatttttaattttaaagaacttttatgaggtagaggtaagtttagtggttgttcaagatcgtgtagttagtgatccatccagtcaaggtttgaactcaggctttaagtctagagtccaggtttccctcagtaggagagatgaaaacatgcatgtaagaatgaattaccagtgacagagagtgcacaggagaggaagaaagaggtggggaagaggtgatcacaggaacaaaaggggctggggtcccaaggagaggcagcaaacattcactgggaacggaatctctctgctctctcctcatcctggacctcggtagcaacagagcctttgactagttatttccatacacctgatgaggagaggatcacaggctgcatgggtgtttacttcccccaacatatgaataatgccacattagaacatagctcctagggcttagatgagaagagaagtgaaagaatgaggaaggatcgttccagatcttcagattttgctaattttccaggcatagtactccaccaacctgcacccaaaccgcagcctttgactcttctagtctacttttctctcagtgattatgcattgcatgctggagggtaggagccattttgcaagttattaaatggccttcagtacttagcagcagataccatgttcatacaaggttaggcagttcagaaagggtggggtcatttagtgactttgatccattttatgaaaacatatttctcatgggttcctagataattgttcctcttacatttgtcttctggtcatgatgatatcacctagggagggagaagggtagaaatagagggatcaaaggtagtgatgctctgctagctggctctcctatcggtaaggcaaaaaggaggcttagctccttgcataattatttatgagacataaaccttgggtggtcaagacatgctgatgcacagaatcagagacaagatcaacagttaatgccttatgtattcatgtgacataaggactgtctgcccaagaatatttcccaattatggggggggtgcctgaaagcccattggctcttctctttgttgcataattcctcatgatttttttgttacatggaaaccaataacttagaggaggtctctggcaggagatcctgaagggttgggataagcgagggtgctgaaaggaaggcaaggaaagagtaagtataggaaaagaaggtggggactacctggataaacaggtggccctgttccgaactttccaagggccaacctgtcagtactcccacttatctttgagatttccatgttagaaagaatgccttgtttcgggttgagcaaaaactgtttcacctttattggtgagaaaaaaaatggctctaagccatatttaggaaatttgttgactataattaagatttcatgggcgtccccaaggtttacttacccataattgaaaaaatgcaaatgaagacagttaatcagtggactggccgactatgaagcactactacctatgtaaatgaattaaaaatgaagacacaaaatatgtccagttgagaaagttaccaaagagccaagtggtaaattcctcagcaaggctgtggagaattttttcttagcctgacagcctgcagtgccttcctgccaaggtctttgccaatttaatcttgagccattccatacagatttcctcacaactggccttcagcactggctggttctctggcattacttaaggaagccctgaagaaaagataacagacctcttgtcctcttttctgtgtaattgatccactacttagagctgtaaaatatttgctttacaagatcctgttatcaaatggaatttgaaactctttaggagttatcgcacagaatttcacttatcagggatcagtatgtgttgtaatattaactcttttaatgtggttttgtttgttttgagacacagtctgtttctgtcacccagggtggagtgcagtggctccatctcagctcactacaacctccgcctcctgggttcaagtgattctcctgcctcagcctccccagtagttgggattacaggcacctgccaccacgccaggctaatttttgtatttttggtagagatggggtttcaccatgttggccagactggtctcgatctcctgacctcaagtgatccgcccacctcggcctcctaaaatgctgggattataggcatgaaccaccatgcccagccttgatgtgtgtgtgtgtgtgtgtgtgtgtgtctgtgtttttaacaataaatacaacatatctgtgatggtcacttttacctctaacaccatccttccttgttaaaatatgcaaccaatttttatcacctgatttaaaatcatccccaaaatgttttgcatttctgttaatacttaaatcttctccttaatgatttcattaattagcaactcataatatggtattagtacaaaaaagtgcacaatatgtctgtaaaatcagctgtggaaataaaagcataaatgcaacatcctttagataaaaatatttgtcggccgggcgcggtggctcacgcctgtaattccagcactttgggaggtcgaggtgggcagatcatgaggtcaggagttcaagaccagcctgaccaacatggtgaaacccccatctctactaaaaatacacaaattagccaggcgtggtggcacacatctgtaatcccagctactcaggaggctgaggtaggagaatcgcttgaacccggtaggcggaggttgcagtgagccgagattgtgccactgcactccagcctgggtgacagcgagataacatctcaaaaaaaaacaaaaaaacaaaaaagtcagtatcagacaatatttgatagctaacaaacaatagaaatcaaacaattcaaatacagaagtcgtgatacaatggatgatatatctgtgccataaacagaatcaagtttttttggacaaccctgttaaaatgtctgctcttgggaggtaaataagtttcctttcccacactacttagcagattctgaaggagcaaggtgcctgagtgattaataatgcctgccatggacactatggatgagaatttgtttgatgagaaagagtgagtagactccaacacagaaatgagagcttgctatcaaggaaatgtctttctgtgaacatataaacattctgagataacttaagtgggaaaagatgtgattaggctgaaccttttcaccatgtctttgtttgcttgagttatttattaccctggactttctagaggtttttaaaaagtgttattgatatagactctggaaaatgtacgcaggtatttcaagatatttcaaacatgtcacagtttctaaggacatcaaataggtcttcaaagcctcatggatttttaaaacatgaaatgttcttcttggaggataataggctccaatgctctgggtttctaacctctaattcattaacagcaaagctgacttgtagcaaaatttttttttccttgcaagcaatatgtgactcctttgagggagataacagtttaaatataaataaatgaccagctccagtggaaagattccagtttccttgaggtgtttgctttcaatttattgccaattctcccatcaaaatttcctaccctgaaaacctactctaggtctgaacatgtttagaacaacccccttaaaatcgttcttgttcttatatgttaaagctatgctattcccattttaaaatattgcaaaaggctaaagtggactttacacatatttagggaaatattttagcattatcaaactcattagtgttattggctctgacttacaaaaatgaaaataaaatagcaaggcccaaatggaactggttccttcttccaggcatttctaagccatttgaagtaatcaaagtaaacacctcagttcttttatttcaaaatcaccttccagatggatttggcttattttattctatttagcttagccagcggtcccatgacatttgcattatttttaatccaatgacagattgctttgtgatttggattttcatgaactgccatttatgtgtcattaatttttgttagtagatgatcagcttttttgaaaaaagacatacaatgtgaaaattgatctctctctccatgcatattgtaaatatatgaattcagaacacacagtcaaatcctaattctcttctttaatcgtatgcccggcctccacaagttaacattctaagacatttactatgtcatgtcatctgcaatgtgtcccctacttgttttatattatttttcacttttgacaatactattatttgtttttaaagcaagctgttacaaaatagcatttattttatttctatcttacctcaggaagttcaccattctgaagggtaaaagattgctaattacttaactattccctacttaaccaaggaaggttattttctattcaagtaaaatacttgttgatgacgttatatcttagattattaaaaatatcttagattattaaaaggatattaatattgattttaaaggtcttattctgagaaattttttggtaaatttattgaacttttgtgtatggatttaatctttgtaaaaacagtaaggaatatgaaaggacaaaatcaaacatgttatacacctacagtatgcagaacatcaccctacatgaaacaattgggaagatcaatataagcaaaacatgatttttttaatatttactcccataaatacaactggacctctgataaatcacctagatgtaacatacacacctcaaactcggtatgtccaaagttatactcagcattgtagcacttcaacatcctttatatttccgcaatctaggttgagagcattgatgtatactaagttggactagttaggtatttgagaattgtccttcctcgtcactgttaaccattcagtcaccaacaacctcttattaaagagtgtttagatatcatgcccacaatgaagctgtttcccttctcctatccctacttgactcaaggtaaattgctattccttttgttcatttagcatctcgcatcctactaaaacactgtcatacagtgttaaaacctttagtttgtgtctatttttctcattgtattgtgagctcttgtgtttcagtgcttatgtctatttgtgtttctatacccaacacttaagcacagtagttggcagaaagtattcagtaggtgtctgaagaaatacttggatgatgtgtagatggaaaaatgtagggatagactggaggataaaaagtcagtgataattcaacatttcaagaggtgtagttgcactttcctttgaaagaatgtggttgacttctgcagtcgaattctgtttctgttgaaactgaacacctgttgcagcataagtcctgtttgaatgaagtagcatgcagctaaggacataggctttcagaaatattcagttgataacataagctgtagcaagagtcatttcaaatacttattacgatgttcttcagctttggtgatataaggaattaggctgcacaaatattgataaatggaagaatcacaattcagataagtctttgctccagtctttctgcccattcaaaacacaaaatgaggagagtatagggaacagaaatcttttagaagttgagtggtattaagaagagtaggaatagaggcaggggaaaaaaagacaatgtcctatagaaaggcctataaaacagctctcctgcccctatttgcttttcatggactgtaatagcacaagatgggaggaaacatctgttttcttttaaacatagtattttgatgttttaagagaatcataataattagcagaagtctaatttcctgtggttagggacagcagatacctatgggatggaatagggagaatgagtgtagcagatcttggtagattttgagggctgaggattcatctgctctggatggctctgggaaatagcatggaggaatggtaagatcatgggctcagtggttagatggcctgggtttacatcttggcttcaccacatgttagcagtgtgataatgggcaagctatatgcttctaagtctcaattggtcaagccttgtctcagggctggttgtgagatagaatgaaataaacgaaactcagggaactagttcagaaaacagcacatggtctaatttgttaaatgtatgcccttgtttttaaactagctgaaaataagcagtttctcttaggttagatacaggaacttaatgggatatcctataggaatataaaaggcccttaaccaggaaaagatggatatgtctttctgctgaaaaggcctgtcactgtaattcaggtcagcttgaggaagggctgagaggtggttgatttttgaggccattttaaaactagcaagactggaccaggtaaaggattagatgactaataagagtagctgagccctgcctagtataaatgtgcttcagaataatggagcaaatccaagacaaattagcagagatcagtttccagtgtctatttatttccataagggtgactcaaggccaggaagaacaaggaagggctgagctctgggcagcaacatacctgaggccagaggctatagtcagcaaggatttgggctatgaggatgagactaagaatcacagattgtgagagatgaagcacttatcagacatagccatgatgttaaaaggatgttgccaggtttaggggacaggcttccagcctgttcattagtagaaaagagttcattttggataggcaataactaaaaaacaagacctgagagatcaagtgatgcttcgggggaacattgctccatggtggggttcagatgagtgggccttggagagagatagtagtggtcctaatccctactttgccaatgactgcagggacaacaacttacgttacctccctaagcttcaacttcctcacttattaaatggggagtaataatcattcctacttcgagaatttttgaaaattaaatcacacaattaaaaggactcaatgtcaggcgtctagtaagtgctcactgaattttgattattatgaaaacttatacgtattcacttacctatcttgttgaaaacgccatcattacaataagtcacaaaagagaatgcaactatgttaaataaatgttcctaaacttggtatttaaaaactgttgccatgcagctttattctaatatcttttctttaggaagtgaagttttagccaaccttgccaattggaaaacagagttttggcaccatcttggaaaggcataaagaaacccatttttaaattggaaagaattgtgattgtgctgataatgatctaaatcatgaaagtgcatctacagaaaagggcaaaatgtaacctttggaaattcaactttttttaaaagtcaaattttgtattaactttaaattgggcttattgtttgtggaaatatttgttccagttcagttggctggatctctcacctcctcactttaccttgctgcaaattcaagatctgccttagcaggtggcttgaataaaattcttggctttatatttcaaagctatctcactctcaaacagtgtattaggtttatttacaggattcctgcatcaggtttgaaaggcaaaggggttctgaagaagagacaggctctcatatttttgctgcagaattaaacaccatctatttgaaaatggaatctgtggtaaaaatctccaaatttacttgtaatcccttctcttcagatcagctcaattctcccaagactcactctttggggaccatttaataatacaagagcaatatcatcttgttctatttctactaattctgttgcccaaagcaaatcaatgaaacgtccctgtcatattttaccctttatttactcatagcatgcgatagaattaactaattttatgaattaacattactcatttttgaaacctgacagacttacagagaactgtgcattggccaaaggtgttaggtatttagcttctaaagaaactgtgacttatctgttcctgattgttcccaacattttgctgtctcatctctgtccttcattatttacacttctacctgggggtaagatgggaaagacgaaaaagtaaaattcatgtgagataactggctatgatattaccaaacttgtgtatgacggaagtcctgaaatcactggataaagtaaaccatcaagacagtctttaggtttcattaatccagtggttctcaaactttggcaagtatcagaacctcctggatggctagctagttaaaacaaagattgcaaggttttgattcagtaagttttggattgggcctgataaatgcgatttctaacagattcccgggtgatgctgatgctgttgcacctcagggactaggctttgagaatcaccccactaattcatgcttggcttctctcctgttaacatgaataacctagagtttgcttttccttagctatctttagaaatttgggctgtataaacgaaagagtatggggttcagcagtgattttggtatacgtgcattttgtatggcataatagaagtgatcaagtaagtgggttactccatccatttggttgagttaattcacaaagcaattatataaaacatcttccattgttttccccaatggtcagactacaagcttttctggtgatggaaaaattgagctcatttgattgacatttttaaaaacacagcgcaacattaatttagcttaaataagggatatggaacaaaaagcagccaaaggaacagtatcacagttgtgttagatacaacttctgataacctcaatactgcgtgggacatattttgttaataagaaatgatacgaagctaaagtgaatgccagtcacgtcagatggaagaaccataagatctacagtctctcagtttaaacactttcttagtcacctagcccccagaaggcttaatgcagctacagttcatgaagttcatgaattacaggctacacaacaaataatctctccaactaggaacagcatacttaagaacatctttgcttccttcagttaactgtaattgatatatctcattagttgatgttacaagaagtttgatgaaagatcagactatgctcaaacatccctgaggctggaatgatatttgcagttcagctgttaattcttttctttcactagctcacatgtagactcctggctgatggagagtctaggaaatgcatttttgagcctcaccaatcctgagctcaggatatagaaatagtgtatagataaataggtacttccattggttgggctataacattgagacataaccccagcatctgtgatgcaggcagtgaagcaagaaggttgaagaagatattgaatgatctagtatacagtacataccacactaactacttaaagacagaaaaaaggtaacccaaaatattcctggcctaaaagtctggtgatgggcctctaaacctattctcaagttgtgacttgtcttggcatttttaaaagccatcctatccaacaaggtgacagtacagatgagtagtatctttaaagactaaaacctgtgctagttactggacctctgcatgtatcagctctctcattctaaaagggcatgacgataatgcctatattatagagttgttaacaagagctaagtgggaaaatacaaatttctcataatagtatttggcacatagtaaatactgaatatttcattaatgcatgtatgagaaggtctcactgaatgctatgagatcctgacataagtatcagtatttatataggaggtatactgaggacctgttaatagttaaattgatactccaagctcaattaacacctcatagaagcaagaacacccatggattgttcttctgcctaaatgactgtatcctcaccaaccctgagctcaagatacagaaatagcctatagatagatacttccatttcttgggccataaaattgagaggtaaccccttataactttttttctttagtgtctgccaaatgcttgtccaacatttgagtaaatgtcaccattgctaattaccctaatgtaataatatgagatgttctactttggaaaacttttgttaccttggaattcctacctgctaagatgagggctttgccattagctgtattgagattttaaaaaccttaacttgtgataatttgctccttttcagcaatactatttatttgcacaaggaaaacattattttaaccgtgaaagtacatcaccattttgtgaatttggggcctccattaacccacatgtatctcattcttttcctactctagctggacagtgccacatcgcttatccaggcagctaaaaacctgatgaatgctgttgtcctcacggtgaaagcatcctatgtggcctcaaccaaataccagaaggtctatgggacagcagctgtcaactcacctgttgtgtcttggaagatgaaggctccagagaagaagccccttgtgaagagagaaaagcctgaagaattccagacacgagttcgacgaggttctcagaagaaacacatttcgcctgtacaggctttaagtgaattcaaagcaatggattccttctaggacgataggttttaacaagaaagctttttctttcttttctttctttctttttctttttaattccatttttgtatgcatacctgccagctcgtatgcctctggcatggggaaattaagggaacagtgtctgtttgcatgtaagatgagatgagatcaatactactgatccatctgtagcctgggaaggagacaggacattcctgtactaaggtggcacagagctgtcctttgcaacattctcataaaattgggcacagagttcgcattggcgcaatatttatgggagtgggagggatggggaaaataaacttaactctacaaaagcaaactctaatgcatgcaagaatcattaggttggcaggtatatgcataagtgaaaaatctggaagtgtaatggtagaacataaaacttgtattgcttctgtttcagtgcaaaaatgtactagccaatacgcttaagtgtgtggcccatgaattgaacaatttaaccttgaagtctatatccgtgatattatgtcgatttttaactgaggggaaattaactagtccagcctaaaatgcttcttttaatctgcattctgtttcctcttctagttgtgccattactagtgatcatgtttttttcccccctttaatgaaaacaataaacatctatttgagacaattaaaatccttctgggggcactggaagcacaatacggtgaccaatcttgctttcatttttttttctttttaatttgaaccatgattttgctagaaatagaaggcccagtggtggaatattagagggaaggaaactgacaacgtgtgaaagttagaggcaaatacataggtgtagcttggagtgctggtatctaatataccattgtattcactaactaactcaaaataaacacatttaatcttgacatctcaagtatgttttcttttttaattttttaagtatgtacttaataaagattagagcatcatcttcctgaaaattcattaa

SEQ ID NO: 92 - DNA, 1135933 bp, Homo sapiens; identical to SEQ ID NO: 91

SEQ ID NO: 93 - DNA, 843317 bp, Homo sapiens
tttaaaatgctttatgatattttatttgatattattcagtaatacaggttttgtggcaaatatgcatttctaaaagtgcataatgaaacattttatttttctagctcttgaatttgtcatagaaataagccatagattgttactttctgatttactacttatagattcatattgaagatgccatgaagaggagataaatgagtttatatgacactatttactgattatgaaaatagagaaatacaaaaatattatctaataataacaaaaaatatatttcttttaaacataaacactaaaacagagagtagtcaaactgatttggcacacttaatatatattatcaacattatatttttcattcttgaataatgaagcattgcatactttgagctttgttcaaacattagttgctataatcatgaaggtgactattaaaaccagtcagagcccgtatgtgcacagcaaaagagtggtaaccaggatctatcctatcatctcattttgttaggaacatagtttaaagagaaatgccattaaaagaggatgagtttgtacacccatctcacgcatgagtagtgaatggtatttagttagtaaatattctccctatcctctatccaacaccaaaaataagcaatttcagcgaaggggattttacttaataaagttctacaaactcaattttaggctttcttatcctgccatagcaaataattttttgactttcttcatttgtactttatggagctaactacattttcttagaaacagcattaaaattaaaggtaatttttaatgataaaatgtttccttggatacattttcttgtatgttaaagagtactttgtttcaaaatgcttaatttcacttacaattagaaatcaaatatggagcacagcatagggcaatttggaaactgtcacactaattgccacaaaaaagttaatttttcacataagacaactggcagtgaacatccaattaactgccacacagttatttaactactatcctcagaaaagaattattctattttatgaccactaattgaatggtcattgacatgagacattttttacacttacaaatgtattttgaaattacatatttttatttagaaaatgtatatttgttttaatttggaaagagctgaacacaaggatcatgattttaaaagatcagcatatgtaggtgacatgaaagttcacagcaactgtttcacaaatcaccttaacacaccggattcacagataagggtacgcctctctttggttcataaggtgttgtcctggaaaccattttgatgcagtcgacaatagggcaaacactgagacacagagtacagcctgtacaagtgtcggttatggtgggcaggtgggtttctggatcaaactgtatagcctgcaaacagaaatagagggtattgatgtcactgaccacaaaggtcaacaatgtccccattttagcgttaacatttttctctgctgcagaggagccacactatgagacaactacgtccagctctatggtgcaactatagcaacagttgagctgacagaggaggaaaaaaagagcgagaaaagaaatccttttaaattaaaaacacaatgtttaaaattccttaggggtatttttcttcattgtgtgaggaaaatatgtcataacatagtcactctctagttttctttgttctgagcagagttcgggtctttccagttctaccaggatggggcgtcttctacctgtggattttgggggactttcacacgtcctccttttcctcttcacactctttgttcttgacagtggaaaagtgttactgtcagattctgaggcaatgaatacatttgtttggatttcaaataatgcatgtagtttttagaagaaagcagaagaaaaaaattagcttaacagtcagctttgagttttgaagatttccaagctgactctagtcattgtccaccacgaaggggaaaaacactgaatggagagccaggaaaactgatgtccagtcctggccctgacactattgagcccagattaccacagccaggcctccagctctgaaacggcttaggattttgagaaattttacaattttccttcccccgtcttcctctattccctccctcccttcctccctcccttcctctctttttctttccatgaagcaatgtagaataagcaattaagaatacctagtatgaaattcaggaccgagttttttttaaaaaaagatatgatgattattttcccattaaagagaaacatttcaatgatgaaaaatgacatgtaagacctcagcggaagttacaggatttctatctaggagggatttcagggcagctacgtaggggtggatcatggtgtcagaggggatttaggaaacttgcctggcagtctcacttgcaaaaaaaatacaagagttttactcagactgtgtactactttgaagtgactaagtcggggctgaggaaattacaagggacaataagtgtctctccacccccatggtaccccttgaggccaggtctacaaatcttacattttcaaggaattgcattattttgatttttttcctgtctcataccaatgttataattcaattatatatgtgtgtatatatatatatagttgtttaaaaaattcccccctccaaatgaagctgcatgcaactatattttttctcttttatgcacatataaatgaaaataatattttcagagtaaatcatgatagttgcttaatatttttaaaaagtctgatctgtaaggaaataaacatatatttgaacaagaactatagctatagcaagtcatgagaatatctgtccacacaaattggtgctatgttttgtaaaacaacattttaaggtgctgtttggatgagtaaaaacgatttatcttccttaggtacccttttatataaatggaaactcaatgaagtaactgataaaaattaagactaatgcttagaaatatactttgaaaatctgcaaagatataaaactttatgttcaattaaaaattttggctttctatttttatcttctgagacagaagaatcaaagaactttctaagtcttttaaaatgcatacttgtgattttctttctcattactaagaagatttttctaaagttgttccaagtctagaattccacggtgggagccataagttctaagatttaagatattagagagctgatgctctgatagttataggacttcctgattgatctctgattggttaatttgaaagacgacatgaaagtaaatgtgatatggctagcactttataaaaataacggttaagacagcttttagctagaaaaaaggtgatgaattgagtaaaaatttggtgtagaactgtggaactaggaagaaaaattaatagtttttttttaaattaaaatatgtctgtcataagaatatgcaaaatcccaccatgagcagtatggaatctgcccctaggttgaataaggtacacaaacttctctttttaaacatggggacattttattatgaatttagaacattccattgatcatttcttaaaaagatctttttttacttatagcttgaaaaatataataaaaacaatattgtatagtttttagcaatttttaatagtttagtagttttccaaaactttaaaatttgctttctccaaactctacttcttaagaaattctttaactttcacaataaatcaggcttttgagaagaaacttatgtttaaaagtattgttatgatcattttttcattcatttctaaaattcaaccagttaaaagtcatagttgtgccaaactctttaaaaaatagcaggttataaatatataggaagtaaatgaagaagcaaattataagccaaagagaaattcacagaatgtgttttcaagagaatagcccactagaaggagtcaaatccccaatttttctttctttttctttttcttttcttttcttttctttttttttttttttttcctgcatggtagatgctctgctgaggactgaggagctggaaagtagctatggctcacttcatgagggaagaatacatctcttaggcttttccagcttcagaggaattcctgggaccaacctatacaactcgttggtgggaaagtgcttctttctgactgtagtaaaagcctaatcaatactgaatggaagagaactctcttttggcagaaggaatcatagcctttcagagtaatggccataaatggtagttctgttccctttcctctgtattaaagcataatgctttcctagtattcctaattttgtgtgcatttctcttttcagttggatttttctctctaatgttgtggctgatgaaatggtataaaaataattctgtgcattaaatgctggcatagttagtaaaagttacaagtttccttttaaaaaaagaccatattataagggtgacaggacagaaagatgtactgttgcagaagagcaatatttggcaccactggtttaaatttcacacatagcaacagaaaatgctttctgccgtaaaaacaagaagaaacatgtctcatagcattctaattccagcaggattcttacctggtagccagaatcattacaggtcatgtagcatttaccacagttgatacacatttcttcatcaatcatagccacaacttgctctacgttgctcaattcaccaaatgttccaaggtactgcagtgcttttcctattacatcctaaaaatagccactgaattacttagcaagctcattttaaaacattttcatgtaataattaatatcactcagcattttcctgtttttatacaatgttgcattatattaacttgggagactggatagtataattctcatagataagctttttatgataattatagcttagatgtttgtcttctgaaagatgggcaatatgcatgcctggcttagaaatacgagacctaattaactgcattcaataggtttttgactggataatttaaaacagcatttctgtggacagaaagaataaatgacacccgtgtgagttgttatggctaactttttctcatttttggaccttgaaggaccaaaagtaatacaaagtgacaaagggtaatacactatgctagaaaagtttagattgctcataatgaagggaatacgagtgtgaatgttatgcatttatttcactgcatgaggattttagattttaatttaaaaagtgctgtgatagaatactcacctgtcatgtcttgaagagtatgcaacattatttaaaaattctaatttatgttaatcgcttaggttgatccaataattaagtcagatgctcttttactttaaagaactagaattttcttcattcaccattgaagatctttcatgtgattacacattgctttgttcttcatactaattgggagtgtgcctaatatgtgaagcacagactatgtttcatcaacaataagaaacattttgcttcataaaacaaaacaaaagaatgtagcaatgtcaaattagcatgctgtcaagatttttgcttttgtttttaactattaacatgagaatcttgtttgaattcaaggtccatgttcaaggaggtttgactcttagttaaaatcatctttccatattctctttggtattgcattttctgctatttttataatcttgcttactcttctttacttttttttctatttgatctctaaattataatatactcattatcatggaatttcaaactgagacaaagtttacatttttatacagttcctttgtgtatctttcaagtgataagatgctagaaaacttccaatattgtcttccctattttctttataatgcattgaagttataatttcaactacactgcagtctgtttgtaggtgggcacttgacatccaaatcaatatttccattttgaaatgctcccataaactcaagatctacatttatcagctgcataatgagcactgtcattagagattggtacttcagattctctactcactgaacttatcatcaacaacacgaactgggtcttcctttgtatttctttagttttgtgaatagcattacgatttttccaatcacggagtcttggaatttcatagttatatgtcactacataacttgctccaatatctcctatctgttgccaagtctgggttccagatgtgcaatatcttttgaatcctttccatgtttactgccatctttaaacattattaatgaatttctcattaattttaatgcaattgtaagagactacttgataagtttcatcctcacattcttcctttcccactctaccctgggcaatgctgccaccttaatctaggatgtaagacacagactaaatttctcactaccttattcaaaaatctgttgaattaggcacaggcttaccacgctggcatttaaggctttctgcaaacatgtctttttctatcttatttctcagtttcaaacaccatgcacttcagctacactggaggacacacttttcaactgacccatctgagatctaacattaggttaaatcctctgtctaagatacctttcattcctaactccactttgcaaaatcccaagcatccttcaaagacatctcgaatgccactacttcatgaagatttccttaatccttccttcttctttcctaaccaaatgtgaggacgtgatctctctttcttcctctttctcaccttttccccttttcctcccttccttgccctctctcctccatatcctctttcttaaaaattttttttgatggccaatatctattatatggaactaatgacaacagataccttttgagttcttaatatatttcaggccagtgccatatgttttacacattttctcacttaaacctcatgcatttaatagttgatgatgtgactgagatttaaagtacccaattaagtaaatgatgaagcagggattgagaaccagtgttgcctgactttaaataccacgatcatcagcactctgctatgctgactcatttgttattctgtatttagcaaattctaattcatgttatggatattttctacatttagcttcccatgttgtggtctcttagtaagctttaattcatctgtgtatctcatgtggtgtatcctgtttctggagatcattgaaacacaatgggtacgcaaatatttgttaacataaatataaattttatatatctatacactaaacctataatatggtagtaggcacatagtgggatgaagtaatagctattttactgaacatttttattgatatgagtattttaaatacaaaataatcatagtcaaagtatctgaatatgtgtaatatttcccagtactattttaaaataataaattcaagaggtcactatctggctgtaaaagcccatttatatgtgatagaaaataattttttaaatctagtaaataaatcaacccaaagagttgtttcactgaatcagataatggtgactaaaatcatcaataaatattcaaatgatgattatacaggaaactctctaggcagtcaacaagtgtataagccttcttcaaaagaaacgttgtatatgccttagaaattttacgtggagcaagtccacattctgtgtacattaaatatgccttttcctctaaattggagatttgcttttgtcatttattaaaacatcattgtttaatgtgaagccaatgtggagcctctagaagttattagcacatggtgttaacaattcatcccttattaagtacaattttttaagaaaattatatttttttctttatctggaagaggataaaagaatgacaactattttaaatcattttgggaaagagtagcaaaaaaaattattccatgtggctaagaatgtggacatttgttttaatcccaaagcctccaggtagtactaccagcttatgaatacccttgagtagatgtcctggaatctggagttggctgaaagatgcataaaatcagtaagtcacatatggctagtctccagcccctcttgtacacacatctgtggagatcagggaacccatattcattattccaattcattattacacccatttggatgtatgaaggttcagcagtatggtgtagccatccctgattagtggaaatggttatatgtagatatgtatgtggagaaagcaatgttaaatcttttaaattatagatgataacacttaattttaatgtaggtgttcaaggaatggatgttgcaaagtactacagaattccaagatcccattattatcaatttattacttgtttgagataattaaaagttgtcgttgttttgttttgttttgttttgtttgagacagagtctcgctctgttgcccaggctggagtgcagtggcgtgatctcggctcactgcaagctctgcctcctgggttcaagcgattctcctccctcagcctcccaagtagctggggctacaggcgcccgccaccacgcccggctaatttttgtatttttagtagagccgggtttcaccatattggcccggctggtctcaaactcttgaccttgtgtccacccgccttggcctcccaaagtgctgggattacaggcgtgagccacggcgcctggccaagtttttttttttttttttaatagaccagtcaatgtttctgtttgatataaagtttaaggccaaagagtgaggaactagacagccctgattccgtccctgatgtttcattctgaatttattacgactaatattaatttattagttttggtctatttttaatagctgatggaagtattttcaaactgtgattatctagcatgttagctgttctttctagcttcaagtcttcatatttgattagcatgtatcatatcagtttctactgcatgcctatggctctcgccctatcttaaagtaaaacaaaagtcataagatgaaccattgtaagtcacactgtcgtaaagtagaaagaaaaatcataagatgaaccattgttaagttcttaatatgaaccattgtaaaataaaaaaaaaatcataagataaaccattgtaggtcaggactgtctgcactttgtacaacttctgcaaataagtatccttcaaaaaccaggacccagaacagcatgctgtgggcagtcactatgacttctaacccaaaaacattcaatatttaaattatttggatgtagctatttaatcatttaactatttccttatctgtaccattaccaatgtcatatctttttatggtatattcacttcttgcctaatgcatctttcaaaacagaaaatgagataattcagtttgctcttactgaatttatgctgatttttaacttcttcctttactaatgctcccaagtcaaaagctgaatgacgtttgtaggattcctttggggttagatctcaatctttctgatttgtttccatcttttccctacttcccctacaacatccacctttttctttgggaaagaacctggagcaacatttatttttcatcagtgtggtatagtgatctcttacaaaagcacttaaaaatatagcaggtgccttattctggatattctatatatgccctctgagcagaaggcagacaggagtactgtacagtaagaaaaggacatcttaagtttaaatttggcagaactctaataactaaggactcggcttgaatatgctgagagcagagggcagagacaaagtatgatccagaaaatgaagtattagattggccggcgagggtgagagaagcaagtaaatcaagagatggaatagcggcaagtgagacttttggaaccaaagtagtgagagcggcttgggtgagagggagattattagtgagagagtcagatgagtaaggattggccaggagcaaagttggttcagtacctgtctgtggccctgatcactgtattttttctatctgggatgagctcaggctttaaagtggtaatgtcttgcaagacactttggatttaaattcatttaatgaaggtaagtgtatttctacaatatccttaggtatcttaggttttaactctcaaatatattttctctactctttttagttctgataaaattctttatgggattctagaaagataataggagtcaaacagttctctctaattataatttaacagtgtaccacctgctctaagtagtgagtattaatagacaaaatatgttgctatttttcctaatattttctccaaactcagatcatttgaggctttagcacttctgacctgtccttaaatcttgatgccacccttttatttcatcattggtaatgtgatctgtcttttctcatataagcaccaaacactgagttatctaaatgcataacctttttcttacttcttaggaaacttagtgattatataatcaaatttgtacttgtcagcttctcatttttcttgatccatcttcaggttagagttgctgactataagataatatctattgttttctctgaacttcctgaaattaggtttactaaaggtgggatacttgcatttctaagctcagacttcctttcattggcctaataaactctaagttaacgtggaatggttactttccttcaagattcctttagctgccattttcttcaaacagacttttttagccagaaataagccaaagcagcaagtcccctcattacttgtctctcttttgtgagactgaatttccaacaaggcaattcaataatttttccgatgttttgcctttagtggagtgggatttccatctgaagtttgcaaaggctttcatcactcctctgtcttgcctgtccctattaaccatctggttacaaggtctctgaggcagtcccagggtaacattttgtttttctttcatttcactctcctgcagctgcttcctccatactccaccctgaggtttgtggatttccatgcatgtgtataatttttttgatagatactgcttctcccctagcccttccatcagacccatttattccagacaagatacacctttccatgccataatctggtcaggaatcacatttctacaaatccccataagacttaagggattattttaccaaattctcttcagtttttaaagttcagtttgataattttcatctgctatgtgttggtacagggacaagtgagaatattaaccttgttcccagcccatttctctggtatcttttggaaattgctgggcaaggcctccactatttttctttctgttccctcctgtttatgctccatagtatccaatatggtcttgcagttttatctgagtactcttctctttcctttcacaattcaattgaaataataaagcactcgatcaggctgactggtgtcccgccaacactgtcttgccagtcttatgagatgcagtccatctcttactagaagcagcaggaagaagagatgaaaacatcactagtgcccctaaaccattcattttcctacgcagaaattcaaagacgttagagatacattcccggcttcataaagagaatgagaattcattctcatatatatcaacagaagtggaaagcattcgggggactttataagtcttggcagactctcaagtctctgttatatgctgcctgggaataaagcacgtttctcatttaactgggccaaatgtgcacactgtcacttcagttctctcagcgaggaaacgaaactgcctcctgtaggaggcattgtctggtttcttttctctagcacaggtgaacctgtagaatatgtcaggagcttcttcagaaggtccttgttcatcttttagaaggaaatctttatactcattgcaggaggccaggtttctttttcttcttttatctcattctttcccatcagccttccagtacttcttttgataccctcttcttcctcagaatctttttctttctgtttcccttatggaattggtagcttcataatatgggccatacgcatggtaaatgctatgctattatgcattggaaatgaagatgtggtgttgataaaagggaaatcatgcagatgccaggctgtccccagggccccagatcattcccaggggtaggacggagggcctctgaggccattttgtttgttttttttttttttttttttttactttcaaggggctaggagaatcaggatgtatgttgtctagcaaagatttctggttctcaaggactctctagtccctggataacactgggcataaccatgcttgatgttcaaatgaaattcatagcagtttaatcagttgatcccattgcttttttatattctgttattaatactgatttataaaacccagttattttcctcattattgcttctcagttctgtgctttctatgaattccaatttaacaaaagaatgagtttaccattttgatgtcactatctgcttgatccagggattatgtattggatttaaggtcccatggctgcaggttattacaagtatgtttgaatactgtgctttgcaaacatactgatttgcttgaaatgccaccttccttttctttcttatttctatgtttcatgagagacagcagaggacagtgcttaagggcccaaggtttagagctaccctttggaatcaaatcttggctttgatatcttcctagctgtgtgaccttaggaaagttatttaacctttctgtttatcaattgcttactccataatagcacagagggttattgtgaggattaaatgagctaattcgcaagcacgtagtgatgcttgaaacctcataagtactcaataaatattagcttttattattaattctctgcttaattaacactaatttattaaactccattttaaatatcaccatctctgtgaagctttccacaattacccaaggcagaactaatccctttcactcctctgttttcccagagcattttgtacatatttgattgaactgtaaataatttttaacatgtgtctttctcccttgctagactatgagctccataaggatagacgtctttctttttaaaattcacgttgtattcctagtttctagcacaatttctggattgcagcaagtgcataataaatatatgttagcactacatctccatcgagattacaaacatcctgagccttggaccatgccgtgtctgtttttttgaatctcctgcagtccttagcacactgctggtcacacagcaaatactaaatacatacttgctgattgactgatattgaaactgcctacctctgaagaaatagaccattaagtcattaaggcatttgaaaggaaaaaagaacaaaagatgagatctactgagcatagcttgcttagaaatattattgttgcattcccaaccagggaagatggggtagatcagaaacttgaatgcatgactgaaaaacttgttcagacaagaggggcttagttaactttgtgggacactggggttctttctacagcagatggggaataatgtgctgtggaagctgagaggataaacaaagcagtgtcatggagtttaaactatcgaacagaggaatctataaagaggccagcagagaggagggaagaaacaagctaaaataaacagatgggtggacagagaaaatattaagcatgaaaacagataacccaggtcctccaggaaaaagggaagtaggaaaaatggtatgtcaagaaagaagaaacactctagggaaaacactgaagtaatcatgtagcagcaattacatggcgtgcctgggtgtgtgctaaaaaacagcaataacaaccacaataaaaggacaagaagcaatgtctgattcatgtgcagacagaaaatgactttaaagggaatgtggccgttaatatcaacgtggactgaaaaatcacacagccacatcatctagatgtggtctgaaataatgggcaaaatggcagggacttgtataaaaatgacaataactgtggctcctagaatttgaatagagctgtgctgtgtataatactttcacacatatcttttcatttaaaacaatggagttgaggccttctgacattatccagtatatattttccctcctgccaatcccttgcctggactgttacaatagcttctaactggtctccttgtttctgcccttgcccctctagcaaactgtatcaacactgcagccagaaagatcctttgcaaaaataagccagatcatatcagtcttcctttctaaaagccttactggtttcctgccaaggactttgctatttcagggtctttgcactttctgttcattctgaatgcagtgttcttcccctggatacccacatcattcattccctcacttttttaggtgtttgcccatatgccattaaacaggcaggtgttccctggccagtctctctagtaatttttattctcctaagcttgttctattttctccattacacttgtcaccatctgacatattatgtattcatctgtttatttgtcattgtctgtttctccctactaaactgtgagctccatgagagctgggattttcactactggattgtgccaatgactgctatagtaccggaacatagtggttgcacattaaagattattggacaaattaagaaacatacatggatgaatttgacaactgttgccaactagaggtggaatttcattgattgcatatgcgagacaaaatgaaacaatacaaagtattggtaaaacaatcggtgctttctgaccttgtggaccactttcctattcttaagacttcctttttgtatttcttccacactatcattttattttggttatccttctctttctttgatcacttcttcacatttgttcctccagaactccctacttcttcatagagtattaggttaagtaagaaataagaaaatacatgtgcagcttctatcttgggtctggaacacagtgggcgttggaaatgtcagctctttctcctttatatcctccagcataggcccataattcctttatcaatttcaatacattcaaatctaagtttttcatgctacaccccaaactcccctcaaacctaaaacactaacatcaaaaccttaactcattatcttttatttttctttatctctgtggaaccataaaaaagctggacatcttagtcttcttattatcagctctttactatacctatgcctaatataatgagaatcactgactcttggaggaagaattaacaagactttattaatttcatctctgtttccattaccatagccaattaccaaatccaggaccacattatggcatacctgaaatattctcagttccccattcccttctaatctctacttagtctacagggctccttaaatgtcacttcctcaaggaggctttcattggccccttcaatctaaattaggtctcactatgaaacagattctatatatcttgcattttttctatgtagctcatatcaaaaaataattttatcttgttagtgtgattccttaatatctgtctctttctatattctgtatgctttatgaggacagaagctgtgtatgttttatttattgccctgcagaagctcaattcctagtgcattgcttatctcatggtaggtatgcaataaagatttcctgaaaaatacataggcttcttcaaaacttccaacttttttggcctccagagctttatgtatttctattttcattcttcagttcattttattggacaaaatggaaatgaatagtcatcttaacgtggatttctttcaaactgttcatttcaaatattatagctaatagtaacatttatttaggacacatttggtgcaggcaccatgctaaaagcacttcacacatcatctaatttataactctatgaggcagatacttttattatttccatttcacagattagttagctgaggcaagttcatgcagctatgaaacggcaatgccatagtttgaacctaggcagtgtgacagagtagtcccatgcctaattcaggaaattctttcaccataaatataatctgttaaaattttacaaactttgctttgtatttcaatgagggcaatagtttctgaagacatttttatggtcactttctttaaatatgtctgcttgttaaaatgacactgggaagtccaaattcagcttcatgacacgtctctcctcttatgcaagatatcttaatatattgtttagactcctttccctctctgcttgccaaagatgtagtttccttaatcatgccctttctggcagcttcagctattctctcccaaacatatgcaagcatatgcaagcctggatcgttctcatataaacaaaacaatcttttcctctactcgattcctcttcttatccctttcctactgacctttctcaagttactgaaagtgtattctgcacactttgttgttactttctcagtcttcattcattcctcaaattatcacctcctggattctacttctcatcattccattgaagctgcttcttgggtcaggaaaagctaaaatgtgatgggtctgaaggttatgctaaggagcttaccttaggattacggttacaatgggggaattttaagcaagggataaaacaaacagtcctacatttttaaaagactccttcataatagttggagaatggattagataaggaggacaaaagaaagcaggacagttaatataatgttttagaattccaggaaagaatacgtaagcaacacactgaggcctcagcattatgtaaagaatgtaagaggagggagatgtaagagataagaacaatagtcattgctgactagcttgtgaataggatgagtaataagatgacatccaggctgaactgcagctttttgagttaggtaagatggggttcattgagacagaggactcaggaggaagagcaggtttggaaggaatgggaatcagtttagttctaagtatgatggctactgggttccttggtcagacgatgcaggtggaggtgaccccaagatatggtgacacaagtctgaagtatagaaaagatgtctcggatggagaatagttgagtcattgtgtaggaaacgtttagatttatcataaaggaagattatacagagagaaggaagcagagaggtgaatacagacaccaacatcatgttctttcaatccttttctactttccccaacctgttcttcagcttccatcatatgagactacacgctgctctctgaactcagtgattttctcaaggcccaccttcccctacctcttccatgaggttaatatcagaaggaaaaaggaatcatattaaacatatttcaaagtaaaggatcaaagctacaggacaagaaataattttgttttgtagaagtgtaaaaggggtattttaagtttggtattaattaaataaggagtttagaacccagaattttgaatttaattagaagttttcatttataaagatttaaaaattgtttattatggcacaaataattacttacggcataaaacttttttctagagattgaccatccttattagaaccttgtctaattcatttttgatttgtccttgaaaagttttggaaaactttgagaggttgaaaatttgaatataaagtaaatgatgcaatttatggtacatttttgtcactgaattataatttgagagatgaaagggatccctttaaaatgcaaatattgaggtcttggaacaactgtctatttggaaaaaaataaagttataactgtacatgatactttagagccaaacaaattttagagaaattgaagtaaaatacaaatattaaaatcctaaaacaactagatggggtaaatactgatataatcttatggtagaaaaggttaacctaagcaaacaaacggcaaaaatcacaaaatgagcctttgctagagatgattacacaaattaaagcttctgtgtgtgtatgtatatgtatatatatacatatatacacacacacagttttatagtataatataaatataaatacacagttttatatttataatacagttatttgttataacagatttaatctctaattttctaaagagataactgcatttataaaaactgaaaatgcttgcttccccgaaaacctcgccactatcagctactattttgttttttgacagggcacagcatctgcctagaaatgacaacaggtggaatgagtatggacattctggggagaaggccaaggtagtggaaaatccaccagacattgagaaaatctaccacagctgcccattaagatgttgacactgataaggtctaagatgctggtaagatggtatctacaatgtcttgaggcttatgtaacatgtaacaccaaggacatttcactctggataacctccaaagtaagacaacttaggagaggaacataaacttgcactatttttaataagatgccttattcctctttgatacttcagaaatctttatctacatccaagacttcacaattctttggtttaattctgactttgatttttttttgattaatgatctacaggctttcatgcaaccacagattttttgtttgctctgttttgttttttgtctaagttatcaatatttaatatacaatctctgaaagatttgagggctagaaaaggtaaaaatgctttcataatcatattgcacttcttttatttcaaatataaataatatcttcctttagaaatttttacacctaaggaaaagatgcctagagatggagattttacatttaattcaaattgattaagaagagagagaaagctgggagaattcctattgagaggtgaagccagctggacttcctgggtccagtgggacttggagaacttttcttacaagaggattgtaaaatgcaccaatcagcactctgtaactaggattgtaaaatgcatcaatcagtgctctgtaaaaacataccaatcagcactctgtaaaatgcacaaatcagtgctctgtaaaacgcacgaatcagcagggtcctaaaagtagccaatcacagggaggattgaaaaaagggcactctgataggacaaaaacagaatatgggaggggacaataagggaataaaagctggccaccccaaccagcagtggcaacctgctggggtccctttccatgctgtggaagctttgttctttcgctcttcggaataaatcttgctgctgctcactctttgggtccttgccacatttaagagctgtaacactcactgcgaaggtccacggcttcattctcgaagtcagcgagaccatgaacccctgggcaggaaccaattccagacacactatatctccaaatcatatagtagtcatagccacacattggcaaaaaggctcgtgaagggctgtaggttctggccttcgcattccattagtgttcagtttgttcagttcatacttttagtggcacaaaaataatttaacatgaacaactcaagagacgatttggggcttttatgctgttaaaagtcccaaatgttcattttatttagaatgatggcattgaagtgctggcacgctttgtggtcagccactccctttgccctttcggaactctgtattgctgaaattttggaacattgagtctggaccactgtttttagcatgagatacattttttttttcttcataggtagaaggaatttttaagggttccagtctccagttgactgctaaagatgaatttcagtgaggtctacttgagaacacataaaagcaagcttttcagctgatatttcaaacagaaaatggagatgtaggagtagagtgtcatcaaacacagaagaatgaatttcagtaactgcaaactacattttagtgatgatgatttcagacagaatgccatccagtaacacctccatttttctcattatgactgcttggaaacaatactgtcttgagggtgacagaaaaaaagaaggcgtggttacaaaagggttacctgaggaatcctggtggtgatgtcactgttttgcatcttgactgtggtggtggatacatgaacctccatacatgacaaaattgtacagaactaaatacaacacacacatagaagtaaaactggaaaaacttgaataggattggtagattgtgtctgtgtcagtatgctggttgtgttatcatactatagttttgcaacatgcaaaacaggtgaaactggataaagggtacacaagacctctctgtattatttcttacaactacatgtgaatctacatttctgtcaaaatgaaaagtttaaggaaaaaaatcaagaaaggtaacacatactcataattctatcttagtgtaatttttgttattaccagaaaataatctcctgagacccaaataaatgtccaggctttccagaggccaaaccagagaaagtttttccaaaactttcaagtgatcacattgatattgatgtgcttattgataattgagttgtactacatgactaatacaagatatcttggagttaattatgtattaaaataatttttaagtgactataagaaaactaggaatttcatcttaatatctcctgatacatttaatgtatataaaaatttccatgacatgcatgcttgccagtgttctaaaaagtataaaatatgcaaataaaaaaggttattttataatttaaatgcagttttcaccatggacagatgtttttaaaactttcattataattctaaaaccaaattagtgatacatttaagcagtaaataaacattttaactatatttgtatatttaaccagtaaagtaggcatacttatatagttggcataatttttaccttgatggtaggaataggccttttggggataaaacagtttctcttaagtggtgaaaaagctacattttgttctttcagtctaatcttgttttctgctatgattttcttgcgctgttccagataaggtccaaaacttggcagtttctaaaaggaaaacacacaaataaggaagcatgttagctcagagaagagaaaaatgggaagatataaacatataaatattatcaacaaacaaatgtgtgtctagggattgtttcatgtatactgtaactaggtcttcactcattgttttggaccactagtcttctcggtatcaggttccgttaattattaaaaagaacacaacagtacaatacttttaccaaatatgtatgtattacatatacaaatgttaattaaaatacatttctaaatggaagaaagttcacaatggcaaaccaaacccattcacataaaacaacagctattagttaaaccatttgtttggtttgtatagacagaaggtgaaacctattgatgcttttttccccttcatcaggtttttagcatgatatagacacagttgtagtccctgacaaatgcttttgtcaatagcaaaggtacttcgccaaagttctcatctgtatctctattttattgtgttcaaattcttactacatctctttaaagattgtaactaatgttgattgcaacttactggaatagctgaaaaacaaaaatggtaaaaatattgatttctctgtacagaaaacaaattttattttgcatggaggcaaaaatagaaatgaaaaggagaggaaatattacagtgcttaaacaaactccatcagtattcaaaatcacatcacggagctttaaatttcaaggttatccaattgtactttacaaagttcatttagaaagatacctgggcgtcatggaaaaatgctaagtggtttcaagttaacacgaaaatgccctcataccattcattatcccacaattattttctcttcactttgtccttcccctcttctagaaactttgatcttcacttttactgacacatactgctggtgatagacatcactgaattccaaatgttttgtgtcggcctgtaacctggaattggtaggtctctttcataagactgcaaaaataccctctctctcctgcagaataaagtccatttatctagctgatggaggtttggaaaactacagcactcgaaggtcatcctgatctctgacctagcaagtattttggtgaaaaatcacacttgtttcaaaacactggcctccacatttcagcttgcataacgccccaggaaaatgagttctctggtcctctagagacctcagtagagtaggtaagctaaacttaaaccatgttccaattaagccgaactgcaaactgcaactgtaattcatgttagcaaagaacatacttatgtagaaatatctaagattgttacttccattatcaattcattataattatgtcaacaagtcaagtaaatggaaacaatgttatgaatgccaaactaatttatatacaatgagactagaactgagtacttcatctctacaccttaatgctttcttaatttgtaatatttaattgttgcagtaatatgaaatgataggatggagggagatagtattttgtatccattttgctataaaacaagtgatactgacttgctaaaagcataaaataaataagagtataaaacaagtccttatcacatatataagcatccttaaaagacaatgcttttatgaaatggctttttcttggggcatatgaggtatatgaggtgttagggattacacttggtgccaaaaaaatgcctttggggtcagataacaccacataaggtggcgagcacacgtccacatgatataaatcttcagaatgtcaccccctgcgtgcttctcttatacctcaggggcatctcaatcctaatctaatatactcaaagactatcaagaacggttaagtgttgaaacatatgacctctggttctagcagatgcctcaggttagcaggctccatgaaaatcggaaccattattttccctgttggggtttacatggttctctgtttggactttaccttactcaacatcatctaatttcacctaagagttttgtaaaggccattcaaaagaaatcattcttgcaaccttttaatctatcttcctttaaatgtacatcagaggatagtatattttttcatttagattattatttatccaaatgcagacaatgaatgtagttaaatttaaaccataatgatttcaaattatttcaacaatggtaataagaacaataaatttttgaaaatcttttgatgctgaatataatacagcctgtgtaaatatccaacagcctgatattttctgtcattttttgcaatgattgaccacatttgccatacataaattatgttacacagccttcccctggctaacatgctaagtttctaatgtgctaattggttttataattagtcctaaagagagaatctcaatttaacataaagattcctacaggattttctttgtgcattggttagaagaattaatggactaaaaggaaaacttgccaattttttttaattgaaagcaaaaaaaaaaataccaaatatcagtgactgctccttccaccttccaccaagcatctccacatcaaattgggttcatttttgtttaattcctcactgctacatggagctctcagagactaaggtatagtaccagcttccaaaacttcaaggctgctgtagacattttgctttccttattagtttgaaaatttaagtgctttaaaaaatatgttgtatatattaaagtggtcctaaggctatttaagtactgaacattttaaaagtaaagttttccgaaaacaaaaaaacatcaattctctcccgcaacaaaggatcaaccgatcacctttacacatactacatttaggcatacatttgtgttttgatcttgcaaaaaaaaaaaaaaaaaaaaaaaggaagaaggataaagcaagcaagcaagcaaaacaaagctaagaaagagtgaagatgaatgcatagttggccactgtgtgtgtgtgcaatcagtgatgattaataaagcatttagttcaaatctctgcctgaacatatagttaattgatttcctattgcaggaggagaagcagcaggacctgacagtgccagcagcaggagcttttcctcttcattcattattttcttacagaaaagttgtagcctgcggtaactcaaagtgagaggttttgagcgtcatgctatatttcttaaacaaaggaaaaagttctttaggactatcaaaagctgctttgtaactgatgaactgaacaaagctcagaaatggtgtgagttttgtttcaatagtttctccagggattcatcattgatgaatttgttctcaccagaaaggctaaatcctactcatttaaagataacagtatcttacactaaaactgtctctatccagatataaaaaaagcattacattgccgatagaaaagtgacaacataatgaatcaacaatgataccttaagccagcaaagctttaaggtaaagaagtctatttggattataatttattcatggatcaatctaaagttaattgagcatattatgaagtagaaaagcgttcttgtttgtaatagaagcaagcacttgtatcttccagtttaaactgcataatttttatgagaatggcagcaagttgcctaatagcactagtctgtagtactgtaatggatcaactttattttcttaatcacactctcttatctaattggaaaccataacaagaagacaagtaattactttgatatctaaattgtaatatgtgaaagatgaaaatatttccggcttatatcagaatatatcactcagtatcatatatatatatatatatatatatgtatatatgtatcttattcagtataaacctgaaatctattatctatctatctatctatctatctatctatctatctcctttatacctatttcgtgtgtgtgtgtgtgtgtgtctatacaactgacagactaaaggataagttacatgtaaaggatatctaaaagttgacttttttttcccaaaagacatgtttgcatatgacatagctctattatttatcagtcttttgacatttattcaacaaatacagtattgaatatccactctgggccaggaactgtcctgtgctacactaaaggctaaacaatttccagacagtgtagtacaaattatcattgttattaattttgtaagtatcttttgctattcattaagggctagtgtcagattgaattatatgtcaaatatacctggttgttgcagttatctcaaggaataatatgccagactccttggaaaactgtttgaactcaataaaatgaccaataattgcagagaaaaatgaagaaaataaatgttcaaagagttgatctttaaaaacctcaaaaagctaattgaagtagttcttggatacctaaaataaaaaatatgggagcagtgtggtataatggttgagagcatgggttctctgagtctgtttcattatctataaaatggccattgtgaggtttaaataaagtaatccaggtaaagttcctaactcaccctaatttcaatctctgctcagcatgattcaaggtagcacaggagatagagatgagaagtatcttttctgttctgtagtttctgaattcagttacttttcttctttcctcttttcaattatgaaagtaatcagttacttacatttgatgctgatttttatttcaaaatcagttttagcatggtttagaatcagaagctcagattttcccatatgtaagtggcatgtaatgcttaatcaccgatataacagtaagcaatgtttcatgatattatcaaatttggacagtggaacacaataaaaagacagagacagaaagtccatctacatattacacgttaccatagtgctatgtgatggctaatgatgcaaatcagtacactggcattggacatgtaaaatatatgaaatatgagtattagtttaacctgataaatgtaagctacaacttttgatcaaatatgtgatatctaaattggtcaaaagcagagatagttcatgtttcatagtgaaagtagaaagtcaacattcacatagtgatgagggaaataatttagaagtcaaatttgcattaaaatcagttttgcactcattagctgtgtgactatgagccaattactttactattctgctactaattttccttatcaatgaaatgagaatgacagtatcaaactcacgatgttggtataagcattaaatggaataatatttgcaaaatgcatgcctgccaatttattcccataagccttaactgcttctattgcattgtgtactgtgctctgtgtttccatgtttgctcatgcatcccctctgccagaataccccatcttgtctttttcacctggtacatgccaattaggctatttagtttcagctcagtcttcataacacctaagtaatctcctttaccgattaccctccctgcccagtggtttagaatatcctgggcatattttaatctctgtgcctactgcactgccttatcatcattagcttatgtgtccatctgcccagcttgagatcctagacaggtaactttgatccagcacataataggtgctgaatataatttttcaaagcttaatgaatgaatgaataaatgaatgaatgaatatcttgaatatatttacaaaatctttctggttgtttgaattgtcaaacaatcccaaacaattactttcagaaacaaattaaagtatataaataggttttcaaatatgacatgaagtaaaaaatcgtacttacagaaaagctgtgattcatacattcagaaaacatttataaggagccagacacttgaaatttatatagaaaggatagtgtgtgaccttaaagagactatattaataacaattgcaataccctgtgggctgtggcagaagtgacacaaactgttatatgagcagtgacaatgtgtatctaacgcaggctgaggggtcagagattttctagaagaggtgtcatccgagctaaactctgaaggataaggtgaaggtaggatggcaagtggtgcagtggaggcgtgaggtcaggaaaggtgaagagaatcctccaggtggaataaacagcagagggagaagggtgacaatttggaaaaggcaccggggagccaatggactgctaaccctctgttccatcgttcataagctacaagagggtgaggcacttcacctgtgaaaagcaggcagaacacattttgttgtgaagtgatgaagtcggatcatgaattaggaataatgtcaatcaagagaagaaagtctaacattcatggaatgccagcaaaggatgatggaaataagacttgctttctgctaagtgctgtgcaggtgctggggcccaggccacaaagaggaccaggaggctgttccttccaaaagcagtttatagccttatgaagaggattgagtcatattcaaaggaactcagataagaacattattattttcatattgaaacaatttaaataactcatatcaggtctctctttaaaaactgtcattttttaaagtaagtatttttgaagaaatacctctaggttgggatttaggaaatgtggtattgatggcatgttttaggagaaaccagaacaaagagatggtccaagcattatgcatggagaaatgtagaattttgaaggagagggggaatagaaaagagaggagagggtaaaaggaagtgtgaaaagagagggcaagagagaaggagcacagcctgttggtatgaggctgaaggacttttataaacagggagagccactatttaattttaagatgtttgcattgctccaatctaaatcctcctccatagtctttatctaagaacatctgctacacacttacatgtcttggtgagacatttggaggaaaatcagggaaacagggttgagtttcatggttgggttggcatatagctgaaaagaatagaaaccaacaggagggaggtttgagggagattcagaattcaatgacagctggaatttatagccagaagcaacctagagaacagaatctctggggatttggtagcaatttccagaaggacaggactgggtaaagtcagctgacatgtggcttacatacgtcattgtaaggagaaataagtagaggacgacatgcacaaacaatctgatgtaacccagatccaatgagcaattaattccaactcagaggttaatacaatctttacagtgaaggaggaatttaaactatgctgaaaaattctgaaaggggaaagcagtgcctagttgtaggaggagaagagaagtaaggaaatgaagtgaaggaactacaggatgagcttatccttatatggctaaaatatactaaatgtcagggagatagtgggggatgaagctggaatatctatagatagggctctgaattctgggcaaagtgtttggattttattctttagggtgtatgggaacaccagatatttgaaaatgtgtgaccagatcctcatagtggcagaaggaagggtggactgtaggatgatggcggtagcaaaaagggagaatcatccagaatgttggagatgggattctggtagtggtaggaaagtgaactagatgagttctaaggtcatcattattttcaaagctgttatagtagaaaattaaaaaagggttctatggtgtaacggttaattttatatatcatcttgactgggttaagagatgatgcccagggagctggtaaaacattatttgtgggtgtgtttgtcagagtgtttccagaagcagttagcatttggatcagtagaccaagtaaagaaaatacgccctgagtaaagagaatgtgggcgggcatcccccaattggttgatggactgcatagaacagaaaggtggaggaaaggcaaattattctttcttctggagtgagagctaggacatccatcttcgcatgctcttggatatcagagctctaggttcttgggcctttggactgtaggccttatagcactcgcccagccatctcctccaccatctgctgcccccctcatctcccagtcctgaggcctgcagattcaggcatagagttaagtatgccattggctcccccagtttttaggccttcagagtcaggctgaattacactacaagctttccttgttctccagcttgcagatggcacgtcatgggacttcctggcctctataacaacgtgagccaattcccatattaaattcccttttacatacctatatataaccaatgggttacatacagatataacctataacctgttggctataataatataaccaattggctgcatatagatatatgagggaattgaatatataacctattagttatgtatggatatataagagggaatctaatatgttaaattggctctgtttctctggagaactctaatacacgtagtattcgggaaacagagaaccaacactgactacctgtccccacaccaaggctccaatattgatcttcactcccacactgcctgctgactgcctcaccctgactcacaatggcttctgccttgaaactcctgcatgctgtcattcttcctgacagacttctatttccacctctttgttggtcatctttctgcagatgacccctcctttatcaccatcccctgctcaatcagattcttgacttttaaaattacataggaactttgttaactggggcctgcatagtctatgagctgccaaagacttacttcttagtcaaaaggaacataaagcaatgttggtggacaacctgggaagggtaaaatgacttagttttactttccttgcattctaaaggacctttgcttatattttgtagagatgatgaggtaggggaggtgacatggggaaaatcaatttcctcaaaaatggctgagaggggattataaatttaacaagggagagggaaggaactgcaccatcatcatcaccttcacgaatatatcagcttattaactgatcatggctatataccagacactttgcaaagcacatgagtacattatctcttccttattgcaaagaagataaagaatatccatgagttgggtattctagtgtccatttatacacaacaacactgaggggcataaagactaagtaacttgctacaattaattcaaatccaagtctgcctgatagactctgtgctatcctgccactcatacttctttgtagtcctcacaaagttttgtataaggtaggtgtttaatatgctctttatttatttaaagaagcatactacctacatactccattccttgaaatctatgcttcctgttttacttattccacaaattttgaagggaaaatgtttcacacagtagaaaccattaaaaaaaatgctgaacacataccaagcaaaatatctgaattagtttggtcctgtttattactggcctcaagtttaatgagctcaagttaatacaggtgaaaggccagggtgttacatgcagaagttaatgaaataccatagagctgctgagaaaacgattagcagccaaatgtgaatttaatatacttcatcttcaagaagcaatgccccatgggaggcatcttgctgggggaggtaatgtggcatattggaaacagcactcacttgggaattaggagatggggctctgatcttcactttgctgtcagctggttttgtgacctatggcagcctgatgactccctctgtgtctcagttttctcaccggtaacatgagggggtttgactacatgatctatgaggtccctcccagtgatatgatctgttttgttttcaaattcacaattagaattccttagggtttatgcctaggtggcatcacattgtctgtgaatgaaacatcagattgagtcataaattataactctttccatcctacttaactatagaacattctgagtctattaggctataacatatggatatcatggatcatgtttatcaaacttccaaggttggatgggttcataaactgttttagacttcattagtaaaaggtaaaactaaagatattgtagctattttacctcattactaaataatgaaatctgtatagaaaattaatagaactaaaaatatttttttaatgaaagctattataaatctgtatgaattgggaaattcatacagttcataactaacattacactgtaattatcttgacaaagtttgatgtctagttacaaactcatctgagacacactctatagaaaatcaaccacaaatattagaagtgaatataaatgataacaggcatgaaattactaaagaggtaagaataaaatatagatacacatgtggatgcatttggtacatattagagttttaggatttgggagaaaaaatagaaccttctactaaagcaatgcaatatgcagaatgatcattgatcttagaacgcagaaactagctgaatgacctggggcaagccacttgccctctgtaagcctcaattttcatctgtataaaacagaaataacaatgatcaccttgcccatttgttcttcaccacaactatttaaaataggaaaagcattaatagatgattaaaatacagacagctgttactattttgaaaactctaaagcattatagaaccaaagtattattacattgtgcataaatctcatttatgcacaatataataaataatgtaaagatgtgagtgctctgaattataaaaatgtcacagagtattaacaatacataaagaaagattttctcagcaacagtccttccagtgccttaggagtacttggatgaaataatttgcttttgaaacccaccttcaaaatgctactgctttcatggctaaatgttgcatagaatgtcaagggcaaaaaccaatgagggaaaatggaataaaaattgccttacacaatggaatggaagcaaaggaaaacagaaaaatgaggtgatgaggaaaatgggactgctataaatatggagtaaaaaagcatacaggattcaggctatatttggagcaagactaggttaatcaattttcttccatatttatgcaatatgatacctaatatcctcctatgcagaaacacctgttttaatcccttttacagcacaggacataaaatattacattttgatccatctaaaaccctatttagagttacagttcagagcatactggaatgaaatgatcatcattttgaaagtcaatttttagtagttctatgctaagcagcagatttatattggaaagaaaataaaaggaagtataagttttttaatataaaaaatatctttctaatataattaattagcatacatgtatgaaatattaaacatgggaaaatatattttatacatttggcagagtgctccacaaataatagcttctccatgcagctacagaatacagtaacaaacatccataaatcagaattcatctcaaatctaggtctcccaactccaagcctagtgccactccctctacattggccatgaacttcctgaagtttttgggctactgttttgcccaacaatacttaaagtttttggtgttttaggaaaagatactgagggaaggacctaataaactacatccttgggaaagactccttctttcagatgtatttgttgagtatttacaatttgtctagtacatgctatgcgctgaccattgaagacataatggagaataaaacagatatgatctccttcctcagggaatatgtaatcacttttagtgcaatagaattaaacataaacaatcccactcacctgcactttcaccctctgtcttctcttccactactaagagaggtatcctatgtcctttaaaagactccactcatggactccacctcacgtaccctgtgatcatctgaaggaatttgcttctgtcatttttatctttgactattcaacaattcaccctcatttttacattattttcattagcacacagatatactttagcgtctgtcatcctaaaaacaaatatgctaagcataacaaaacaatttctgtgaccctacagccactttcaggcatcattaatttacttcccttcaaacttcttttaagcatttttaatagtgtctgtcttcacaccttcacctcctattcactcctcaacatatccttttcaggaatttgtcctccattccaaacaattgaaatgcttccataatgaagctaacaacaatctttattgtgcaaatcctgtggccacatttttgtttgtgctcatctaactttatctctcagcatcattaaacttagttgacccttctttctttcttaaaacactatcctatggctgggcacagtgatttattcctgtaatcccagcacttcataggctgaggcgggaggataacttgagcctaggggtttgagaccagcctgggcaacatagagagaccccatctctatttaaaaaaaataaacaaaacccccactattctgtttttcatcctacgtcacttctaagtgtctcctttgctgggtagtacatacaccccaaatctctctacttttcaccatttccattgatatggctctagtccaaggctcaattgcctcatccttgggctactgcaatagcctcctaaccaatctacctgctttctcttttgacttggtataacgtatcctccttatagtagcctgagaagttgtcttaaatagaaactatgacagatgattcctctgcttaaaatccttcaatgatttcattgctcttagaataaaattggaaaacatcaccatgactgtaggtttatctggcccctgcccacctcttcaatatattttaaccactgtcccctttattcactacactccagccatattgttcttgctattcttgacaagtcttataagatcatatgaccttagggcctttacatttactgggtttttttttttggtctgcatccagatctttgcatagttggatccttcacatgttttaggactcagataaaatgtcacctcctcagagaggcactctcggaccacccaatctagagtaggcctttcaaatcacactcttcacatctcctttttaaaaatattcacatcgtttatttgcttacttttaaaaatctccaacccctctaaaaggtactagattaaaatgttcactaatcttatttactaatttccagaaccttgagcaatgcctggctcattgcacactcttgaatgaatgaaggtactgggtaattgtacatttatacacagtacagtcttgaacttagcttggcttccaattctggctccatttttactaggtttttgacttagtcgtgttttacttaacttttgtaagatctcagtttcctcactcataaaatgggaataatattttataaggttgtaaagattatataatttatataaattgtatagagtgaagccagagcttcatacacaataggcacttaataggcctctttgccatcattatagaaattcttatcatcaacattatttttattatagaaattctagcaatgtctcatagctttttattaactttgtgaattacttatgtacacagtgacactatattaatgtatttattttttaaaaatgtgcttttaaaatattttgccttgtgcttaatattacgatatagtaaacatttcccatcccttcagcaaaccatttctccagcatttataagggaagtcaatggattaagcatgttgtacgtgatggagaactgcttatttcacatttagactgcatacactgtataaagtcaggattgctcatacagttatgtaattttgtgctccacatgtttaaataagtaaaattaagaaaatgaagatttgatagttgacaagtaaatgtaaacactagtgcttaaagaatgaaagcaagaccattctgtagcctaaactagatgctgtcatctgtgggggttagggaagatgctaagatctgagcctgctaccatgctacttcacgaacatctggcagtgtgtcacttcacaggcaacaacatcttctctaaacagaagagacttgaattcatcagggattcctgtagtacagtatatgcttaagttaagtacctgctttcccgtgatttccatagattatcatattcatgacactgtggagtgaaagcattcttctcactctctaactagaacatgaaaaagaaattaaaacattggcaggcactttgtctccagtttgttggacaagtaagaaaaggactttccatccattaatgtaaatgaaattcggtcaacttagagcatttaaacaaagatgacatcagcctgtctattaataaattcttgacaggataacaattacatttgtagttgactgtttttctttcaataaatgtaggtcagtgggtatttttaaggaatgtatttaaaataaattcgcaaaccccaataacttttctcctcatctctgttaacccagaaagtaactttaacatgcacattcttgcttcttaagagtggttttcagaacattgtggtcaaagcctttttaacacatgtgactgtgtaattaaatatgtgtgtgcctactgtgcatatacacacatatacatacaatgcatatccataatacatatatggtatctatattctaccccaatattttgaactgaatcctatagaaagatttaaagctacagcgggctctctgttatctagggatggtttttccatttagggataatctgggcccttgtgttactgcttctttctgacttgtgcatttctttcattattgactatcagaaaggaaaggtaagaaaaggtaataaattgatctagctggttagtcctctagccttaggaatccatttcgtagaggaagaagaagtgaatttaatgaataaattgagtttggggggattatgtgtggaattcactaatctacctggcccaataccccattagttagatttgagaaagtaagtttctaaacagaatcaggatgagattttcaatttcattttgtggaacgtctttccaagacaatgtgttttctttgtctaggggagttttggagatggtatatgttgatatatttgaatatcagttataagtactaccaaaacagtgaataattttaccttcatttattacaaattaaaagcacagctctatatttcatcacatttaagatgctatcatacattgtttattaatacaataaacaagaaaatataaggaaaatatgttgtttaaaatattactaaaactttttcacattcagcatctggtaacttgacgatataatcaattgtaagacaaactgattcagaggtattaaaaatgaaaaaatgcatgtcttagatttggtaaaatgcattgtgttttctaaatacttactggctcagttctaagtctccttctcatcattgttagtagccataatacagtaatggcatctcattactcctagggcgatgctacatggaaattacatcatcattcctaaaaccctatttatgaatgaaagtccacattttggattataaaacttcaaaatttgccatcatagaaaagcaaagaataaaccttgttctacttccagcattatcccagaaaacgatgagtgactatcacaaagaaagagaggtgagggtggacattaccgtatgttcttgagtcgggttaagtccatacctgaaaacttctgagacaggtgtctttattgtttcttgactccattttcctatccatatctcttctactcttctagaggtatgtggtgctaaagaattttttaggttaaagactatgtacattatatatttgtatttgtgtcttctaatgtgaattcaaggagaaaatagcataagcaatatttgttccttcaaagaaactcaggatgtcctaaccattttataagagaatgatttccctcttgtatttctccatgaatgtctttgcatgagttaaatatttgaaaggttgacagacttagttatttctagaagaagtttctgttgatcagtgtgcaggggttaattctggcactgccccttagagatatttttctagggcagaatgagccacaaagagaaagatacacaggacagtgtcaatacagcatcactacgtcatttaatggctgatggtggttatggcagccaatagtctgaggaaagcagattttccctgaatgatgaaaaaaaacccatcatattcaataaaatcacaaacaaataccatatattcctgttaaccatccaatgatgaaactgtatatgtgaatacactaatgcattccttaaatgcaaattactgctaaatttctaagtaaactgtcttccacttcagagccattgtaatccatctcttatgtcagatgaactgtgagacttatccttctgatcgcataggatttactgctttttgtcattcatctctcacacttggtaatccttttacctcttccttccaagtttgtaatttaaatgcactctattcacaactgaaaaaaggaccatagtgtaaataggatgtctttaagttacggccaaagaagtcattactgcttatacaatggtgtgggttctattacacagaggacaatatgaggaggctcactcttcacttgctttcatcaatgttttgtgtcaacacacagaataaagggtgggtgctgaatttggggtcttcccttgctttgacttgtttcttatggtattgcaacattttgtgtttgagagaaaagtccttgactaccagcattggcccccatgagttcttcagtttgtcatcaacatggattctgattttattgtttgaaagttctaaaatagcaaattgacaaaattggtatttactcctgaaaatcctacgtggccatttcaaagagaagcacgtttagaagaattaaaaggtgcatgtaaaatgcttccataatatatttttaagtgaaagagaaagcaggattacagcagcacatacagtatgatcctaatatagtttttattatacttatgtattttcctaattttctacagtgagcacacactacttttataatgaggaaaatgttcttaaaagtattgtcttaaaagtcacactaacagaaatggttataaaaacctatgcaggaagaaaattacaatcattattatggtcacaattgttaccttatatgtttttaaaatatgaatctcaaatcgtaatttagaatggtagatatcaaagaaatgtatgctgtgggaggatgcatatgtaatgactacacagatggaaatatgataagtagacctgaggcccacttctaaaatatggttaaatacataataagtaagaaatgctcattcagttcagcaaagcactgcatatgtttgaggatatagattttttttattcctgagaatatgaaactcctacattttaggtctatatggggtgttggcaaattaatatcctccaagaattaaactgtgatgctaactttccaagaattaaaactataatgttagcttttattagagtgagttcttttctatttgcagctctcaaagaagaaatacatttaggaggatatacatatgagaatatttatatacaaaaacacagattaaaagtttgtcttcccaaataagttaaacatttaacttaaaccaatgtttgctgagcacctacaattttttaggtattgatccctctagctggctccctattcaatgagcacacccaaactgcctgcaccacgactgccttttaacgggggggctatagtgcatcttaccaagacacaagcttaggaggtccagatataaactatagctgatgtaaaatgacaaattggtcatgcacagtggcacacacctatagtcccagaacttcggggggccaaggaaggcagattacttgagcccaggagttgaaaaccagcctgggcaacatggtgaaacctgtctctacaaaaaatacaaaacttagctgggtgtggtggcatgcacctgtagttccagctactcggaaggctgaggtggaaggattgcttgagcccaggaggtcaaggctgcagggagccaggattgtgtcactgcaccccagcctgggcagcagaggaagaccctgtctcaaaataaataaataaataaaagatacaaatatataaatatacaaataaaatgacaaatcatggatttactatggaaatgggtagtttttctcacaggattaatttttgtacacaatctcctttctgcagtgttttatatacagataaatttgagttgtctttagatatctacctcagaaaatgctcaaaaaggcaactccaggccagtgactcacacctgtaattctagcacttcgggaggccgaggtgggtggatcacctgaggtcaggagttcgagaccagcctagccaacatggcgaaaccccatgtctactaaaaatacaaaaaaaaaaaaaaaaaaaattagccaggcatagtggtgtgtatctgtaatcccagctactcaggaggctgaggtaagagaatcgcttgaaccctggaggcagaggttgcagtgagcagagatcacaccactgcattccagcctggacaacagagcaggactccataaaaaaaaaatgcaactccagacccctggaataaaagcatatgacaggttgaatgtgctaacactacaaagtttccaaaataaaatctttattgattgattgactgaatgccttgtaattatcaagtgtcgctcatttatctgctgctttcaactatatgtgaacgtatggatgaagaaagacttcctgaacaatcttcactagaagatcgtttcagaaccatatgctaaagcaaagcttttttattgctatataactgcagaggacatttacaggaagctgggtcaagcactcttatcatgtttcttatgtactaattcaacctatttcctaaggtttacccacattcattctataaagttaatacagagacaattaggagaaagacaatccattgtatacatattgcaagaaacttttagtgtcgctagaatgtcgaagatgcaatttatcatactttctttagaacttttgcatctttattcataagtgaaaatggtctataattttggtctacaattttctgggttgtactattgtcaggatttagtattaaagttggtcaaggttcataaatttattagggagttttctgtacctttctataagttgtaattgttgaaataacatagaaactctgataaaacaattagctagtcagatgtgaaatcacttgtgcctgatatctttttaataataaattttaaaatttgcttccaattctatggatgattattgactacataatcaattttagtagtttttatttgacaagaaattactcctctctctagattttctgaccaaataattatatataacaccttttcactatttaattctctcctgcgtttgaggtaacagtagagaattaaaggattctgttttcattcttatagaatacatttttgcttcctttttgcttgagatttcattgtaattgtatatatctattgatcttttcttttcaaatgtcaccttttgttttatttttccttttctttcggttcttcctaagactgaccttgctgatgcaagggggaagtgacatcccttagaggccagcacatcgtctcccagtccaggcgggtcttccacccagactctgggcaccctgagctctcttgataatcttcagattttattgtgataacaccttctttttcccccttttgtttcccaccctgtcgttaaccttctgcttaaactctctttccatttctctttctttttaacatttttttttctaagccagaaacttttccaacatacaaagccatttaaaaacacacaggtagaaagcaagagataactataaagtagattccatgcttcctggcttctgcatggggcaggaactgaggagggcatcaaaaaaacatggttcaacaatataagctgcattgctgtttaagtgcctggaaacagcagtgcccattgaagagtactgaacgtggaatcaatactcaataaggagattcaggttctagggctttgttttaaatattttttctgccagattcaaaaattaactcttatctaaggaatcagtcaccaaatttcccttttactgtcgactcagaagtttagataactacatagaaccaaatggaagaaaaatattctaagttttataatcacatttatttgcttcaaaactttcaaaaaacttgtttgtttgtctttaataactcacattttggtggtttagcgcatatcatctgaggattgatgttgaatgagtaaattactgtgccagttgcaaacaggaaagaaaaaaaataatggaagaggatacaataatataataatatttagtgacaacgggagaaaatccctcattttttttcacagactttggggacagaaggttctttccttcaggtattgggaattttgaacaacaagcattcattagaaagcatactaagtgtgtgatttattgtgacttccagtgacataacagagctcaaacagaacaatatttatttgaaaaaaaagccatatggcagtgcattctataattctggcttatgaacattgagaagtgaatttttaggccatctacaatgggtctcagcactttagtatgtctccagaagtcaggtaacagctctccatgctagaaaaccattcaaagcaatgacatggaaattagcacacgagtgtcccgctttgcagcccagtcccttgatttctgtgatttgacaggaagatgatatcaaagactgcagaaaagtgttaagggacagctcaaatgctggtgtgtgtgtgtggtggagcaggtgagcagttaggattgtgtgtcatgggctgacaggagagggagtgtcaggctaccacgtgggtgaacatgggccctatcatagaaaatatgctttttgttaggattctcaatatctagaaggaggggcaacctttctggcatgaatgtgcaactgctgtgaggatccagtaaaaggtcttctcaggatttgtttaaaaaggtcagctcaggaactactgacccctctgacttcatcctgacagtttcagccctctcacaaaatcactcttgtcacttctagcctcctgtgcttttctgaaaacaaaaccctctaccacctgccatccattattccaccagcaagcaacatgcgctctcttcagctgatatttcaatttattcgtggttagatgtgcagtaatcctctgactgaagctgagggagcagtttaaagatttaaaacaaaacaaagccagtgcttcaaacatctcttcatgcaaagcttaccagatgcagaaatgtggctaattctcatccacacaaaagctaaacgaagacccgcagatggtcagtgcctgccctctgcagagggagaggcagggttggctccaagtaacaaataattatccaggccctttgtaaatcaagttgtaccacttctcctgtgagcatccacaaagacggctgcatatatttgctattagctccttctttgtctggggattttgttaatgccctttcttcatataagtttgtgtcgccttgttctcacatttgacaccaactgaaatagccttgcagaacctttgtttctattttcttcaaaatgtgtattcctcaatgaggtttcatcttaatctcttcttttcaaaaggatatgaattgaacatgcagagaatcagcctaacaggaccgattatcaatttccatttcctttcagcgcctttgccacccatgggccacctagacagctttccttgaagacaaagggtgtctgaaatggacaactttattttatataccagtctcttagcggacgacagagcctcatcgccagtaataaatccttctcctgacccttttatataatgcacagctgagctaaaaaggaaatcaatgttgcaattttaatttagcactttcattctgttaatttatctaaaaaatcctatgccacgactttaccttgtcaaaacagccaatttgtgtcaataggaaaatgtgaaaatgctctgagtctctcctctgcacccccaaccacgtttttagtagtatggctgtaaaaaccatggggcacatactaagccctccatgttttcctgtaagtacaaagcttcttttgcaaatggtgtgagctcagcaagttgaagaaatatggagggtctttagcgagaaaataatctgggaccacagtgttagttagctttgctaaagatgtttgtgaaactactaaaatggaatgccaagtgtctaagtatgtattaatggtgatgcctgagcatattagtcaactagggatattaaatcttgattaatctctggggagagttctaagtaataaataacactgtgttttctgtcaggggatcataaaataactctggttttactcttttctctctgtatttcacaactctagaataagccagggatagaaacttaatttactctgggaatgatgctgccacaggagaatgaggtcaactccacaccacactgcactagtgccatggtggagatgcagaggggtggagcccctgagcaggtgaggacctgctacctttccagtaggaatcttgtgtcaagaaattgtttcttcaagcctttattcaaatatcacattctcagtgggaactttcctaatcatcccattgacattaaaattcttccctgcctcctgccactcattggccttcactatatcccttccatgactttttcccctcttggcacttctgactttcaatatcactttataatttacttattttattatctatccccattccaatgatatgtaagtatactgctgtttactaaataatcctcagggtatgggactgtttttaacatactgcaggtgctcaaaaacatgtttcccaaagaattatcatgaggtcacttctggccagttgtttcttgggtgcaggaatggctgcattatataggttgatgcatgtaacaactctgttggaaagaaaaccacctcttgctttcagggtgcttttgaactctacaagagctgaacttggtacgggagaaggagccaaactccaaatccagggtaaggaattagcccaaaggtgggcttataaacagagtcagatcctgggacttatgtgtggctgaaataaaaaataaacctagttggtttgggctcgaaaaaaggcttcagctattagtccagcatgctgtaagcaaagtaattcaatgagggccattatagcataggtaccatgcttggcactgtaagacagacaacatcctggcctgggtctgcaagtagattatgatctagggaagtttacatacatgtttcagtctagagcagggcatggaatgtattatcatgggaaatcaaggagggtttgtccaagattcttgaatcttgaaggatggaaatgttttcagtaccagagatgagataaatggcattcaaggcaatgagaatgctgttaagggaagcagaatgcatttgaggagtagcaattagcctcatgtagcctacttcctttgtagatgtttgctggagtacggatgaaaagagagataattctagaaagataggtgactatcatatagaggctgggttttacatgttgtattattttattgggtaaccaggaatagctcttaaagaggagacagacttcattcagaagcctgtgctgtaggaaggatgctctattttggttttgtggcagtgatggggctagggataaatatgcttagtcaagtaaataagtatttagaagtactaggctataaagcttaagaactatggaatctatccaacttataactgtaaagcagtaaatgtagaatattctagaataaagagtcatacacttacatttcaaagacttcccatcagagactttgcaattttgctccttattctttctagtattcttaatctgaatggttaagaattcttcaaatgaaatctctttaacttaattataaccaatttcatcttatttcctcatatatgtacgcagataattaccacatggcattgcgaaaagtcagcctgttacatgcctgatgatactaagcaagtctactgttctttaaaaaaatgttgctttaatctttccttatatcacttactctatcccttcagttaaaaaaagaaactcttctctttactccttgctatctttatttttttttcctgaatattgacaataaaactgtatgtggacctgagaagaatgtgactactggagagactagtggatgatcatttcttgactcttttatgcaattgactttttagttctcaattgcactgctctgattagtcaaattaaatataaggttgcctatactctcagatatttttcttctatacttggatctcgttagatcagaccatcctctattatctttaaagtaaaggttaactaccatgtggccagggaatagtaaaacatgatgctgacacatttatttcagttttaaaggaaaaacctcagttttcagctgatgaaacataggctgaaaatcctaatgctaaccataacattgtaggttctcatttgaattccaaaaattgggtatctttacatagaagaaacatatttactctatatgtcggtcagtactaagatatacacacaaacagtttaccacacttcctgtagacaaaatttatttttttctaataaactctgcttctaacattaaggttaaatttaactagttcattgagactttgttctttattgtcctctgaaattggtattatgctatcaaataaatataagaaaaacagtaaaaattcatctgagtagggtttgaaatatagtaccttcaatagcccagaggactcacttacttttgaatctgataaacaaagtaaatatatgaagaaaaatatatatgctccttggcatcacatttatacactagcttatttacaaaatttttctttattggtcctttgaatgtaagaaaatccacaatctagatgcttaaaaaatggatgagaacatttattaagtaagaaaatatacatggacacatatatatgaatgcatatcaacatttacttttggttttaattctctcatttatctttcccaaatttattttatagtctatctaatctttaacagattttttgttgttgttgttagcttcattacaacatctgaaatatccaatttcctctatagttgctgctgtgtttcggcagacacctttattgagttatcagaggactgtgcaggttctgagccctgcagcatacagagtagcctgggtgattcaggtcaatgtgcaataatgaatctgggtccctgccaaatatggtctgccattgtgaagttctatctctctgcattttaaatcatgatggttttttgcatttcacttttccatggattttgcttcattaaacaactttggaaggagtattttgcactctcaatttttgcgtgaaagtcactgattaactggtgaatttatggtttgaaatgatgcaaggcctgatctgtaggaaccagaggaaaatttcctaatggacttcttcctgattttaccaaagcaaatgccctccacccccgccctgctctaaatagcacagatttctggtattttaatgtgtcattagtttgaccagacagattttagtccctaataaaataattctcctaactcttaggttatttatttcttaatactttgttgtgagataaggcagaaagacatgctaactgagctgcaatgcttcaacattatgactttagtaacttttctgagtaattttaaaaacatggagagctacagttacccaaaaaaacagttcaaggaaacaaaaggactagatttattccaagcacaggttcagtaggtcagtgtccacataataatctgtgctttgtattttccattatttcttttaacatgctttagtgtctacaaaggatgaaagaatatagactccattgtccacttggaatttaaccttcctatttggccagctactaggcacaaaatgtttgggttcagtggatataagtccactgaggaaagttagatgctactaaaattttcctgcatctttgcacaccccggatgatctatcccaccccaaatatttgtgcatccacacagtgaatagtttatctgatctcctcatagtgattttctggattacctttgctttatgaatttaagaaagtcacttacttctttttatctgctaaccaagaggttcataaatattctctaaaaacctgtgggctctaacatgggaagttagagagtacgtacttttcctagtgggtatgaaagaaaaactctaggttcaccctgaatagcatctggagggactgaattaatacagtaaaactgcaacttcaaaactctttttttagaatgttaatttaattttgaaacctttttaaaaggcttaaaggattctttttagataaactaacaagtggggaagaaataagccacttcttttgggaagttatcagtggtttcaggaccttgcagtggcaactggattttcagaaaagaagaaatattttaaaataatcccccatttttgactaagataagactgtttgcttgtgaatggagactcaacatgtataacatgtctcctatttatgtggatgaatcttgttttcaaaagactatcttgatcacatgagatcgtttttctcaacaaaaaaacagaaaaagtattacaccatagatgttctgatgcattttttctcactcatatccaacatctcatttgttatagaaaattaagtagatttgagtaaaaaggtataaaaaagaaattccagttttatgactttctagtacttataattattgtaactatgctgaatacttgcaaaggcctggagaatgagactcagtttactcaacaggccagaataagccagagaagcaattgctatggtctgactgtgtcctcccccaattcatatattgaaaccccaacctccaaagtgatggtagtaggaggtagggactttgggaagtgattaggtcatgagggtgaagtcctaaaaactgaaattaatgccttcataaaaaagatcttagaaagaccccttcctctttctaccatgtgaagttatagtgaaaagatggctgtttaggaaccagataataggccctcaccagacaccaaacctgctagcacctatattttggaataaatttctgtggtttataagcctgatttataatattttgacatagcagtctaaactactaagcaaaaaattatttttatatgaataggtacttttaagatagtttaaaatggttaattcggtttagtttagaaataatttatatcattcctttcttttgagatcattactggctaagtacaaaaagtaatttcaaaagtaaaacttttgagattaatagtacaatgataaacttcagccatgctcttgtctgacttgtcagaaattcccaatttttaaaaacaagtgagatttgctgtgcgtgtgaggctctttccagaactgctcttttggccctcattcttatggatgtggtattcagtggtgaatccaacctccacacatgagtatttgataaatttgctcaagtagaacttctagatgtatctgacacttgttcccatcctacttgttttttaattacctatagattataaggcatttttatatacatgttttattgaaagctctggatcttaacaaagcaagcacttgcttggatttgcctccctggcccctttctccacttgttcacactcaagcttgtaccaaatcaaattccttgcaggcccctaatgttccattacatatcatgcccctcagtctatgcacgtgcatgctgggtctcatatacccttcctccaacataatctaataggtgaatccttactatgtcctaggtcccaccttgatatggccttctccaggaagcactccctgatgacactcacttctatcacatctgagattaactcattcttagtatttactacactatactgagtacctgactttccctcaggcctaggacagaatcttgtaatattaatagcatgctgtctgtcacagacaactgttcaaatacattcgttgagtaaatgaacaggtgaatggtagctaaaacttcattttctctttagcgtgtcttttgcacatgatttccacatttcagtttttcttaaaattccctgggaacagcatcttgaaattttctcaaattttatattttctttaggacttttgtaccttgctctgcctgggcagtcctttattcattcaacaaatatttttgagttgtgtttatgtacaaagtactttacaaggttttctaaggaacccaaagataaatagtacttggatgttgctcacaaagggcttacagtctaattgaaaagggaagacaagtataaacgtagcaaatggcaagcttcatacaagggaagtgacacattcaattggaggataaggcaggccttcttggacacgaacaaggcctgacagcatatgcaaagtctggacattacagcataaagagaaaagacattccaagccgtgagatgatgtttgtgacaaagaggaaaacagaacatggaaactacagatcaaagcctgactggacctcagtgtttatgaagaagggtagcaatgctgatggtatgttgaaaagggagcctgggttggtccaggtaggggagggtcttggaagttacatttttgtaggcaaaggagactagtaaaagcttctgtgcagagttgtacatctctcattggctgactcttgcttcatcttcctacgcagcatttctgtacctaactcctttttctatgaagctacagaaacccctcgtatcccattccacctccttttcctattattttatgacattctaaataattctagaaattccaacttgaaggttgctagaaaggtattcatcaactcattttcccccatcctcattaagctctattacttacatcaggctcaaaatcccaacaattagtttctgcagtagtcccctactggcatctttccagtactaatttacttgctacagattatatatttttttagttattttgagacctttgacatcaacatttccatttctggagccatttccttgtcttacagctcctgtattgtttcttttttgaaacaccaactcatggctaaactccactgagcatcttcttggattatgggaagagtatattaaacagaggccattatcttccacacacggttccatgtactgcaataacaaaccatgtatgtattgctaatcttgcacagaccaagtacatagcagtcggcactcaataaatttgttgagtgcttaataaatgtgtgaatgaataagtgttggttcatgctggagtgcaggttcctcagtatcaagtattagtatttctattctgtatccttgaacactctcactgaaacaggcactaaataattctgattaaatgaatgcattaatcccttcagaaaaaggatgcctgcagaaaaatcccaaggaattgcaaacaagatgcaatgcaataagttttctcaccccaaaatatgtagagcatcatatatattatttaggctattacagaaacatacatattcttgagttctcatttactgatgcctggcatatatgctttcaataaagtatagccattgctgatttttttttaagcctgactcaaaggcttcatgtctttgaactaaacaagagttccgggtttttatgacttatacaaacaaacaagctgagtgtggttagagttatccgtgcctaatattttaattccattgttcaataattccaattcctttgcattagttttgctttagtatacccttataatactttcaaatatatctataaaactttacagcccttttccaatggcatatggtgtgtgttctgaagagaaacatgtttatgagctgaaagatgggaagaaaatgtaaaatgctcttacgggactcggggagggattgctgcctgcctgtgtagcaggaacactgcagtatatcaagactcttgcagactgaacagaagcccttctatttcaacaatgagcagaagtctggaattgtgctatgctaactttgatgctattagggtatttttgttttttgcttttttctctcctaaagattaaagtaaatatttcctgaaacaatatttgaatactgtatgttgtaggatagtatcaactgagatggagggaaggagagaaaagtagagtgtggatggaggagtgacaaaaaataccatttttctgtcctctcccactgaagcccacccaaactttgtccaagccggagcttgcaacattgttccttacagagcttatctgtagttattcttggaaacatgcaaatactcattctaaaaggtcctgctgtattcttttttttttttttttatggagtcttgctctgtcacccaggatggagtgcaatggcatgattttggatcactgcaacctccacctcccagttcaagagattctcctgcctcagccttgcaagtagctgggactacaggcacgtgccaccacacccagctaattttttgtattttttagtatagacagggtttcaccatgttggccaggctggtctcgaactcctaacctcaggtgatcctcctgccttggcctcccaaagtgctgggattacaggtgtgagccaccacacccggtcctgctgtattcttaaaatggtcatttgctgagtgctagattcaaattttcagttgcctcatatattccatcttggtcttccttgtcacgatcattgatatatagtaacacagctgcagagactagaaagcttcgtgtgacctctgacttctttgctgttgcccctagttggtcaccaagcacagtcattttcctctcccatctctctcactcactcttccccttcatttccgtggctcttccgcaggtttcaggcccttgaactgatctcacatggcctattccaatagtttcttagtcagtctcttttaatgctaggcttcctcactcaaattaccctctaacatgccaccacaagatggttatttcttttagaaagtctactgtcattgcatcctattgtagcatttttattctgctttttattatactttgcagttttaactcctgtttgcacccagtgactgtaaactgcatcttcatgtcatcttcaacatctccgttacccatttcacagtgtgttttaaatagactcaggattatctttacacagaatgttggttttgctcacgaggattctcctggtccataccctgacatttctaaatgtccagcctttcctgttgatattctattagaaggtaaaataaaaaggcactcactgcctttaaatagcaatacaggaaaatttcactgctactctcatgttgtccaccaccgagtcttgagcaaacatagatgtgaaaataaaatatttaaggagaatactttgaaggatccacttttctgaattctctaaattttatttctaggtgttctaaatttaagctagatctttagagatctggttagctggagagtcctttgcaaaattctttccatggttacgagtgagaaaagaaagtataaaatgctacattatggaacctgttgttgcatttgtatcagagatgtggttctagaacaaagtatcttctttgtatggacacatcagacatttcttgagggaatcctaccagaaggagatgctctttacctcttctattggtttatacctgtaggtcctgtggtctgcatgtgatctatatgtgattgctccactttttgcattagttactaggctgctcagagtattatttttaaactccctttattagggatatcatccctactactgataatatttagcttatgacttacatacacatagatactaactctattccatctccattttatctttttcactctaattcctaccatctgatcttttcctttcctttcctctcctctatccttttcttttttccttccttccttcctttccttccctccttccctctctccctctctctttctttctttcttcctttctttcttctttctcccttccttccttccttccttccttcctttccttccctccttccctctctccctctttctttctttcttcctttctttcttctttctccttccttccttccttccttccttccttccttccttccttccttccttctttcctccctccctccctcactccctccctccctctttctctctctctatctatctatctatctatctaacttctgcatgcccagttattacttaattactgaaaatcattatgacaagttttaagtatgaacagtgtttgggaataaatgaatatgctagtaagttctatttcctgtaaaggcagcactttacacatagaagatgctcaagaatttcctgattggattcccaaaatttcaaagcactaaaatatatcaaaaagaaaaaaaaaaggaacgctacaggtcagaggtaactagtcatttgaaataacctaaattggcttttggtcaaagttgagcacaacaatatggtactcatccttattggctttcatctattcttagtgagttatattccctaacttgaggtaaaaagtgaggtaatgtgtggtatttttccctgctataatcctcatacagaatatctgaaagagaatggtacttttcatgcatgtaataatacccaggcaccactatatcagctaactttgctagatagcagtcacaaaaaggccattaatatctctcttacctccacctgagaaaggttagtgctatgggatgtgcacaagaagaagatcaaagagcatgcattgctggtccctgctatatgtcagagcaagacaactgaaatacactgagaaggtcaagagcagtggaagctgaagagataactatttgtgtgtgtgtgtgaatgtttataggatctgaagaaacctgagcacaaacgtcagtcttcatgacctgatcacatatgactcaatacagaggtgaaatcaaggtgctcctactgaggagttcaaagtagagactccgaagaatgaagagtgcaatacgccaaggcatccaggtcctaacaggaagaaaatccatgaacaaaaccagcaatgaagaaaaaaagatcattcaaaatggaataattttagtttctagggttacctttttttgtatttttcacataacaaaaacttttttgtcacttattttcctttacttaaatgattttgaaatgaagacaaatggttgccagggtgcctacaatttaaaatatgtctgaaaaggtttctgtggcagtcccaattactgagctattaaaagtaaacacaactaaaaatttgaagaatatgcagaaagaagcctaggaaaatgttgattttgaaaaagcaaaaacaaaccacaaacatatttttaaaaacacacatacacaatgtaattcctttatgatcctcatcagactttcctacatctcagcattctttaggtcagtcagtcaaatcatcgctaaagctttcaccaacaggaacatcgttcctggcgttaatacttcagtgtaagaactgttactaataataaaattttatatactaagaattttttcctcaagtgatatacaaatgcctctacagataaatacaatgttgtatcttatcactaatctattctaccccacattcattaacatagctacggtacagtgtattgggttaggaaatgaatcagatggaggaaatcttcacagctccatatttctaatataaaataggaattgtgcataaacattttgtctttatatttttcaaatataacaataataactatagaacatttgacaaatggagaaatgtaaacaacaactactacataaatttagcactctaaaaattctatcataaattctatcattcttataggtccttcttccatctttttcatgtgcaaatcatcaagatgaaaaatgacttgcatatgtttgatcattttgcattttatcattaaaacacctgatccaataaatttactgtaatttaatcaattattttctatattgctcccaagtttttataatgactactatttcattagtaagcaatgatgaagagaacttctatatgcacattaaaatatattttggattatttacttagagttaattcaaatactttaaagaatttcttttccaaagagctgaacctatttctaaagtcatcaatatttatgacatcaacagtttcaaaccaatacttgatatttcttaatataacatgaatattattttttttgctccgttggtatgtgatgaaaaagtaaggccttagttttcctttcaattttttaaaaaactagttagcttgaacattttctaggttcttttttagatgtatttcttgttttgtaaactgactatagagtactaagatattttttaaaaaaatttagcttagccttttataaaataaaagcattaattctgccacacttattatatttttcccgaaatctgttgctagcctttttggatttgggttatatattacatacataaattttacaatttattaaagcagataaatatatttttggtcttctccttttttaattgctttctgatagtgataacatacaatggtatcatagctttattttattctactttttttatttgaaaaaataacttttttctctaacttatgcaggggaatctgcttgttagtgtctttttcctttttgttgcttttaaaaattgattacctatagaagcttggtaaatattcagttttattttcttctacatgtactttggtttgtttttatatctaactatctaatcctttgaaatttgttttggtatatggtatgagacacttttgatctttttcttctgtaattgctataccatatcacagagcacactgcaatttaaaaaatcctttcccattgttgtatgaaaacttctatgatacacattgacctattaggttacattttttatttaaaattatattgtaggcctggtgcggtggttcacacctgtaatctcagcactttgggaagctgaggtgggcagatcacttgaagtcaggagttcgagaccagcctggccaacatggtgaaatcccgtctctactaaaaatacaaaaaattagccaggtgttacggcatgcgcctgtagtcccagctactcaggaggctgaggtgggggaatcgctgaaacccgggaggtggaggttgcagtgagctgagatcacgccactgtactccagcctgggtcacagagccagactctgtttcaaaaaaaaaaaaaaaaatatatatatatatatatatatatatatatatatatatatatatatatatatattctaattatattaggtagagactgttaaggtgtaagtgtgagcagcaataataagctgataataatgtctttatcttttaggtaaagacttatggccaagctagggttttatatagctggctctaggctgaccataagttttcaaaaaatgggaagaacatcactttcaacatttaaattgagttattaatgtatttccatagcgaaaataaccctattaaacctgagtataaatatttgctttcctctgaaaaatgatcagattaaaataagccagaatttggtattctcacatcgtatgtatgagcatgagttctgaaacagattgcctgagtctagctctctggtctgctaccgacaggctggatagtttggcaaattatataccacctttgtatgctactttcctcatacgtgacaggatggtaataatagtcatgatttcttgcagttgtgataagaattaaatgaattgaattaacatttatgccattttaccaagtttggggaggaagaggaggaaacgtgtcaacaaaggcttccttaaagagggtgaccatttggttaaatcttaaaatatcagtagattttcactatttgaatgttctattttgacacgactttctgaagttggtggtggcccagttagcagagaatttttactacatacttttaaaggttcagcgcagctctgcagggccacgtgagatgttgcttcttattagtagccctcggcataatgatgaagtaagttaacgttgcctttgacacttaacctcctctcagtgaaaccaaggtatggatttgaaagtacctcagtgttgggagtttaaatagaaaaagatctgataaaataatttacgcaaaggtgaacagtacctagtgggttactctttccaggtggggtcttatatatatatattttttttatttaaaaagtgttttggagataattgatattttaaaaaatcagcctaaaagacagcttaatccaccatttttctgagtttccctaagcattaagtttggtcaccaagaagcaacgttcttagattttattagcttaggttcactcgagcatacttcttttgagttgatttagctaatccttagctttcactaaaaattgatatggtataggtatttgaaagacacttttgtatttttcacaaaaccccggctataggcattgtacagtaaattattaagtgttcattaaatatggatccatgtaacaaaattttcccaatatttactgccaggagcaaagtgttgtctcttaagacaaacctagacatccccttttatcagaccatgagagctataaaactcatgaatttctttagtttcttggctaccaataagtttacagcaaaacatgatgtcctgttttaataatatagcttatcttttgtttcccatacaagcacttcttgctttctaaataatttctgctgtgtcttaaattttaaaaattttattacctttaatgttttaaattggtaaactactttaaaagacatgtaggaacatgagtggaatagttgttgcctgtgttcctcatttgacccttactaaatattaatttttaaaaaatagtgtcttttttctttccaagtagatttcaaggttttatggtagaacaggatttcttgttttctatcctctatactcaccccacatgggtactcaatagctaaattgattgattgatagctgtcttttaaaagcagatgtctagacaggatttttaatgatggaccttgttaaaaaatgatggactaatagtggaaatactaggctgagagagtgtttctgttatttttcaaaattcctctacaatggactatggccattttctgcatgcaaggaagaacacagccaggatcaccgttctttaaatcagaaaggactttgatagagtccagttccctcagttcaaatgaggaaaccaaggcccgaggagttactatcattcccagaagtagcgagctgagtcaatataacgttaagactgaaatttaggcctccctgttgccagtctgatgttgtttgatgccaatccatttattcactttctgcttccacacaagaatgacttgcataattttaaaggttggaaatccagcatgatcctaaatcagagtctccattcataaaactctaagctttaaaaatgctaggaatcattacacaaataaaatcctgagcactcattgtgctatgctttgtgctaaacatgtttcttttttccatatagtcttcgcaatcaccctatgaggtcagtactgttattattcctgttttaaagacgagaaaatgagaggcatgtctcatgtttagcactgggattcagtggcactctcctacactgtgtggactgcctcgcgaatccagtcatgtatacacatgtgtgtgtttttccttttggacacgtaatgagattttttttcccatgccagactggggtatcttagtatctctctcatggaattctcaattcctacccacctaggtttttccctggaaacttcctgccatcaaagcaggaatgatatttagtgcttcagtattagaaggtcacaaattgtgctggaatccaagggagaatcacgtatttggatgaatcacgaacgaatagtctgaacttccccaaaaacactgtcagtaaaaataaggtgctgccattaaatgacacctttaaagaaggcaagaacgcaaatttatgacaagaagaaagaacttctgagccaaaatcagctagatcttttttgtttttttcaatgccatccttgacactggtaaagagtagtcagctaggtatttgtcgactagaaagaatcgttaaaatggacaactaaaaccatcatatttacaagtgacacaaatcagaaattgttggctaacaaatctccttattccatcactgtgatatttgctaaagctgaccacctattaatttttccagtggagcctaaggatatagcaaatgccaagtaaatagttcaatctgaaccaggtttattgttcatcggctggtgctgtggtactgtgccgtgcttgtgtcttttgttgctgtggaacagcaggccttccgggaatgctaagaatacagtgtcttcccagagctgattacaccagacacgggcctcaatgatgcatggaccagctaacacagtgccacacaaccccacaatgctttcagcatattcagtcatctgcctcggagagactgaaaatattactattgatttggcttggtgtttaatgtggttgttaaattttaaatccctgtacaatgaccaatactttgggtagtaatgtaattcttccaggtttatcatctctcttgaaacctgactatttagtacattgtgtagcattaaatttcagacaggggaataggttttaataacacaaacacttaataaaataactttccatgagctttctcataatggtattaacagggaaagacaatttctctcattgcgcttctctgcagacattctgtcggctctgtatctccatcagttttttcataatgtgctcttggcacacttactttaatattgctggtttgagagcactgtcttttttatccttgtcactaaatgtgatattttgagcactcaagatgcgctgcaagcaggcctaaagtatttatattgaaactacaatggcaaagcatgtaggatgatctacctctctgaaatgagcctttaggaaacaacttcatcttgggaacatctctggctacacaattgtaaaaatgggctgataattaaagtaccagggaacactccttccatattcactgtttataagcagagtggtcttggtgggtgcacaccttaacataaaggaagtaatacttacatcttgcttttgtcacaccgaggctgatatctccactaagtacacatccctaatccaagacgttagcaaacatatctcttatcagcagtacggctttcacaggcttttttcagtgtccaccaaccactttccattctggataaaggatgttagctaggtaagaggataagcacagttgtaatctggatattcaagctgacctaatggtagatgctggatgcacactgaacctggcctggcggaaacctgtttctatatgagaatggcatgtggaaacagggacagatggtggggtcagtaataaagaacttgtttgttgttgctgattggaggccatttcttctgccagcatgactccacagatttatcctggcattggtgaccaaggggagacaaacaatgttgttcaacaagcattctgaaagctaccatatggccagaaggaaatctctggagaatactaggatgtgctgtgttgtgctacactgtggtagtattgctcttaagcagtagggggcatggtgagttcatccggttagaagtataaatagaagtaactgaaaacagcaggaaatataatccggtgagcttgcgagctggtgagcagttgtgttgtgggctgcttttaagattatttgcttaataaactgcattagtttcattcttttgcatttttctcgcaaaaaatgttcataaaggttgggttctagggtgacaaagtgttgggaaattttgttgatttaaaaaacataaatatgaactaataagagagaagaattcatgttagtctagaagcttagttaattgggagtctctagaggagtcactcaagatagtgtttgctaattaaggcaatgcattttccagggatttggagaaggaagagctctcctctggctttctgtctgcttatgagttactgtgcagcaccagtgacgagctttcactgattccagtcacatgactgacttgggtagatgtattccaccctcataacaaaggcttgtgggtagtaaatattacctatcaaataaaacaccaaggtaattccagttaactcttttcaggaattctaaaattttgtcattgagtttggtcctttcgaaaaagaagtctgccagaattggatatttcttttttaagtttttggattagtaaatcttatccaaaatgtaaattaatttcctataatagctccaaattaagaattctacaattctgttgatcctattctgatcgatgccagattcggttcatcggtgatgaacaagtcagtcatggtgcctcagattccttccatctcatttctgatgctgtagctggatttctctaattataattggatcacgccagtgggatttttagaaaactgcaaagtgttttttgttcttctgagaaacaagttataaaaataaaaaaaaatttatgtattctgaaaatggcttcacaagatgaatcttttaaagaaaaatcaaaacattatgaaaaacctaataacactcataagtttagatatgcaaaagaaaatgaaacagtattaaaccccaagactgggttctattcatggatttaaaaaatcttggacctgtctttacaaaacttgagtttaaccaactgaagtatcattacatccttggttttaaacgtcattaccacactaccagatatttctagactgaaaagattttttatgtttacgaacaacagattaaaggcaaaggcagcattattgtaataggatgtcataagatgtttctcagtcttagatgaggccccaactatgaaaggaatgttggcaaatctccttctttctaaaggtggatcaggcaggacttggtgagatgtgattcaaatttactctgtaggtctgggatctttccctgtcacccatagctctaaggagaggcagagaagacactggagaaaagattatgtattgatagcccagaaaaagtgctgtaattttctctgctctctcctgtagaatgttctgtttccgctacctcaagccaagtgacagaagacactctaaatacaatcaagagtggggtacttgcccaaagaggcaactgacatttttttttttttttactctgggctacctatttgctacttggaaaaaatctgcctttatgggacacttgctgactgtagtgataccagtcttagcaacctgaacatggacatgcccctgggtgcttgggtgggtagctgtggagggttaaagtaaggaggctggtgtctgactactgctgagaaaggcctgtatgtcagaggttggttgtgagggttccctgatagtagggccagtagaggtgtttgcttatgatgacagagacaggagttttttttggggacactctggaaagctgctgcaatataactacattgaaagccctgccaaggagaggtaatcccagtagaaagagacttcaggggtgaaatgccgaagcataggaaatcataatgggcagagcagaaggtatcaccagggagacagaatgggaggctctgaagatcccacagaggtatcctttaagaaaaagagttggcacctgccctgattgcatcaatatcacaaccatgccataagagcactacacaatcatcttttagcctcatatgcttcatcctttcccagcacaatggaggaatcacaggtgacatggagaagtggagaagaaggatgggagagggaggcagaagataatcacagacgacctaagcatccggccttttctctactgatgctatagggcctagtgcaggttaaagcagagattgtttaaataagaggagagccacaagtttcctggctggactctttattatctgagggtgttctaatgtctggaagtgatcagaaaaactctgggattttatccatagccaagaagaggagcttagtgggttttaagagaataaagatgtttctggcttgttttgaaagtgcagctcatttggtacactataatactgttttttcccaataatcaagtaattaatttttgtgtgatgacatgaagccaaatgtaagtgtgagctgagtggatcatacgtctaatagatctgtaaacatgaggaggtagggaaagttcacttctgagtacatatcacatctgcaaaccttgtcatagtgatccaaaatggaatgggaagtactgaagatgtatagtgatctcgcttcatgtaggattgtgcttgcattttctaacacagtccctggcatataatggaagcttaataagtgtatgccagaccgaactgggaagctgggaagaccaagcgaggcacgaggtgcatagaaggtgactaacaggttcttgaattagaagggaactaagttagagcatgagcatggccactattcctctactctaccttacttacctccctgactttgtctcttattactccccctatctactctactccagacaccctactcttggctgatccttaaggcttttttactcgctattccttctgcctggaaatctcttctcacagacatccacgaggcttatttctcatttccttcacattttgctcatatgagactttctctaaaaggtccatactcactgctgtctaacctttaaaatgcaacctgtctcctgacttccatacttttgagctcccttgccttctccacccttcctgtttacatagcccttatcaccgaatatactatcatttattatctttactgtttgttcatttttatctcttttacttaaatataagttctacaagggtaggttccttttttaaatggataaatcccaagtgtctagaacagtggctgacacatggtaggaatttcagtcatcttagctgaatgaatggatggcaatagatgcccagaggcctctgtgtcgtgttaactggattccatttgaggcattacagaaccctccggggtcaggggaggagttactgactcctttgccaagtagccgcagtacatatccacagcctcctaccaaaatcagcattctgggtattctagaaccacacacgaaaactgcttaggaactctcaaatcaagtagcaggtcaaagaactcctttgattgactctttgttaggctgtttggagtaggatgtactaattagatttggaagcactcaaggtttatactttgagctttatccccatagaatgcagagagaatagaaatgtaaaccctagtaaaaattaaaataaattaacagaatcaatctagatagttcttcaagtcaacttgcactcaaagagtattgggccttttatggtgcaaataatcatattgtacattagggataagtaaatctatcttcagttagactttggcaagcatttctgcttttaaatgtgaaaagccaacttgaaaattctgacaaatatattttatagaaaacttcatgtaacattagaaaagaaaaagaaactagtttccttcatatggttctactacacatatagaattataaatacatgcgaatctctctttttctcaaggaccaaagaagagaaatgaaaagaaaaacaagaaaaaagaaacaaaagattccagagatgttgtcagtctctttcaaacagctcattctttggaaagcatatctccgtcagatttcattcttcatacttgtttcactttccttcatcagtagtagacttaaaacactgttactctctttataaaactttacataataatctgttatttttttttacagaaaaatagcaattcctcctcagccattctttgttggctaaactaatttaatttattctgtaagctaaataatgccagctctttatgcccttcctgactttcctgcttggcacttgaatagtcttgattcttttaaatttggttcttctaagattttctgatgaaatttgatgaaatattttgatgaaatatttgatcaataattctttagagacttatagaaaactttcaaaagctattgctttcatttttagtttttctcagtataaaatacatgttccttaaagaaaactgaggaaatatagaaaagaaaaagaaagaaaaattaccaagaatttctgctttcagaaatgtctggtaatatatgggtattatcatagcttttttttcctgtccacaaatgcatgctttttttaaataacaaaaacaggaattatatttagatatagcaaggtttcttgtttttttaacttaataacatgagcatttctaagggccataatatactatttttaatattattatgattattttgaaaataagtcactttcattctaccagggatgtttggaacaaggtgtgttttggaattccttcttgctagaatggctatattggaatcctgtagggcatcttgacatctgctttaggcacactgaaatgttcaatggcaagagtatttaggactgagaacatctgaccactcagagcaaattatttgaacttctaagtgaattaacccacaaaaatgacttgataaccactatctaatgctgattgagatatcgaaaccacttgtccacaggtggaaagagcctccaagataagtgaatctagattcctgagtaaggaaatttagtattacccagtgactgtaccaattagatagacccttctacctacagactcagtgtcaacctctataaaatagtaaatataatcctcacctcttttcacacaggagtttcttagaatttaagtttggcaaacactataaaaaatagctctgagtcacaagaaattgccatattgccaggctacttagctatttattacctcacacttttagtgtctgaggtgagtcaactttaaacaaaaaagcattttgaaaatggattttacagcccatcttcgtaaggccatttcttatatctcatctttcaaatttcatttgaccagaatttgggcaaagagaattattcttaatacatttgtaacggctgcttttatgtgtcatcaagaagagttgttcaccagccaatggtaactgactcttctgactctttatccccagttacagaccttccgaacaaggaaattattattcttgccatgattctctggtcatcaaaccctgctatgcatcaccatgaaacaaatatcaaataaaggataagtctcaggaaaaccccagaactggatttcaatgctcagatcctgaaaaagtattctctgattttaagacatttgctgattcaagtgactttttaaagcaaaaagacaacaaatgggtacgcttccttaatgcagagacataggcaaatgcctttctttcagctttacgcaaagatagaagaagaatctcttacattctgggcaaccatctggaactctattaattggtgtatgaagcaagctaaactataagctcagatgtaacatgaaacaaatatactcaattaatggaaggtaaaattacagtccccaaatggaaagaactacaagttctctggtcattctacacgaaaagttcattttgacatttcagttatattaacaatctgttcctgctttggtggtctggaaagaatgaacagcaatattcataatctctactatcaactttgctaaattttttccccaaagaccatctttattaccctgtaactttcactacttgaagtgttcccatttctacaataaatagattaaaatcaacagagaaaagcttcaaaaagtgacagggttgttggaatttttcttgggattgttatgactccttctttatacacaggtcatctgagtcataatgaaacaccaactattcagagtcacatgctgtgctttgtgcttttggttgatcagaaaagcagtgaacttgatcccatcactataatctgatgcagcaaggaagagtgataacaattattcttagctgatttatttttttcttacaaatcactttcttatgcacacagaactgccaaaatggcatcagttctctcactaaatcttgcaaataaaacagtatacctttcaacgtggtggctgagattgtgtgatgtggagaaaaggaagatatgcagagatgttagcatggccacagggtgatggtggtggtggtgctggggcaagtgtgcactactaataggagaagatgtcaaaaaaaatgaagcataataatagtgcaatttatccttgctaaacgtactgcagtgtgctataattaaatatgaaaacctaaatttatctctatgttcggttgtcattaatttaacagggagtgcacatgttctaatctaatggttgattttttttctccatgtgcagcatattaaaatgtatattagcctcaaggtgcataaacacaaaataatagaccaaaggttttggcctgtggagaaaaaaaatccatgctcaaaggccgtcaagtagctgtgatgcaggggagacactcacttagcctcattaagccaaagctctcttttgcttgtcttttgttctgcatgacagcagcctctttgttgtataataattcattccaagttcgttccaagctaccgaaactggtgaactgtggccattttaatgagaagtattggtggtatgcataatctggaagccacgtgggccagacaatcacagagcactgcagccagcaaaatgagatattgtcgaaatcacaaatttgtcaagttgtttttggacagggtattataataagcactaaaatatgcatcctattactctgcatctgccagtcaaagatcactgtaatgaatgcgtgctgcagggtataaccaggccgttttcctaagtaaaacaaaccacagagtacagaaaagaattgtgtgggtttttttttttttttttggcattgtttgacttttttttttttcctaatccttttgcaccaggagtcaggttctcctggcatggtgtccactgctagcagtgaatacacaggccctgctggtgccagggagttaacatgaatacattgcttttttaataggtgtgcttaccatctgagaatacaaaacctcaaactcaaggcttcaattgagtctactgaagaattcctgggagagaaaagggaaaaaggaggagaaaaaaatatctctcccaatgatcctaagccttatgttttatccttttctacttcaaatggcttagcctttgggacttgttttgttgtttgtttttctgtttgtttatttttgcttttttgtctgtctgttgatttatttgctttttagatgaacctaaagctttgggaagaaatgggtgagatgctaatctatcccagttctataatattaatagtttgtataagaaaactaatacaatgttgacaagtagagagagtattttcacttgcccataaaaatggtccttagggagagtgaccatatactttctcatctaaaccagaactcttttgagagtgaagggaagatattatcgataattacaggcacaaaaagcaagactgtcagagacaaactggcctatatgatcatcccaaccataagctcttgaattggcaaatgtaaaggaagcacaccatgtccaaaggccatacaatacatcctgttattctgggcagtctctatgaaacattcagggttatttgtttgtttgtttgtctgttctgttttcagccaatggactttccataaggtctggatggaaataaaatgattgttaaatctaagaatacggagaatactcttccattcttttctagccattttttaaaccttacggaaccttttttgtgtgtgtgatcaggaggcatgatgtgagacagagacatataaaagtatggtccatatggtatttataattggggctgcagtagaaagatgggtaaaaccaagtacaattactcaaataaatgtggatttggatggtaaatatgaatatatgtataaaatagatgctttcttagtttagaggagataaatatatccagtgggaaaaataaacaaagcttcctggggtaggtgagaattagtagaatttcaatggcaaggaaaataaagagtcagaagaactgcatgccatgagccaatgtattgaggctgttataggaaggaggagagcatgtttgaaaaccactttactgaaagataatttacatggaaggaagtaacaaaagtaagactgacaaaataggccaggtgcagtggctcacgcctgtaatcccagcactttgggaggccgaggccagtggaccatgaggtcaagagatggagaccatcctggccaacatggtgaaacgctgtctcttctgaaactacaaaaattagctgggcatgggggcatgctcgtagtcccagctactcaggaggctgaggcaggagaagaatcgcctgaactcaggaggcagagattgcagtgagctgagatcgcgccactgactccagcctggtgacagagtgagactctgtctcaaaaaacaaacaaacaaacaaacgaacaaacaaacaaaaaactggcaaaataggttgcagggagatcacaaacagccttgaatgccagatgaaagaatcccttacatttgttggtcaagaagtatcactgaatgctctgaatcagaaaataagctttggaaaaaataaactggcagtgatatgtaaagggtctggagaaggagaagctgggagaagaaagtctacagttatagcgcagaagagtggtcctaaaagcctaaaccaggatattgatatttgagataaagataagactatccaaaatgctccttccttttcctaaatatcccaactgtaagacttacacatatttctcaagttgtataaaatcttctcaatgtcctctacgtccttagcccatcagtccatcttattttcatgttaaactcttctgtgcatcatgtcaggctcagtgattgtggagcgagtaatagctctcttttactgtactttgagaatgggtagaatcaagagggtgagtgcaatattggtttatacaacttggtatagcctaagttggtaagcattttcttttaccctaagttacaaagtgtgtgcactttggatagatacatgactactttattgtagaggcacaggtttgagaagggagataagtgcaaggcaaaccagatccctgagtaggtctcgggagatataagctagaaactctgcccacagcctgaattatggaagcctgcaactgtaacaaatgtcctgggatgaaatgtctggagccttaagctgtcatgcatgacaagaacagctctttagtgccagaggtctctgtctctggggcactggtatatccctccattgcccatgtgttcttctgtttggtgtatgtgtagggtgtgtgtgtgtgtgtggggggggtgtgtgtgttcttttgggatatctgctttgaaatttcatcatcaaactaggcttttccctgatgaaagttccatactatagagaaaacatccacatttgcttgcagtttgtgcagcttaaactgaagacagatgtcttgtgcagcaaccacaatattttcatttatctcttaatagatttccatctaggaatcaaaagtctgattttatttttcaactctgatgatgaatactaagaattattttaattatagatctatttcattctgcaggaaataaggagaggcattttgaagtttttttctttaaagacctcaataatatttatcttctaaatgggattttcatacataccatgacaatcttatggattactacatattgggagatacctactatggaatccctggcaatatctagttttaattaaaatgaaatgtcataataatgtcatcccacattctggtgtcacgacaaacatctttgaactcctgtgattaaataagcagaaacacttgataaaacttctaatgattcttctaaagaaacgaaaaatcttacagttcattgtttgtatctcctttacaagtatatcctttcttgtattatagctatttagatcttaactttcaactcagttataagctcttaatagaaaatacctgcatcactctaagtttacaacagagtcttttgtacgctttgggcttgatagatattaatgaaatggaaaggtaaaggtaaatgtttcacgccctttggaattaatctctattgtacatacataacatgcagatgcactaacagaagatgacaaaaattagcaatcttttgaaaactagtatttactaaatggatgtaatatgtgttgattatcataagttaggattgagtaaacaattaaaatgctctacttggaccaaattgaaagcccatattactggcaatctgatacagaattatagctgtgtttcacttgtgaaatagagataactttttttatttttttgtaacagagtctcgctctgtcacccacgctggagtgcagtggcatgatcttggctcactgcaaactctgcctcctgggttcaagtggattctcctgcctcaacatcccaagtagctgggattacaggcatgcactgccacgcccagctaatttttgtatttttagtagagacagggtttcaccatgttggccaggctggcctcaaactcctgacctcaggtgatctgcccatctcagcctcccaaagtgctaggattacaagcctgactcaccgcgtccagctgataacttttgtctttctccagtgtcattatcctagtttataacatcatcttgcaactcgatttctatagtagacagtattagctacataatttggggacccaatgaaaagtaaaaatccaagcctcccagtttaaaaattattatgaatttcaagatggagttgtcagagcattaatccaagagcaggaccttctgagagggaagctttgtgctatggcacagattgcatacccacaaagccaattctgctaaccacctcataatgatgtctgtaacttcattgcatcacatttcctatatattttcacatagtaacattacgatgtatttgtatattttcaccatttctgtgtaaaaccatttggcagtttccctttgcacatttaataaaatccaaattctttgtcatggtcaacgagcctccacataatgtggccattgtcaacctttctaataccatgtggcgttacttcctctttttttctctaacttgtgccacaaaggccgtccttcaggtttttgcacaccttcacaaatgctactctcaccagtggaacgctgttccctggctcctcatccttcacatatcattccaaatatctctttctcacagaacgcttccctgatacccaaattaaagtagctccacattctctatttttcttctaagcatgccttttcctcctgcaaatgtttagtacacactgtatcttaaaaaaaaaaaactaaaatagtttctgtccatgattagcttgtaatctccaagagaacaaggaccagtctctcttcttcgctacagtatgacaatgtttagcacattgcctacttcacagtaggtgcttaataaacatttgctggatggatgaataaatgaatgaatgaaagcaccattcaaatgttcaagaacatttttctcactattactattattttcacgtaggtaaaatataatttgcttgggcaaccagaactataataagctcacccaggcattttcttgtgggcactgggctctctctgggttctcctctgaagaagccctcttctcagatatactgtatatatgaatatttatttctcttatacaaaagaggacctcagagctaggtacatcactgcatcatctgctttcatgacttctggatggagtgagacatgcttctttctaggtccttctcttttccattttctattttacttaaagagaaggagctgttaacatattgaaactaaccatcctgttcttctttagcttcaaatagaactaaggctgtttataagaaactacacacaaatagaatatattgcatcttcctggaattctagtacattataatgacaaatgtttttcattgcaatattcattgcattatgttcaattgtttttgttgttggtctggaaacaccagaagtgtaattactagctttgataaagtaataaagtcaatggaataaactatgcttggattatggcctcttgttataagataagcaaagctaagtcaatacccaataaaaattaatactgatatcaaatccagctatcttatgttcaaaatgagaaatcattaccttctcgtaacattcttctatgaaatgtgttccttttaaaacattaaaactgtagaaacattaaaatactttacatatatttacatataccttactgtatttgagaacatatatagagattatacagatataatcgtacatatatatgagctcttttgattctttacaacagtgctgtgaagtcaactgggaagactgaattatctccagtctctagatgagaaaatcaagaatcagaaagattatctggggctgggtgcagtggggctgggtgcagtggctcatgcctgtaatcccagcactttgggaggccgaggcaggcagatcacctgaggtcaggagttcgagaccaacctggtcaacatggtgaaatccccgtctctactaaaaatacaaaaattagccaggcatggtggtgggcgcctgtaatcccagctactcggcaggctgaggcaggacaatcgattgaacctgggaggcggaatttgcagtgagccgagattgtgccattgcactccagcctgggctacaagagtgaaagtctgtctcaaaaataaaaaaataaaaaaataaaaaaattaaaaaatgaaagaaaagaagagaaaaagaaagattatctggtactatgcaatcagctattaatacagacagaatccaaatcttcaaatccctgttctttcaattttactgttaatatgttccaaaatgcattttaaattaaaaacatactaatggtcatactctactattccatagaagaatttaaaaatggaaagttattcatggaacagttttgaagtagtatattatctgaatttgtctagtatattttattaagctctcttcagcctgtcctcatcaaaaataagtattacattaacattacagttatttaaaaattaaccttttctaggctggtttaattttatggataatgtattaatcaacatggcttgaagtttcctatcaaaatgcagtcaaggccatttacactactattttcaggaatctccttctgctacctttgtaaagcatttacttcataggaagcatttcaaacactactagtggaaaaatacactaggcaattatagccaaagtttctacggatgtggctaatttatttcctggtttaaaccatatctaaacgagatttaagagttcaagagctgggaatgaatggacaattgggttattttgtattctgtggagtgagatttgcagtcaatgtcagtattaaatctaggtgtaaaatgcaaaggtgcgaagtttgaatgatgcctccactttgttaggtgatggctgaatcacatacacacacacacacacacacacacacacacacttacataaacacattgaatatatacacaaatacatgcagatatagttaatatctataaatatatctattaaattataatattaatgtcacgtaaaaatacacagatacccatatttaataatttttaaaatataccatatatagtacttatatctattgtatataacatatatatgcaaggcacacatgtagatattgctgtatatattctgtagactaatatattgatatatataattatcatatttatacaatattatcatcatcaatgttttcatcaagttgtcactctctcaggtatagcatacctgagaactgaatacttttcaagtttatgtttagatggttttcatggttgcgttttcccactgataaagtagaattttaaatataacttgtcttatttttatctgtcctcaatttgagtgtgtcctagttcattaaatttagaaatcccttctcattgcccctctgccatgtagttaatggtctgtaaaacacttaaaaacactagaggagttcatttttttaaaaggggctctatggagaagccttctaaaatgtaagagtcttttgtaatcacctatttatttacttgtactttaagttctgattttcatctagtagaggcattctttggtcaaggcaaaactgcagtattctctgtagcttaatatgagtatagctgataacatcatacttttttccattactactatactgaaactagtctagaacctaatgagctgaattgctatccaaaggaacaggatttaggttcagatggggaaaaagagaataacagctgcatccacactcccttccacatgatcttgttcatgagcaatatgatgacctggcatgacgtgcaactttaggtctggctctatagccccaggagaacatggcgaggacagtattaaaaacgtgtctatcctattcaacaaatggtgctgggataattggcaagccacatgtagaagaaggaaactggatcttcatctctcaccttacacaaaaatcaactcaagatggatcaaagacttaaatctaagacctgaagccatataagttctagaaggtgacattaaaaaaaaccttctagacattggcttaggcaaagacttcatgaccaagcacccaaaagcaaatgcaacaaaaacaaagataatagatgagacttaattagactaaaaacttcctgtatagcaaaagaaataatcagcagagttaacagacaacccacagaatgggagaaaatcttcatgatctatacatccaacgaaggactaatgtccagaagctacaaagaactgaaacaaatcatcaagaaaaaaataaacaatcccatccaaaagtgggctaaggacatgaaaagacaattctgaaaacaaatggccaacaagcatatggaaaaatgctcagcatcattaattatcagggaaatgcaaatcaaaaccataacacaaaaccacctcactcctgcaagaatggccatgatcaaaaaaaaaaaaaaaagatgttggcgtggatatcgtgatgtgatgaaaagggaacacttttgcactgttggtaggaatgtaaactagtacaacgactatggaaaacagtgtgtagattccttaaagaactaaaagtagatctaccatttgatccagcaatcccactaatgggtatctacccagaagaaaagaagtcatcatacgaaaaagatacttgcacaaccatgtttatagcagcagaatttgcaattgcaaaaatacagagccagcccaaatgcccatcaatcaatgagtggataaagaaaacgtggtaaatatacatcatggaatactactcagccataaaaaggaatgaaataatggcatttgtagcaagccagatggaactgactattattctaagtgaaataattcaggaatggaaaaccaaacatcttatgttctcactgataattgggggctaagctatgatgatgcaaaggaataagaatgatacagtggggccaggcacagtggctcacgactgtaatcccagcactttgggaggttgaggtgggtacattactggaggccagggttgaagaccagcctggtcaacaggcgaaaccattagccatgttattagccaggcatagtagcgcactcctgtagtcccagctactgaggggttgatgttgcagtcagcaaagattgcgccactgccctcctgggcaacaaagtgagactccatctcaaaaaaaaaaaaaaaagattgatataatgtgggcttaggggaaggggtgagaggggggtgagggataaatgactacacgttgggtacacattggtaagtgtacactgcttgggtgatggacacaccaacatctcagaaatcaccactaaagaacttattcttgtaaccaaacaccacctgtcctcccaaaacctattgaaataaaaaataaattaaaaataaaaacaaaaacacgtgtctaggtagcatacatgataggtgtactcaccctaagtaagttaatgtgttttacttgtgtcattgcaaaaatgaagcaaggtagagctataaaggctgtctgaacttttctcaagacccggtggtggggtgaggagtcagttacaactggttatttcctctttgcagggaacgtatatgtggcctgaatagttgagcagacagacttgggcttgctgctattaaatatgtggaatgtgtgttaatattcaggacatattttttctatttgatttcactactatacttcaaatttcatgcctcctaaaatcaaaggcttttcacatttcatatttccaagtgttgtcataagtctgactttggaatcatcatttacactattcatagttcttttcatctatcaaatgttataacctgttgttccctggattctgtatgaaaccagagctcttctgcttttgtgtccaaatattctctctgaattttcactcgagtcattaaaaaagaactattatctgactcttccatgatttgtctctggataggaagccccaaattgcattagttgtttttattatcctaatacactgaaagcctgattttactataatttgttcttcactttcatcccagccctaggtctcctgataatactgctttctaaattgtgtctattaaatgccttatttgatattattatttcacagattcatatcttacatttacccaagtttcatttcatttcttctttcttctttgtaacctctttagattcttttgtgctagttatcttttttctgagaattgaaagtagttcccaaattatagccaactacaaatttccttagtgttcttttgatctcactttccaacggtctcactaaataagacagatgagatgcttcttacattgagattttattttattgtattatctgttctagtacttctcaaacttaaacctacatatcaatcacctggggatctttttaaaatgcagattgtgattccatagctgtggagttgggcctgagattctgcatttttcaacaacctctggtgatgatgctgatgttgctggtttgggtaccatgttgtgagtagcattgatctagataattccagttggtacaaataaataacttgattgatttcaaataatgttttaaataaaatgtttatatttttagtgatggaaaatttttaaatctgtagttatttgaaatgaataaattttttttaccttggattagagaatctcactttaataatacctaagaaggagacaggagcttgattttcccttctttagcctccagggttccattctgatagaaaaatacaaactgcattctttaaagaaactaccatcagagtaaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaagcacatgaaaaaatgctcaccatcactggccatcggagaaatgcaaatcaaaaccacaatgagataccatcccacaccagttagaatggcaatcattaaaaagtcagtaaacaacaggtgctggagaggatgtggacaaataggtacacttttacactgttggtgggactgtaaactagttcaaccactgtggaagtcagtgtggctattcctcagggacctagaactagaaataccatttgacccagccatcccattactgggtatatacccaaaggactataaatcatgctgctataaagacacatgcacacgtatgtttattgtggctctattcacaatagcaaagacttggaaccaacccaaatgtccaacaatgatagactggattaaaaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggaggatagcattaggagatatacctaatgctaaatgacgagttaatgggtgcagcacaccagcatggcacatgtatacatatgtaactaacctgcacattgtgcacatgtaccctaaaacttaaagtataataataataaaataaaattaaaaaaaccccttcttggtaataagttatatcacctagtgtttgcacacactcatacacacatcaccttttctgcccatgcacacagttttagagatcccttttcagtgtattaccatcatcttgcctttttcttattgggaagacttatctacttatgtgggattttattcctcaaataagatgggttttattaccgacccctgaggaacacaaatgcccagttatccctatatggagtttcctattattaagtcagttctctatccaagacaacaaagtccttctcatttccatggtgactgaatggggaagcaatgattataaggcatcagccagaacatatgcgacagaaaaaaggaggcttgaaatttctctagactcaggaaatatgtattccatggcacacaatagagtattgcttctgaaatatttcaatttctgtggaatacaactcttgatggatatattttcaagttgtaccgacattcccatacctgtaatatgtgtataagctctcctttacttttgacacttttattcacccttaatggtacatggagctaaaagtgatatattttccagatgtggcttgatttcaggtgatatatatctgcaactaaagaataagattctttacaatgagcaatgctgaataggtacttctataataatcaggcatcacatatttggacttgactgcttagggtaaccatatatattcttgttgaagtactgggtgcttaaaaatgttttacttcattcctcagttaacaaaaatgaccctgaaaagtacactgatagcaagtagtattgcaccaattatacccttcactgcatttgattgtagggttttctctttattagcttaaaagtgagcagtaccaagtccaattccccagggctttttgtgcttctacaaatcatgtcaagttgctcacaaccagtgaattcattactctgatttagcgatggcagtacacaggatgggaatttaaaaacaacagcaaaaaacatttaagtcttcaaattttactagtttgcaatatgaaaaagttttatatctaggtgaatgctctttctagaaggattcttcatatttttatttatgatagatgatttttgaagatttcaacttctggtaatggcagaatacctcctttgggcttctcctgcagataactcaccagacacacacacacacacacacacacacacacacacacacacacacacacacactctatccaaatgcactgaagaatgtccaaaagagggcagaaactaaaggggaattggcacctggaagaagggaatgacactattctttttgcctgagaacaggctcagggggtggtaccaagcagggaggttaaaattcagagagaaattcgtcttctaactggctgagaaatcagagttggggccatcaaaacatctagaaactggggagatatccaagaaagaaagctacagagagggagcaccagattctgcatatgtattctacccaaatcactggctgacatctgagctatgcatgtgcttggcagatgccaagcagcacagctaagattgaaataactgtacagatatttcagtcagttgctaactgcagaaggggcagagttttggggtttgcattaagataagttaattgtctgctaaagcaaacaaaaatcgggactcttaggtgtggagagtccagagtctctgtataatgtatcatttacacagtccagatacaatataaaattgtcagacataggaaagagcattttgactgctctcaaaatgaagggcaatcaacagggatcagtcctgagatgatccagatattagaattagaggtcaaggattttaagtcagttattataactgtgctcagaatataaagtaaaatactctgataatgaatgatgagataataaatatggcaaagtaataaatgagaaaaatgaagcaaaaagaaattctagatttaaaagatgtgatactaaaataaaaagttcattaggtaggcttaacagcataatggagatggtatgagaggaaagactcagtgaacttgaacatggataaatagaaattgtccaatctgaaaaacagagaaactattaaaaaaattaaaagaacatctgggacttgtggaacaatctttgaagttctaatatatattcatttggagtctcagaaaagaggaagaaagaatgaaacagaaaaactatttagagaaataatgactaaatatttcctaaacttggtaaaaaaataaacccacaaaccatacatttaccagtttaagaaacccacagaagcttaaggtagataaataaaggtttctaacattttaataatatgtaggaagtaagttgcagaaactattcagggggcaattttgagactgaatttgtggtatgtttgtagaaaactgtagctaaggagatatgaaaaaatgggaaaataacaaaaattaattagaaatacattctgttccttttaatcttattattagaatgttaaataggaatattaaaggaataaatttatccattaaataacaaaacagacatatgattattcagttactatgccgctaaataaatcctatgatttcatcttcctcccttatctccctccttccttgtcttcttctctccctccttccctctctcctgtccttcttttcttttatcgtagagaaagatgaaggataaaatctttcttactgatactattatcattaggatacaatcatcattaggaagacatagtgttttactgtttgggtcaagagtcattgtaataaccaatagttttatatttacagtgttatatattcaactaattcaccaacaatttctatatagtgttgtggtgggccttccaagataattttagaacaattcttatttaaaggacatggaattaaagcagaaaattattttataaaaataggtgaaaaagaaaaacaacaacaaagacaacttttctttcttatcctttcagaatatttcagtagaatgggaagctacacttgaaatgcaagatggaatattttcccctaagctctccataatagaatgttggttataccatccttaactaaactaacactgtatcttttctgtagtactgataagaaaattgaaaatgaacaactcgttaatatactacctgaaaaatgtgagattagagagtccagcagaattttgaaggccaagtaagggggtgttcgatgatgagagataagcaactctttgaatagaaggattgtaagagatttaccctctgctattagcccccctctagttcccagggtttaaaatcaattacaatttcattggtacttaaaatttctcttattgtcacatagattgaatttcaaagagaacaggacagccttacacatagaactagtcagtggggagcagaaagtgtacaacctaaattgtttacttcatccacaagagactgtactatgactgggattccataatgtgatatctgaataaaagccttactttacttactgatttatttttcaaagttcagttcttaacaaattttgaaaacagaaattcaggcctggtcactatttattcttgagttaatttttcaagtagtttcaggatagccttagttaacttggcaaaatgccctgaaaagtgaattagcatgtttaaaacttggctaatcactccctcatccccaaccatagcaaagcctgcttaattttgagccggcgttttagcatacagtggtctaactccatcctgcacacatatcttgaattggctgatttggaagcaggcagacttccttctggatctcattcaatttagaaacaacagcagattagcgattaaatcggccaaacaacttctggctcataccaattaatttcttcaaggatttttcccttaaataaagtgtcttacacagttacagggaatgtctcaaacagcctgactatatataccactattgttgaatgttttcatttttaatgttaaaagctctgtcacagaaaacagcctggaaactctgtggggcaatgcaacccatcattctaccatactgatacaagtaaaacaacaatatcaatgttctaatacattaggaccctttataaagagttctcaccgtctaaaagcatcagcaatcataacggagctgtgggtatttctaagccaatcaacaaacagccataaatatacttggaatatacagagacattatcctacttcacttttaattcaacatgaagtcttttttaaatttaatttaattttattattattatactttaagttttagggtacatgtgcacaatgtacaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccatgtgttctcattgttcaattcccacctatgagtgagaacatggggtgtttggttttttgtccttgcgatagtttactgagaatgatgatttccaatttcatccatgtccctacaaaggacatgaactcaccattttttatggctacatagtattccatggtgtatatgtgccacatttttttaatccagtctatcattgttggacatttgggttggttccaagtctttgctattgtgaatagagccgcaataaacatacgtgtgcatgtgtctttatagcagcatgatttatagtcctttgggtatatacccagtaatgggatggctgggtcaaatggtatttctagttctaggtccctgaggaatcgccacactgacttccacagtggttgaactagtttacagtcccaccaacagtgtaaaagtgttcctatttgtccacatcctctccagcacctgttgtttactgactttttaatgattgccattctaactggtgtgagatggtatctcattgtggttttgatttgcatttctctgatgcattcttatacaccaataacagacaaacagagagccaaatcatgagtgaactcccattcacaattgcttcaaagagaaaaaaatacctaggaatccaacttacaagggacgtgaaggacctcttcaaggagaactacaaaccactgctcaatgaaataaaagaggatacaaagagatggaagaacattccatgctcatgggtaggaagaattagtatcatgaaaatggccatactgcccaaggtaatttatagattcaatgccatccccatcaagctaccaatgactttcttcacagaattggaaaaaactactttaaagttcatatggaaccaaaaaagagcccgcatcaccaagtcaatcctaagccaaaagaacaaagctggaggcatcatgctacctgacttcaaactatagtacaaggctacagtaaccaaaacagcatggtactggtaccaaaacagagatatagatcaatggaacagaacagaaccctcagaaataacgccacatatctacaactatctgatctttgacaaacctgagaaaaacaagcaatggggaaaggattccctatttaataaatggtgctgggaaaactggctagccatatgtagaaagctgaaactggatctcttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtaaacaggcgacctacaaaatgggagaaaattttcgcaacctacttatctgacaaagggctaatatccagaatctacaatgaactccaacaaatttacaagaaaaaaacaaacaaccccatcaaaaagtgggtgaaggacatgaacagacacttttcaacatgaagtttaaactatatgtagttgaggtgcttttccaaatggaaagaaaacaatctactacccaaatcaacacatagtttcctgtgaacaatatcagaaactaataggatgatcctctgtcttagtccatttgtgctgctataaaaaatggtacagactgggtaatttctaaacaacagaatgtttttgtctcagttctggaggctgtgaagtccaagatcaaagtgctggcaggtttggtattgggagtttggtttctgctttctagatagcgccttgttgctgcatcctccagagaaatgaatgctctgtcctcactttgtggaagggtcagaagggcaagaaagtgttcccttcaccctcaaaccctttcataagggtgctaatctcattcatgagtttggagccctcatgacttaattaccttccaaagaccacatctcttactactgatgctctggggattaagttttgacatcagttttacaggggatgtggtcattcaaaccacagcaccctcttttagaaacaagattgagagacaactttctggtattcacttatttttggttcatagagttcaatcattaaggaaaaatggcaagttgaaaagttgtgtagtaaaaaataaagaaaacttcaggccaatatccttgatgaacactgatgctaaattcttcaacaaaatactggcaaaccaaattcagaagtgcatcaagaagttaattcaccatgaccaagtaggctttatccctggggtgcaaggttgtttcaacatatgtaaatcaataaatgtgattcatcacataaacagaactaaagataaaaaccacatgattatctcaatagatgcagaaaaggtctttgataaaattctacttccctttatgtttaaaactctcaataaactaggtattgaaggaacacagctcaaaataataagatccatatatgacaaacccacagccaatatcatactgaaagggcaaaagctgacagcattccccttgaaaaccagcacaagtcaaggatgccccctctcaccactcctattcaacatggtactggaatacccggccagagcaattaggcaagagaaagaaatactgggcacccagatgggaagagaggaagtgaaactatcactgtttgcagatgacatgattctatatctagaaaacctcatagtcttgccccaaaagttccttcagctgataaacctcttctgcaaagttttggaatacaaaattaatgcacaaaaatcacaagcattcctacacaccaacaacagccaagccaagagccatatcaggaaggcaatcccattcacaattgtcacaaaaagaataaaatacctaggaatagctaaccatggacgtgaaagatcgctacaatgaggattataaaacactgctcaaataaatcagagatgacacaaacaaacgggaaaacattccatgctcgtggacaggaggaatcaatgttattaaaatgaccaagtgcccaaaacaacgtacagattctttttttttttttgtatttttagtagagatgcggtttcaccatgttagccaggatggtctcgatctgctgacctcgtgatccacctgcctaggcctcccaaagtgctgggattacaggtgtgagccactgcgcccagccacaatgtacagattcaatgctattcctattaaattatcaatgatattcttcacagaactagagaaaactatttcaaagttcatatggaactgaaaaagagcccaattagccaaggcaatcctaagcaaaaagaacaaagctggaagcatcaagttacctgactctaaactatactacaggggctacagtaaccaaaacagcatggtactggtacaaaaacagacacacagaccaataaaatggaatataagcccagaaataaggctgcacacctacaaccaactaatcatcaacaaagctgacaaaaacaagcaatggggaaaagactccctgttcgataaatgatgctgagataaatggctagccatatgcagaagattaaaattggaccccttccttaccatatacaaaaatcaacttaagatggattgaagacttaaatgtaaaactctataaaaacgctggatgacaacctagacaacaccattctagatacaggaatgggcaaagatttcatgacgaagcttccaaaagcaattgcaacaaaagcaagaactgacaaatgggaactaattaaacttaagagcttctgcacagaaaaagagaatgtcaacagagtaaacagaaaacctacagaatgggagaaaatatttgcaaactatgtatcgaacaaagatctaatatcctgaatcaataaggaacttaaacaaattacaagaaagaagtaacaaccccttaataagtgggcaaaatacatgaacaaacacttcacaaaagaagacacacatgtggccaacaagtatatgaaaacaaagctcaatatttctgatcattagataaatgcaaatcaaaaccacattgagaaaccatctcacatcagtcagaatgactactattaaaaagttaaaaaaaaaatagcagacactggccaagttgcagagaaaagagaacacttatacactgttggtgtgagtgtcaattagtttaaccattgtggaaagcaatgtggaaattcttcaaagggcttaaaaaagaactaccattcaacccagcaatcccattactgggtttatacccaaaagaatataaattattctacctaccataaagatacgtgtccacataaggtatgttcattacaacactatttacaatagcaaagtcattaaatcaacctaaatgcccatcaatggcagattagataaagaaaatatggtacatatacaccatggaatactatgtagccataacaaagaatgagatcatgtcctgtgcaggaacatggatggagctggaggccgttatctttagaaaactaaacactgcatgttctcactcataagtgggagctaaagaatgagaacacaggaacacaaagaagggaacagacacactgggacctactgagagtgaggggtgggagaaaacagataatcagaaaaaataactattgggtactaggactagtacctgtgtgacaaaataatctgtaaaaggggcccccatgacatgagtttacctatatgacaaacctgcacatgtactaaaataaaagttttaaaaacattaacatgaaaaaagtaacactgtacagtaaagcttaggtgtcatacaaatgggaaaaattaacttttcttttaagatttccttaagacaactaatggtttatctttaccttcccttcagcccttggcagctgaccgacacagctacctattccttccacacttccccttctcttaattcagaggtataaatgcttttatgtgccagaaattatattttatgttatgagttctccagacataagcaagaattgccaaacttgccagatggccctatacttatatttcaaagtttaaaaaagcagaatttaatgcagatacaggaatattatcaaagtaccatattatttgagcattttggaaaatatttttattttattttcaatagtttgtattaccactaatgttgttaatcacttcagagagtatattaatgctaaattcagaaataggaattttttttatagccaaagtttagatttataaaaaatatgagattctgctttagaagagattcttcatgaatagatttatatttcagttttcctggtgggaaatcttgttctttcaaagcctttcagaagatatcccattaaaagtgtacatttttcaaaagttttagtgtagtttaaaattattttggacataggaagagcacaatatatacttccatggaatagctacctcatattcatatactctctcgattttatttagtgtgctggcattagatttaaaaattaaagcacatatcactccttttcctgaaagttaccacttcttgacactgtacaattcttggacataattactttgagtctctagagtaagatcagtaagcaactaatgaaaaattcctggtagaggcagacagaatgagaaaatgactatataactgagatcaaattatatccacagggagtaggatgctttctatattctacaaaagtctacagcaaaaatgcactaacgtggatgaattgtgtgaagagtcattttgaattggtgaaaagactgaattacagattattgggaaagaaatgcatttttttcaggtacatccaatgggaagaattgctaacaaacattcatttaaaacagcatattcattgttgattttcatgtgagttttgatagcgtacttgaaagctgttaattatcttaagtaggttaaacaatttcttgaaatgtgtttatattaataattcacttagtaaagtagggctttttgtctgatagcataaaggtatattatagcctagaaagagtaaagagcctgcattttaaagtagttatttctaaaattcacaagtttgtagctctttattaccaatcttgggaaaacttctagacctttctttcagaggtcaactactctcatttaatagtcataagtacattatttttaataaaataacatatcctgatggagtaatgttttctagtttggatgacagatttctatagtggatgataaacctaaagtttttattccagtcatatattcacagattctaattataaatctgaggaactctaagaacataaaatctttttttaagcgtgatattctccaaacaagttaagcttttcttagggaaatcagaatattatgaggctttctagctctgtgatccaagtaacaatcttctccacaatgtgtaacaggctatcatactcagctgtcaaatgccttccagaaagcaagatatgccttgctggcagcagctcttcactctattgagggatgtagaatggtttggaatttgggctttcatttcctgttgtctgggttcaaatctcagctgagccacttgttttatcatcagttaaagcacaggtatcaggaagacctacttcacagattgctctgagggttaaatgaggtaactgaagtaaagcccactgcaaggtattaatatttagtaagagttgggtgaaaattgttatccattgcctggaaacatattaaaagaggacagtatgttcatctggtatgagttattctcattgaattttcattctccctatccctattcacatacattgctttagacaaatcttgcttccagaggaacactgctacttttccttatttagatttttttaaccaatgagtttagatatattctagatgaccaaattgaactttaatattcagaaattttcagaattcacattttcaccctttgataaaaatgaatttaacgtgattaggcactacacctgactatgcttgctcatatagagaaggggcttcaattcccacttagtaattttttttttttttttgagacagagtctcactctgtcacccaggctgcagtgcattggcatgatcgcagctcactgcaacctccacctcacaggttcaagcaattctcctgcctcagtctcttgggtagctgggattacaggcacccaccaccatgcccagttaatttttgtatttttttgtagagatggggtttcaccatgctggccaggctagtctcgaactcctgacctcaagtgatccacccacctcagcctctcaaagtgttgggattacaggcatgagccactacacccagcagtgattctgttttgctcaagaagaataatcaaactgatgattcttcttggtgaaatattaatagttctacctactttgtgttacctataaacattttacagttttacatttacttctctatggaatggtctaatcattaccattttcttcagagtgttctaaaaagtcaatatttactgatgatatcagtaatccataatgtattcttttctttccaactccaaatgtttacaaattggcattctctttacattttgtcttagaaggagcatttctttccaaggcgaaatacttgagagaaaatgcccttagtaggaagatgtgcttccagatgcctatgataattgattagatttttttgatatattgggttaatttttattttattttattttattttattttattttatttgttatggagttttgctcttgttgcccagggtggagtgcaatggtgcgatctcagctcactgcaaaaatacttccacactttcctcttttaatagactctactagcaacctgtcacatttaatcactactgaactagccatgttgttttaatctgcattctatacatatttagcataataaatgaaaacttcaaaaatcctccctgttgatgactggtagtgtaactcttgctgtatgcacacttatgctctgccttggattgttgacattctatgctcatgacactggaatcactcagaaacatccttggagctctccatctccacctgcatcccttctactgcctcatctcacttcaccccaaccatggtatttataccttgtgacactcaataaataactaaggaatagataaatatttagatcattatcctgggaattcttctttggtgcaagagtatgaggctaggtatcctctagggaacttccagggagaaatatgcaggcatacatacagaaaatatattagcatcacaaaggcaggggaaataacccacatacagatctagaatactttcagatggccctcataagttttctcttggtcctctgcagaactgcatacattacaatgcttgagtaaggactgtatgaatggaaacttcacctgcagttgtgatgaggacactctaaggtccttggcaggtatatctagggttttccttgctattaagtgtaaatcagtcattgcctggtaccctggacagtaataagaattataagccaattgaaggttgcttaccacaggggaatctgaagcccattcgagtactcagttactgcctagatagctgattttatatgaaattgacacgactgaagagacacagaaggcaatgttcacatcaacagtttgctgggcatgcagccaggcaaccatacacatctacataggcaatgcagctgatgaagggaaggcccaaagctggggagaacaaggcaatttgcagggatctatgcagacctcaggatcaggtttctccccattccctgaaggtcttctcttcttcattattctctggctgtctctatcttaaatactttcttctttccatttcttttttttttttttgagatagagtcccgctctgtcacccaggctggagtgcagtggcgtgatcttggctcactgcaacctccgcctcctgggttcaagctattctcctgcctcagcctcctgagtagctgggattacaggctcaagccaccacacccagttaatttttgtatttttagtagagatggggtttcaccatgttggtcaggctggttcgagctcctgacctcatgatccacaaacctcggcctcccagagtgctgggattacaggcatgagccaccgtgcatggcctatcttaaatactttcaaagacataatcaacagactagaaaaactagtttaattaaggcattggtagggaaaatatatgcatgtaaataaatacatggagtcataacccaagttggatttgttgtagaaaagctaaaagtcaagtaatataacatacatgggcagaatagaaggaggaagagttggacctgtgatctttgccaataaacggaaggtccatggtaaggatcagcccacgatggcaatgtggcttgatgccaatgatgaaaggttgaggaaagaaggtggcatgcctgcaaaagcaataatttatcctaagttcactgaatacaggtgagtaagtattgtattatttctactacaactgactgccacaggtcactgggaaagaggtaaaacgttcaacaatcttgcccacagattagcaaaatcttaatctgctctctgccaactcagaatcaaatcccaagcattaaaaacaatgattctctctggacaggataacaagtagaggtggtagaatgtagtaggcaagtgcggaggttttgtgagcacacagaccaggaccagaatgctgcctctgctctttccagcatgggacctaggacaacttcctaatccctccaagccttccttttctcaacaggatagagaataataattcataccttacataaatcattgtaagattaaagtagataacacaaaaagccctcaaaatgttaaataacaaccattgaaggtttttaatttgtattgtcattatcatgattatcaattctacttttccttgggcaaataaccttgtactcataaactgattctaacagttgtgtctgttttataggatgaacacatacatcattgcatggaaaaagcagaacttagcctggctgtgcatttcatgggtgcagtttataggcatcacctgcaactagaatagcaatattaattgtaatgctaacatatggaaagataaagataaaggtgtaagataaagctcactaaaacaaagggatcttgatgtggaaatgttagtatttagacaaagtataaggacgcaaatgagcaaaaagaatttttgtgtttacgaccatgatacaaacagttaagaaatccaggtgaaagtgggttttccatcccacagaatttgaaccgccctcattgtcacaactgtaggcatcggtgatggtgttatctttcttcgtaggctctctggtctctagccagtggggagaaggagatttcgattttataaactccaggacacatacattaatgagtaaaaaatgcttcataagctgatcaacagtattttttgtcatccttcaagtaataaaatacttaaaactcatattaggttctgacgagcccaaaaatgctaagaggagggaaagacatgatttgatacaaagtatagatctgatttctgtgtatgggaattcatatgaatttgtttttattgcactgattttgataacctgccataaaacttttgttaatgctaagaagaaagacatagctaatgctataaattcacttagatatctctgccttccatattttggtatcaaattaaatttatcacttcattatcccttcctggcagttggaagttgtagactttaatggaaggtgccagggttgctaatagaatcttctcgtcacagatgaaggaaatgtaaaagcgaaactcacaaagatttgataggatttatgctaaatgacaacgacacccaaaagcacaaactaagaatgaagcctgtgccctatcgggagaaggaattaattatccaacagatttgtaactctttctctactataaataaaaatgtagcaattttcacaaatgatcatttagccagagccagccattgcctatagaatggaattaatgaggacatttacataaaccttacagtgttttcatccctcaagactcagttcatctgttgcctcccaactgctcctgatgccctaggttgagatggacacttgtttccttctaattccataactccgatagcataatagcagttatgttgaggagtggtaattgaatggttacgggcacaatgtttgtaataaacagaattgggtttgcgtccggcttccactaataaatatctaaacctctttaacctcagttttcacctttgtaaaatgagtatatatacacatatgtacgtatatatgtacacatgtatacatatatatgtgtatatatgtgtacatatatacacatatacgtacatatatgcgcacacatatatgtacatatatgcacacatatgtacatatatatgcacacatatatgtacacatatgtacatatatatgcacacatatatacacatatatgtgtatatatgcacacatatatgtacatatatacatatatgtgtgtatatacgtacatatatgtgtgtatatacgtacgtacatatatgtgtgtatatacgtacatatatatgtaaaatgagtatatatatacacacataatgtgtatatatatacacgcatatataaaatacacacacaaaaggtatatacaattatgtgaagtatttagagtttattactattttttttttaacaattgatcatcaatgataaagagtttatcttattaatcactcaatctcaattaactactgcagtgcctggcatggaatactcaatatatgttaaatgcatagatgtttatttaaatgattaaaatccaaacactaaagtttctgaggcagggatatgtaaaataaattctaattagtaccaaaaatcaaaatctgtcagaattatgtgagttcagaaaagatgtgcgatacttgtttccagtcacaattttctaggagaggcatcctagataataggaagtacaaaggcagaaatcctgaatgcaaaaatagcagaatgaaagtacagttttgactcttttccaatttgcaatactaatgccctacaaaatgcacaaagtgtacccagagtgaatggaaattcaacctcaagtgttttgttttcagttctataaatgttataattttattatccattaataataatgctattacaagacaaaatgtcaatgcatatattaaaacactagaaatgtatttgatttaaagtttccagacaaatttcccactgggtttgtttgtataagggtaggtaggacgttagggcaaaagagtccagccctgcatgtaatatcctatcggcaatcaatttaaggttctgttctggaagctttggcctcaggcaaggccagcttttgttaacggaggctgcaggcactggctgatcctacaaagcaaagcacatggaaggcctaccaaaagacctaatcaaattttccatctttaagaagcagcttctcctttgagttgtgacaccacatccactacctactccactcctcaaggagcagatgtgccccttctctgtttctaagtcctagccagcctccctgatgtgaaaggccggaagtcttccaactccacacccagctgctggcaagttggcagagtgaaatgcatttgtttatgcccctagccattcattttctttaagctggtttccagccaagatttttatctaggtaccagctattcttttccagtggttaacttcataaggtttttagttcccaaaggctacctgattaaaagtaatttgggcataaaaaatgtctttagtatttcttatatgatatatcttattttgtcatagaaatattaccaaatgcttatcctatagtttctttcagagtgagtttgcatttcttaaaaaaattaacaatgtatttataatatgtaggatttataatatacacacattttaagtatacagttacactttagacaaatatacacattcacaaaactaccaccccagttgagatataggataaaaatattactggagaaaatttctgtcttgatttcaaataatatggatttgttactcccattttaaactccacataaatgaaatcatttggtaactgctcttttgtgtctggtttcttttccttatatgtttgtgagattcaattacctcaaaaccttatggatatgtgctttcatttctcctggaaagatacctagaagtagaattgttgggtcttacaagaaattgctggagagttttccaaagtagttgtaccattttatatactcattagcaatgtatgaattttcaagctgctcaatatctttgccaacatttatgttttcagtattttgaacattagctattctagggggtgtgaagtaatatctcattgtagtgttctactgtactttctaatctcacctaagcatttttctctcttttacctaggttgtcagttcttgttcagtgctttcctttatgtaagagaatactattcccaatcaaaggacagactaccaaaattatggtgatgtgcaaggtcacctgtgtgatgacatataagttgattatgacaacagatgcatctgccaaaacatttccttgatctcctcctgtaagcttcctttgggtttctcaggaggggcagaatgattcactatcaacatagtatcacagatagacttatcagaatcttggtgaattcattcaacagaagtcttctccattttggtgccaaagcgataaaggaagaataagggcaagggagtgggtctagagaatgtctgtttctcaactataccttatttcccttattcaactgccacgttctataagccttagctcctacctaaaccacctaatgcatacctcttagtccaaaaaatcatccttgaagctcattagaatcaagtgcatctcttattaattgattcaaaagtgggaaaaaccatttcatataatttaggctacataaaatttttaaatacagtgcaaatcaattgaactgtcctttcgtgttgcatctttcaacagctgaatattctatatggcatttcacagaaataagatttgatttgagaacatctgcagcagtctggaacacattttcccctgtacttgacttttagctcattatagctctcagatgttctctcggcaatcctgtgacatattggagtgttactgaacaaacatcagtgaagcctatgtcttgagtagtgtcaatctcagttgaaaatgtttcagctttcttagcatcaacactagaagaatttaattaacccactgaaactttcaaagtggtagttaatgcatggaagaaatgagaaatcagaaaagtggggggagagtggataagtgcttaacctcccacaagctgatgcctgccatcatcagcctctgcttaggcaggccatgagaagccttgctgctctgtgtagcctcctgcattctgccatgaaatctctggcttgctctattgcccctatggagatggagaaggtgtggaggtggcaactactgctgtcatgctcccctggtccccacacaaggtcagcttccaggctctaatcagctctcatccagatgctctcatgtttttagtaggtggggctgggagaccaaggtcagaaaagagctgtcgggagtgacacggttttttgcccactgctgctattacattaaggaagcagctggtgagataatgtatgccaaagtgctttctaaattataaagtgcttatataattgtcagggataatcactactgttgttttattctgaggttgcagaaaaagcactgaactgggatgttgggtatcaaagtccaccagaaagctgaatataggaatgtgtagggtccacagggaggtctttggtgagagtacagatttggaagataacaataaagagaggaatattggcttcaggggtcaaatgaccatacaacaatatgagagccagagatggaacaagggaataccagtattcaagggacaaaaaaatgtgtgtgtgtgtgtgtgtgtgtgtgtgtagggggggtgtcctaaaagattaactctaagaagtttctcttcacacacagaaatattgtttatctccaggcctttgccacgctttatgccttatcctagagtatttttcccactcctactagactttgtttcaggttatctaggaaaacattctgaaactcatcccctgttgtctgtgtatatctctataattgcaattatcacactatattattaataactgtttaagcgttctatttccacacagtctgtgatccttttaagggcacaattatattactgttaatgtttgcatctataatgaccagcaaatactaggtacgaacggttgtttccttgaaagaaataatagagaaatatgagaaaaatgtgtttaaaagtcaaagaatacatttcaagtatgaaggagtagtcagttgttgaatgtcacacagattttgcaaaataaagactgggaagtatctactggattgagtgatcagtagtaaataactcaactttagtgagagcatgtttagtgattttggaggttgccagtgggtagaaatctaaccttgagtagctgaagacagaaaagcaagtaagaaacgaagggcagtgagtacggatgacattttctagaacctgaactgtgaagggataaagaaattcagaccattctttctttctttttttttttttttgacattcctataagatatatatatcctaactttttggatcaggaaataggggctaagagaaagtatgtatattgtccaaggcttactgcttacaagacagaaaccatgagtaaggtgcacactcttcttggttccacagttggaggaggccaattgctggatatcctcctaacttatttaaagtcaggctgtcttagtctgttcaggctgctataataaaataccataaacttggtggcttataaacaacatacatttatttctcaccattctggacgctgggaagttcaagattgagacgctgggagatttggtatctgggggcggcctgcttccatacagatggcaacttctcactgtatcttcacatggtggaaggggcaagggatctctctggggtcccttttataaggacgctaattttattgccttccaaaggccccacctcctaatagcatcaccttggcagttaagattttaacatatgaattttgaagggacacaaacattcagaccatagcataggcacaatggggaaataaacatcttagctgtatgttatggaaagaaaggctatgtggtagcctggagcactctgacaggagaggtcagactactagtggagtgatataatgggaaactgcactacagcactagctacttgcagatgggaaggagtgcagaaaaggaagtgaagaacacaaaaaatgagtgtattagtccattctcagactgctataaagacataacagagactgggtaatttacaaaagaggtttagttgactcacaattctgcactgctgaggagggctcaggaaacttacaatcgtggcaaaaggcgagagggaagcaaaggcataccttacatggtggcaggcaagagatgagtgaagagggaagagccccttatgaaactatcagatctcgtgagaactcactcattctcatgaggacagcacagaggaaactgcccccatgatccagtcacctctcaccaggttccacccttgacacatagggattttggggattacaattcaagatgagatttgggtgggggcacaaaatctaaccatataaatgaacttttccatttcataatttttcacagggctaaagagccagctacccctttggaaacagttacaagttatctggaattctatattaatcctcataggctggttgtactgtggtaataatagacccttaaatcttagtggcttaacaaaataaaagttcctttcttactcagaaaaagtctgctgtgtctctagctgtgctaatacgtggtatctgaccatctaggccatccattttatgttgccactatctcagcatgagacttcagtgttcatcgtggcagagaaagggagtagggagaattgagtgctagtgcttaaacgcttccagccaaaagagtcatacaccacactttgctcacatttcattgactaaagtaagtcgctcactcatatggaacatccaaggggcagggaggtttgcctcttataaaaccagaggggacaaagaatagaaaatattagcgagcactagcaatatctaccacaaatgccaaaagcacgcaaagtcagatggcattccagccttactctgtatctcaataaagattatatacagtagcacaggaataattttattttcctaggaggactggattaccacaaatgctatgtgtttgcttttgtttgtttcacttgggacctacattaagtggaaataaagacttggtaacatttagggtttgaaaggtgcccagattgatagcctgatgatgggtgggtgacattcttcagctcagctgggctgggctgagcaaatgaagagactaacagccagcacaggacctagaaaaggctctatagtttgagatgaaatggtataaaattgataagtagggaagacaaacgaaatgctttaaagatgtatggcaacaaatcttcaaaaggcatggtcttgacagtgaaacaatccacagcagactggccagcatggtgtaaggggctgggagtgaaggcttcagggcacttccagtctataaggcacttcataaacagtgcctgaagctgcaaatcaaaggcttctcagtgcagcattagtcacattttctgtgcgcattgtagtcacatcttctcagacacatttcgaggggtcacctgtgactatgaagcacagaactattatagggcatggatttgagctaccaataacattgctttttaagattatacagcataaaatagagtggatatttgataattaggtggttaactagatcaatatgggtaaccaaacagagtaaccaggtttctaagaagaaaaggaaaggagatggatatttcatctgaatgtctaaactgatttggttaagtgtgagactgccaattattcagggcaactgaagatatcctcacctatccttcctaagctcccagggttttggtaacgctgttcaatatccatatcatcttgaagctaaaaataaatttaattatggtttgttttgtttgacttttttttttggtaaattaaatcccccttttattattccaaacagcagacatttcaattttttcccctgaaatcttagatgaggacaaattggcataaagctcaatataattataatttctgttgactctttacattatcaaaatgactcctttgtctcctataattaccagaaaattgtatcttcaaactaatattccctttattcaagtgagcagatgggcttaacgggagatataacaaatacatgtttttctcaggaagagtatcaggggcatagctcaaaattgcagagaggtattttctttactccataaaatgaggattgggaacaaagctaactggtttgctataaatgtccactgattgtgtagagatcatagaaggaaaggtagggcatgaattcaaggctagaatttgaattcaagttttaacttacatggatatagtaatgatttcattttaaatcctcaatctccacccagaacaagaacaatcctcattttttttcatggtttaaaagcaacatcagaattaatctggacaacttgtgttgaatatgaaaagcattattatacaagttttaagtatataattaaataaggtgcattctgattagttatatttgatgaagtatgaggaattatacttaaccactcccatgaatgtgacaaaagaagtaactgcatttgtgtttggcaatttgatgtagtaaggagaaatggggaatcataatctgtataagcacgatggacaagagaaaggaacttatgggagaatgacaacacaatgaaaatgtagtatagtttacattttatttcaggcatgcaatggtggattgtgataaggcagttgtagcagctacagattcaaaaagcacattgctgcccaaattcctagaattggtgacctgttggtactccacactcagacatggaagtggaaatccatgttctgtactatctcatcctatatctcaatgtccatgcaggcactgacaattgatcacacacctctgctgggctaggctttgaatcacgagcttcctctatacagggctcccagcaggtactaccaaatgattagagttgccttgtaaaatgaaccaacttacctctgggatgagagaaaccaagttggggaggcttacaggacttcacaaactactctggttacaagcaatgcaaaactacctcttcccataacttgagggactcttatcagcccctcccctaatggttcacgttaaattcagatgttaacttttggcaacagcagtagacacctcccttctgcctattttaggaagaatgatggactactcatgacaatttactgcccaaacttgaagttaattaatttatctccattttacctggaaagtgaacacttctcaattatttagaagctttttgggataggaggtgcttcaaaagacaaagatgctagcttttgaccagatcaaacaaaactaagctagtaaaatcatggtgtcaataggttaaggtaacttctaaaaacaatttgtaagtaccatctgaaaaatctgcacaaagcagagaaggaatcaactcataaagtattgctcaaatgtttctatctaccccaatattacccatatattttggaaatggatatatcacatattcagtattatcccaaattgcctatctatctatgcctctccatgttacgaatagttataataacaaccaccatgtattgattgcttacaactacatgctatacactttagatagaggatttctcttttttatcacagaagacttctgtgtacatatatgatttctaatctttacaaagtactgcaaaatagctatcatcatctcagtttgcctttacataaatggaggattgtgggatccatgtagctgttccaagctcacccagtagtaaggcatcatgcctggatttaaactcagaccttctgggtttcaagcactctctcttctgtggtaagcttttgactacagcacattgacttatttgtgggatcatcacacactgatgagatgatcagaagctcagaacaagatggggctaacaaattttatccaacattttttgcttctaaggaggaataatcacaatttataaaacaggtgtctgtcttatttttacaggatacttgacactccagcattctacttaagatatcactcaaaccatctgacgatattcagatgtagattaagtcttcataacatttatgcagtacattctgatctgataattttgaacctttgaactttcagggactggtgttttgttttttattttccttcctcatgccctatgaaatgaactaaaacaataaaaaatatttagcctcatgtgatctgactacaatcatagaaagtgacctcaataatatattttatatcaatcattacccaagtgactgatagaaatgcaaatatcatctggaacttttctaacaacataatgtaactgtctggcagtcccagggagaataactgtggggacaaagctgtaatgggagaagataacatggacaagaagtacagggccatacaatgaacttgaagaaaaatggctttcattcccttcccttctcctcttttctgggttagctccaagaatggtcattacagtataaaaaagtcccccaaaaatgttatcatagatggacaggagtaagctgcaagagcctaccagcaggtccttattatagattttccattttaagattctatatactcatcaataaaattaaattttctaattattacagtttacattttgaaaatattatatacatttattctgggcacaagttcttcatgagatacaagtataggaatattttctcccaatctgtgacttgagtttttattttcttaattgtatcttttgatgagtatgttaattgcgatgaagcataattcatctattttttcttgtatggttagtgtttttttggtatcctgtccaagacatttttcctttccccaaggttataaagatatttacttaatgtttgcttttaaaaatgtacagtttgaaggcaaggagtatatgccttctgttcaattttgctgtgaatctaaaactctaaaaagaaagtcttatagtcttaccttactgtttacttttttatatcacatatttaaaattacttttttgtcctgtgtgaggtagacatgaggtttattttttaatataggtatccaataattccagtactatttgttgaaagggctttcttttctccattggattgcttttgcacccctgtcaaaaatcaattgagtgtatatgtgtgggtctatttctggactttctatccattacattgatctatttgtctaccctgacacccaaacacacttgcttgattactgcagatttatagaaaatcttgaaggcagatagtacaaattctcccacttcccactttgttctcctttttcaagattgttttggctattctagtttgtctgaattccagtgtaaattttagcatagcttgccaacttctaaaaaacacatgttgggagtttgattgggattatgatgtatatacagatcaatccagggagaaataacatcttaatatatcttaccattattttaagtcttctttaatttttcttcagcagttcttcttaacttttattttagatgcaagggtacatatgcaggtttgtaataaaggtaaactcgtgtcatgggggttcattatacaggttattttgtcactcaggtattaagcatagtgcccagtagttatttttttcctgatcctctccctccttgcaccttccatcctcaagtaggccccagtgtttgttgttccctattttgtgtccttgtattctcattatttagctcccacttatgagtgacaaaatggagtgtttagttttctgttcctgcattagtttgctaaaaataatggcctccagctccatccatgtttccataaaagacacatctcgttcctttttatggttgcatagtattccatagtgtatatgtaccacattttctttatccaatctgtcactgatggccatttaggttgatttaatgtctttgctattgtgaatagtgctgcaataaacatatgtgttcatgtgtcttcatggtagaatgatttatgttcctttgggtatatatttggcaatgggattgctgggtagaatagcagttcttttttttgctctttgaggaatcaacacactgctttccacaatggttgaactaatttgcacttccattgacagtgtacaagcattctgttttctctgcaacctcaccagcatctattattttttgagtttttattaataaccattctgattggtgagagatggtattttagtgtgcttttatttgcatttctctaatgatcagtgacactgagctttttttcatacgcttgttggctgcatgtatccacgtcgctgtgaaagcaattctttcagtgcagatactacatatattttaatttgttcctaagtattttatagtttttacatgccattgtaaatgacattttaaaattttaatttccagttcattgttccaattgttcatgtagaaacagaactattattgtacattgtttttgtattatgaaactttgttaaattcacttattattttaatagtgtatttataggttctttaggattttctatgcacacaatcttaccatctgcaaataaagacagtgcaagcccatttttttccaatgtaaatatcatttatttatttttatgaccttattgcgctggttaggacttccagtacaatattgaatagaagtagaaagaatggacattcttgcccagctcttgatcttaagagaaaataatttatcctttcaacattaagtatgatactaggtataggatttttgtagacgtttccttctattaatgaattgctgaaggccattattatgattggatgttggattttgtcaaatgcttttgctgatctaaggacttataactagaatgattaagaactccaagaaatcaattaaaaaattaaaaaatggacaaaatatttgaatagacagttcacagagtaagatacatggaaggccaataagaacataaagaagagttaacatcttcttattagggagaagaaaattaaaatcacaatgagatatcaacacatatgtactagaatagctgaaactaaaaagactgagaatatcaaaaggtggctggaacatagaagaaccaaacacccacccacagctggtaggactgtgaaagagtaaagccactttggaactctgtttggaagtttcttgtaaaacttatgcatccaccttatgactgagaaattatacttctatgtactagccaagagaaatgaaaacatgttcacaaaaggagttatgcaagtatgtttatagcaaaaatatttataacaccaaaaaagtgaaaacagcctaaatacaacttagagtaaataaattgtggtattttaataaaatatagtattatttaccaacaaaaatgaactaatacctacaataatatgaaaaaatctctgtaatattatagtgagtgaaagttgcaacacatacaaaaatacatattctgtagaattccatttatgtgaatgctaaaaaacatgaacaaactaatctatggtggcaggtgctagatggtgtttgcttctggtggtggtaaaggaagatgtaatggctggaaaagtgcacaaggcagcttctaaggtgttggcaatgttgcatgctttggcagaggtgaggatttcacggatatatgtgtttgtcacaacttgtcaaatggttcatttaagacctctgtatttttcctccaagtaatttatatttcaataagggaaaataagtggcatagaagatacaaaacttttaaagttgtaaataggaaattatagtatcctcttttgaaactgtcattatgcttttggtaagggtcttgctgttgacatttacacatttctttggacactgctttattctctgtgttgaataactttccagaaaggaaaaaaatagataattagacatctacatataatattaccacaaccaaatagcaatagttttatgaaattgtgttatttcagttttttttattagtataaaattaaggggtacaagtgcagttttgttacatggatatattgcatagtggtgaagtttgagcttttagtgtaaccatcacacgagtaatgtacattgtacccgttaagcaattcctcatcccatatcctgcttctacccaattcctcatcctacaccctgcttctaccctcccaccgttttgagactccaatgactattattccacactctatgtgcatgtgtacacattaattaacttccactcacaagtgggaacatgcagtatttgactttctttttctgagttgtttcacttaaaataatggcctccagagggcacagtggctcatgcttgtaagcccagaactctgggaggctgaggtgggtggatcacttgaggtgaggagttcgagaacagcctggacaacatggaggaacgctgtctctactaaaaatacaaaaattagctgggcgtggtggcagacgcctgtaatcccagctactggggaggctcagccatgagaatcgcttgaatctgagaggcagggttgcagtgagccgagaacgtgccactgcactccagcctgggtgacagagcaagactgtgtctcaaataaataaataaaaataaattaaaaaaataaaaaagaaaatggcttccagatccatcgatgttgctataaaatacatgatttcattctttttttatggctgaatagtattctacattttctttattatctgtcaaagtacatttagctttattccatatctttgctatcgtgaatagtgctgccataaacatatgaatgtatttttttgatgtaatgatgtcttttcctttggatataaacccaatagtaggattgctgaggtgaatggtagttttattttcagttctctgagaaatctctatactcttttccacagggtttgaactatttacattcccaccaaaaatgtataagcattcccttttttttcccacatcctcacctacatctgttattttttgactttttagtaagagccattctgactggtataagataatatctcattgtggttttaatttacatttctctgatgattagtgatgttgaacagttttttatatgcttgatggggtttgtcttcttttgaaaaatgtctgttcacgtcctttgcgtactttttaataggggttacttgtttgttgttgttgttgagttgtttgagttctttgtaaattctgggtgacagtccctgttggatacgtagtttgaatatattttctcctattctgtaggccttctgttatctcgattatttcatttgctgtgcagaagctttttattttaagtcccatttgtctatttttggttttgttgcatttgtttttgaggtctttgtcataattatttttgcctagactcatgtccagaagagttttccttagatttttttctagtacttttatagtttcagatcttacatttaagtctttgatgggttttgaggggatttttaaatatggttagaggtagaagtataattcaatttttatgcatatggcaatccaatcatcccagcactatttattgaaaaaggtgtccttgtcctagtgtatactttttgtcaactttgtcaaaggtcagttgactgtagatatgtggctttctttctgggttctttattctgttccattgatccatgtgtctatttttgtaccagtaccatgctgtttttattaccacagcctaattgtataatttgaggtcaggtaatgtgatgactccagctttgaactttttgtcaaatttgctttggctatttggactcttttttggttgcatatgaattttagaattgttttatcaataactgagaatgatgtatctggtcatatggatacaattttggtttctattatcaaaacaaatccttgttttcagagttgctgtacaaccaccatgacagaatttctgattttatcctaatgagagccttttaatgagcacagattatgttcatttattaatatcaccaatatgtatttcatcatttttgaaacctactgaaagtacagtaatttggcaggtttattgttttcttctaaaatgactgctgctgttcttaaaaggatctagctggaattttaattatacattgactttcttttttcctcctaaataaggacacaacagataattcgtgcaatttaattctataaacatgtagcattgtgctaggtgcttgcaaactccagtatgaataagatattatctttccttcaaaatgcttgtaatgacctgcagcactggacaagaagatatacaattaaagaaaatgcagtacttgcaatactagttgtaggaaccatgggctgtaataaaataaaaaggagtgatttgactttcttggaggccaaggaagagggtcatagacagactcacaaaagaagtgacatttaagatagattctaaaaatatattaatgattgatcagtatgttcaattcagctaccatgccattactcctacatggtagacattgcattaggcactggcacacagtctgtgttctaggccgtcaagaagcttataatctaggcatattttgccaagtcaagaaggcataaaggttgctcacctgtctatctcactccttctattctggctttttccatgttatttttaccaaactcaattcacacataaaaaggaactttaagttcaaaggttatttctttacatattcttttcttttctgatgtaatggaaaaagtaatggcttggtaagtcaagtgattactaattcttaatgttaccaataagcttttttctttcaacattcatttagtcatcagttcacttcttcagtcaacatttattaaggcattaccatgttcagtgcatgtctagagaacttagatacaaagatgggtaagaaaagtgaggttattttctagtaaaggaagcagacttacaaaaatacaactgcgatgtgatactggttacagccaaggttcaaaaaggaaggagacattaattctatagcaaaggtcagggaatagctcaaaaagtgatgcttgagaactggaaggccattccagatgtcgggaacagcatgtggaaatgcatgcagatcccaagtgatcattagtttttggcctctactgtttttctttcatgactggtatttaggagtcctgttctcatcccaagcaccaaaaagtgaagacattttctttcatgcttttccagttgcaaaatttgttgttcaaatatcggactgtccaatttctttcatgtttcttaacgaagaatgtcaacataactcttatttcccataattaaaagtgccaaatagtaatgttttcttttctgaaatcactaaaatatatacattgcctccaactctatagatgaatttctggatgaagttatatttgcaattatattttcattttggtaatcttcacaagcccatagttaaaacctttggagccagatgtatggatttagaaatatcttttggattttagaaatgtaaaatggtacatacacctaattttaataaacactccctctccagccccagcaaggtgtggggtagcaacctggaatcaaacacgttaatctgatgttctctgagaggaataaagattatagcaagtctcacatcagttcaggccaggttttctgctgaatgaattatgtaaaaccatttggtttcagtatgttttggatttcagaattgttaatgagggattatggaactgtattgtaattattttcattgtacagttttataaaaaggtttacagagattaagtaacttgcccaagttgtctagctaacaaggaagcttcacataaatccagcagtcttactatttgctaataactgctgtcctacatgcagtttcttcattgggtatttccaacctctggccatttggaacctaatgtgatgcttctctggcattcctctcctgcctcttttatttcacttctttttcagctcaaaattatttattgtttactttctccatcaagagaagcttgtgttctgctcattgctgacttctcaatctctcactgttctattgctattctcttttttgtcccttttggcaatgcagatttttggatccctccatgagaattatgatgttaaaatgcagattctcaacacacctcttacccactgactcaggatcaatgctagtggggcctgggaacctacatttctcacaagcatgctgcatggtttttaagcaccaagagtttgacatcaacagctctgtgttgtgccaaagctgatgactgttcttctcaggaatttgctcttcttgcaggcacagattttaatggcttgcacagtaagtgtactaacacccaactacctgcccttcaacagccacctgaagaaatgctggttaggcagtttgatcagttaataagtaaggtaagcataaggaaagtatattaatatgctaattacttgaaagataacatgacatacttggccaaatccttgtttccatagcccaagtctcattttctctccattgtcaaacactgcactgtaatgggtttcttctaaatatctattctggtttattctagcctgacctatgagtgaatatcagagtagccattgtactttccaaacaaaattttcctgtgtaaagaagccagatacttctagagtgtctttctacaaagggtctacattttctctcatcttcctatagtatgcggacactgtgaggaccagcatactattctttggctaatgataggacaatgtgagttatatgcaaagacacacacacacatacacacacatacacacgtacatacaaacacacacacacacaaaagcagcagcaacattaagaaagaatgattagtttgctgagaatgatgcacatgtaccctagaacttaaagtataataaaaaatataaacataataaaaagaaaaataaaaaaattataggaccaaaaaaaagaacgattaggaaatcacctgtaccctagatccagagtactttgattcactactggggatataaatctaaagggataatcacctattgttttagtcatgtcagcctgcacaggagaatccagaagcacaaatctattaccagaccatctgcttattcctcaagttagtgttgagaaatgaatcactaatataatcacatagaaaaatcttcctttttttaaacgaatgataatgctgaaaattacacttacgattttgatgaaagctgagcttaacaaaataaagtctgaatcttgattcaaactattaccaaatcagtttccatttatgtcattgacacaagttgtcttcatcattacccatcttttatttgaatatgtaagttttgaaacgagtgtgaaaatcctttaaagacaaaacatgacagtgcaatgcagctacttccatttccgctcacatggcaaccacccaaatttgagacaatgattttatagatggtcataaactatcatgtcagagacaatttccttgagatatttacatcgaatgattgtaaagtcatttgtgaattttttttagttataagcaaccttaggatattgatagtcattgataaaggcaagaacactcactgtctaaatactgcagagtcagtttatgataatatgattagttacactaataatgctgcttaggcattatcttgctaattacaatattataaatattaatgtcacagtctttctgtttgattgccactcatggagtcattcatcatgacattttcctggaacccacattgtaagattttatttctttcctccttttcttttttcattactggacttgcaaccatacacattactcttgaagaagggttttttttggctatctattaggagagggacagtgatattttctactaaaactagccaaatataagtcaattatatgatgtttctcttattctttctgagtccctaacccagtcatccaaggcagagtacccagggcttttgttttccattctttttcatgtgacctgcttcaagttaagattcatttgaattattaaatgcttccttaaagaatctttttatactgcctctcttttttttaaagttaattattgatgtagtgacaagctgaaaagactaagaattataattttttcctcccctcattgagggctcaagaaatgtcttctgacaatggttatctatttagaataatacaaaggaaatacaaaggcaaaatgctgaatgttgttttagcagtgttgctaaaatcactgtattatagaaaacgtaaatgtagtgtatatttcttggaaaatagcagttagtgagaaagctgggaccataaccgtttgagaccgggtttaaccacacagcagaagcagttacaaaagatactgattagattttaattttaaaaacttccttatattattcaagactacagtgatttgattgtcttgaaaatagaaaggtaatgttataatttccagaaagcataaagaaatctccagactcccactgggaagaatgccagtcatcaccacagtaagcaagaatttggaggcactttacactgcaaacatcggtcttttccttttatataatcttgtgttgtattggtttataaaaaggtaactcacagacccatcatatggctgtaatcaagtctccttcagaaagagtccactgaagaaatcacatccaggaggcactgtgtttcctttgttagtgagaatgtgagatggtaaataagatctgaaatagaaaccaaggctgagttctcaagaataacacaggagatttaagcacataccttgtccatgagttcagctatacgtggaactggtttccctttctggtgactcacagtagctggactctgtccatcccagtcttgtagttcttcaatgcttttcagataaagcagggctttgaggccagtgcagtagtcttcgatcacagtgaaatcctgattctgaatggcactgcatacctagaaaagacagagcagtcaaccaagtgtcaaaccaagagataattctccaaacaaattcacttttctttgagtcaacaaatatttattttatgtgccaggcactgtttgaggcatgatggatcagtagccgtctggagatgggggtggtggggaggaatggactgcaaagaacacaaggaaatttccagggacaatgaacatttttcataaacttgcaatggtaatggtgtcacaggtatatacatgttccaaaacttattaagttgtatagtttaaatagctacagtttattatatgtcaggcttaaggagtcgaatttggcacaacataataaaggacatttaaattctcattgtcactctattgggatgtgctgcctgcaggcagttctcacgtctgaaagtggtcaaactgaggttggagtgctgtttattacgttaactcaaccatcacttacccctgcctctgtctccctcctcatctgctattgttctccttgttgtcaactatgatccagttacccaggtctttcctttcttcctcaaaaaaaatgccatagtctttctttgccttaggatcttttcacaagaccttctcactggctagaaggcctttcttttccacacatggctaactaccaaccattcctcaggctcatggtaaatgtcccttcttcaaggaggcttccaggagcccagaataggttatggccttcttttaatcagacatttttaacttctaattattgcattattatttagttgacaactcacttcccaattagaccaaagtttcagaagggaagaactgcatttattttggtcactatattatctgcagtgactaggacactgtttgtctgttagtctgctctccacaaatataagatgaatgaataatgatgatatggtttggctgtgtccccacacaaatctcatcttgaattgtagttcccataatccccacgtgcagtaggagggacctggtgggggtaactgaatcatggggatggttatctccatgctgttctcgtgatgatgagtgagctctcacacaatctgatggttttataaggggcttttccccttttcctttgcacttctccttcctaccaccatgtgatgaaggatatgcctgcttccccttctgccatgattgtaagtttcccgaggcctcccccagaaatgttgaactgtgagtcaatcaaacctctttcctttataaattacccagtctcaggtatatctttttatttatttatttatttatttatttttggagtctcaccctgtcaccaggctggagtgcagcagcgcgatctcggctcactgtgacctccacctcccgggttcaagcaattctcctgcctctgcctctcgagtagctgggactacagggacacaccaccatgtccagctaatttttgtatttttagtaggaacggggtttcaccatgctggctaggatggcctcaatctcttgactttgtgatccacccgcctcagcctcccaaagtgctgggattacaggcgtgacccactgtgcccggcctcaggtatatctttattagcagcatgagaatggactattacaaaagattaaaaagaaaagagaactaaaataaaaaattctggagttaaggaagtttgaatcagagaaattaaagttcttccactaaaaaaaccctggggattctgtgagtgtggctgggatttgagttaaagcttgaagaatgtggatttagatactgcttctaggttgcttatttccaaagatatccctccaattttgatatcacatgtagactccagagagtcatttacaacttcctgtagaacctcttcaccaacatggcccaacattacatcaaattcaaaatttacaacatgaattcaacatacttcccaatttatatttcaacttcaaacaatgaaacaaccattaaaacaaaactgagcaaagaaaaactcatttctatcctgttttcccagatgttgaatacctagtatatcagggtgtctggcaatggcagccaacaaagaaaaatcatgtcatgcatgaatgaaaaagaaaatgaaggaaatgcctgaaaacagaataataagattctatttcaaagactcttaaagccttttgggtctttgattaaatacattttattgtaagcctcgtgcctagcatgctacctgatacctcattgttgctaggttggttgagagaatttattgaaaacatactaggaggttccagaatggggaatgggataaggagagagagagagagagagagagagagagagagagagagacagaactctcatatatatatatatatatatatatatgtgtgtgtgtgtatatatatgtatgtgtatatgtatgtgtatatatatatatatatatatatatatatatatatatatatatatatatatatatgcctaggagttctcagcaagcagtggtagtgattccatgatgtgtacctaaaaaaatgccaggtgtgaaattctgggaatgctagcacttaaaaggaaggctaaggaagatgatcgtgagggacaccgagcagaagagatccaagagagttaagtcaggcgctgcagaaaggtcaggaatatcagagctggaagcgatgactggatgtaacactcggcaatataccggataacatttgcctttataggagagatctgcaatggagtagatgccggtttttttggtaggttgaggaatggatgagggatgatgaactaaagatatgcagccaggtcacatttctaagaagtttggctcctgtaagaggaagaggcgagctggggttataggttatagggttttgcattttgctttttacttttatttttgagacagagtcttgctctgtcacccaggctggagtgcagtggcacaatcatagctcagtgtagcctcaacctcctgagctcaagcaatcctctcacctcagcttcccaagtagctaggactacaggcacacaccaccatgcttgggtaattgtttttggtatttatttatttatttttttatttattcttatagagatgaggttttgccatattgctcaaactcctgagctcaagcaatccgcccacctggcctcccacaaatgctgggattacaggcatggaccaccatgcttggcctgcattttatttttttaaagaatgaaaataattatgttttaaggagatacagttattttacatttcagaataggacagactgatttctgtgtatgagatttctgtcaaaattggctgaatgattatgcgatgagaataaaacaatgcaatatctaacatgatgcgggctcttcttaggggccaggcactttgttagcacttttaaatatattatcttctttagtcctcaagataaccctaaaagataggtttaattttcagccccattttacaggtgaggaaagtgagtcttaggaaagttaaatgacttgctccaggccccatggttagaaagtggtggcaccagaattcctggccatacaatagaatatgacctagatatagacattaacagaggaaaaacttttaatataactacaaatactttcctacaactattgcatggaccaaatgcatacgtttttaaaaatttaatcaagttatcttcaactgaaatatagctctggttttgaaaaaatccacacttttagacaaaaattgtcaatgttttcaatttaccttcttacttgtacagtatgagtaagaatagtaacaagccaaaaccaaaaagcagaaacaaaaaccccttcattttctattctgaagtgctgcatgttagtacaatgtagaaaagagtatagaataactactaaatatgaacaagaacattttctaggaagcccatttacatcagattaaaaaaatctgtttctcaggaggaacaatttgaacattaattaggcctgttataaccttcttagagttggtggtgtttttttctcacaacaattataaggaacatcattatcatttcctccacaggggtattttttttcttttgactataaaagtcaactgatgctttacttaatcctctttgctcactctgagattctatttttttgtagtatatgcttatgggtatactttactatagtcttaaaatagttcaccatgtgaacataagaaatcagattttgaaaatcacataatgtcatgtactttatgggattttcatgattattgtaaaatcctgctgctaaaatgaatctagaaatacactgcaagggatgaacagtaaagtataatctaaatcatccctgatgtttccaggaagaagatacaaaagctatgagttatctcaatcctcaaacatggcacaatttgtatacagtagactcagacaaggagtggagtgatcagaatgtagacttgggatcttttaactgtagaagaacatggtaggtcccaaggctaagaaaacttcctctttcccacccacttctagactctttatcatacagggttggtgtttcacataattgggagctatactgagaatgtgaactgaacacaaaaccttaagaggaaggagagactacaagatacttactgagcaagactgggatagtgtgcaatgctggaagccctggaatccaccatgagacacgagtgctggaggggaccacttcagatatacttaatcatatggcaaatgtcacaccacttacgtacctttacaaaatgagtagtttaatttttacttccaataagattaaacctactaattttcctgatagaatttttgatagtaggaactttgcacattgatattttcttttaaaattttgttgcacatacaaatcaggtggggatctttttaaaatgcagattctggttttgtagctttagagtgggatcctggagtgagatcctgcattggccaaattttcgggggatgctgctgctgctgctggaccacacttagaacagcaaagtcttaagcactggcaggggtgaatctcatctcaactgaaatgctgactgcaaaaaaaaatttcttctaaacaaataggtttcttcttaatttttactattagattatatcaacattttcctagcctttcaaagaatgcactacttataataagaagtcatgtttgaagaaacaagaataatttgctgattaaatactaataagactaaaaataaaacttaggatgcaagtgcaccattgagaacagctttgcccatggatttgatctcaggaaatggaattgcttagaaagatgccttgtccttgcctaacttatatactccattgagggccttatcgctatctcaaaggtaaatcgttcttgttaaaactccaaacatgtagctgctatgcctaaatgggtgcattttatatgacatctcttaattgtttgtttaacagctctgattaggactcttaatagctgttaacatgtttgcttagtataatttgtaagttctttatggtgaaggctggtttatctttcttcacagcagggcatcaggtgccattataaggatcgttgccaccattaattatttctatatgtgtgaatatccctatagtgagctattttaaagagaggcccctagattctcagcaggaccagccctacacaggagcagagtaggtggtggcccccgtgcagcgtgatttgacgtgttccataaagcaccaaatagcctcctccaggggtctgacacagtgccctgaatttttactttaggtgcagacgcatttaatagaggccgacctgtgcagaacaactgtacaaatacctggatggtaacagagggttgtggggagctattcttttctcattatttctcataaaatgagattaactagattatcagtaaattacctatttatggagatttacgtcttcaaaatcttctttacatacattatttctttcagtactcaaagctgacttagtcaggagagggagtaatattcttacttgtaaaatggaaagagcttggacttgaagtcctgtttcttaaagtcaatcttgtggtttctatgccatattaagttaagaggctgagagcatgcacacagaagtcaagcagaatagagttccaattacatcttagctgtgtaatcatgagcatttttttcacttaaaaatggagattaaatacttagcacataggaaactaaaaggcaacatacttaagtgcttaaaatagtagcttatactcagctacattggcaccaaaattaaatttcatactatgaataaatcattagggcatgaattaggcaggatataatttttttaatgtaatacatttttggtcaaatactgcagaggaaaggcatggaccttatttttatttgcattaaataatgatctccaaaaaaaaaaagctttggttttgttgtcagaagactcaggtctgagacccaactcttgtcatctggcagctgtgtaactagggctagtcatttagcttgttgattcccttctccctcctttacatctgaaaaaggaggatgataacatcttattgttgtgaagattaaattataccatgaaggtggaagtactgtggaaattataaagcttagacagaatggtactaaacctcataggtattgtagaatttcacgtaatctagaatttcaagtgcctggcagaggccaaaatgggaagttttgcctattaaaaaaaagctcacttcatctgaaaagtaaaataaatttacaaggaagctatcaaataaaatctaaattagattaaaaatatttatcccaggtaaataatttggcagagaagagttctacaaaagcaggaacaccctgagactggcacatgcttttgtgtaatcaaatagcacatttttcaaatgctattttaaaatataacaaagtttaaaaatagagatcttgatctattaaacacaactcagataaacccatgaccataattatcccttttcatttcttatcatacaggtggataaactacacttcaggacttagaagtatgtgcctccaggttatatgcaagtaaaatatatgcttacaatttaagtctaaagttgtctcaaatttactgtaaattcattagtaaaagttctattggagaattactacatttaagcaaaaacggaaattcttctgcaatggttatcacatcacaaattgcattaataactgagttatgtatctggaagaggttcaagaagcctcccatgaatgtggttcatatatgaaacactgaataagaagggttgttcatccaattcttaaagctttctcaggaaaaagaaggttatattatctcttcttactaacctattttgataagcacatattttgtttaaactatgcaaaacatctgcaatattttatatagcactttatagttttcaaagcatgctgtcaaaaagaaatatctatacaatgatttatagttttcaaagcatggtgacaaacaagattaaagggaatttagactttttttcagaccagcttcctcatttcagagatcaggagtccagactggctaaatgatctgtgcatggtacacagctagttggaggcagtgctggcagacccgcctggtttgaagctctttctgctacaacactgtctgtcaatatcatcgtacagcagttctaagagaaagacagagaaggtgctatgaattgttcagtaagtgaggaaattgaaaccaaacattgaatgcagtgcccaaaatcaagattagtaactgggagggccaacagtaagactcagaatttctgacctctgcagagctttttatcttttctttttattattatttccataaatttcaaagccttaaatgagatgaaagtcttacatatataaacaagcatatatgtataattttcataaaaagaagcgaagtgatttcacatttattagttaattattatgacagaaatccacagatttttaacatttaaggttttaatatttggatgacccacttaaaatttcttactttaactggaaactaaatttctcctgttttcggatgttatgcagtttctaattctatctgtccacacctactgattaaaaaaatcagattttctgaaggcatggaatcaataattactcacggaattgagttctgaccagtactaacaaacagatgtataaaactacattgtactttaaaaatggatgtacaatacatatagataaggtaagaattcagaataacaatatccgcctatgagcttttggtactacataaacatggcattgcttactggaattcatgaataaaacaccaaaattataattttataaaaatataggttaaaagacagcccctggagatacatagtaaatagggaactagatggggatgtatttgtatattcacataaaaccacaaatcttagttgttctatcatattagtttctatctgttggagctgtacaacatcaaagtcatgatgtccctatatattgcatttagcagtaatgtaacggactacgtgaagaaatcaaagtgagagtttctaagtagtttcctggcaattgagacagcaggctctctcatctgctctgtaactgtggcagtgcattgatttaaactccttctgagatctcaaatgcttttatattcttaggtctctcaagcagctttttttttttttttcccaaagtgataaaattccagcattcagcagaataccatcttgtttcccccaaaaggagagggcttatttcagctttgctacgaaactgcacaggatcactaagtaaaatagctgtccaaatgtcattctactaagaaatctggctttgagttcagttgtctatgttctgaccacagcaaataggattgggaaaaaaagaacaacaaacgaatagccccggagatgttgtttttcaaaagttcagttcagaaaaattgccgaaatggataagtagttctgcttattaaatattttcaaagttgtttttaattgccactcattgatcagtccaaatggtataggagtcatttattttgtaaatcatatatttcttctcagtacattacttatcctctgaaacgataaattctctgataaattttaagtataaaaatttcccccttttcctccaattaggaaggaactttatgtagcctgaaagtctatttttcagtgtaactctgtggtcattctttaattaatttcttaacccaagatcagctaaagacagactgaagagaataatatgttttcaaggtatattatactgagatccaaaccacattttgccagccagaatataatcatcaattctccaagtattttctcaaaggcagcatatgatgggccacccactcgactactattcagaagagcatttgtgagactgatcttctctgttgcactttgttgatgacacagtttcactgaagatggcctgcgctgattagtcaaagggctgtgccctgcaggcgagactgccctgcccccttccttgtatctgtcctttacaaagtgagctctaactggactcagatctcaataatgactgcaaccaagaaataataataagaaccatacagagacacagcacctctgtctgccttttatgtgacactagagataaaatgggtgagacaggtacaacatgtagggccaaagaatggtgattactgttctgtctcttcaaagatattgctgttgatggctctgcttcccaacgggcataaatacaagactcaaaagactgaggtaacaactggagtcttctacacaccaggatcctatgcagcccattctttggttaggaactgtggctgcagtttgaggaagcttggccactgctcttcagaggcagtaggatttttctactaacatcgtttctcaccatcaggctttggtgctgcatcagttaccacagcaattttcaattactctgcagtaacacaggtggtggtgtaagggtttgcatgtagcattgtgcatgctcagcacctctcatgataaaagtggggtaagaaaaggaaactaaacatccaaacaatagctgtcagaagactcaaatccttaattttaggcaatctttctttttcaacagagtcaacacagctgggaaaacttgatttatcatatcattcactaaaataccagatagagtttgatcacagaggagaagtcataatgcctagagagaaaaagttcaggaaggggaatatcacactctggggactgttgtggggtggggggaggtgggcgggatagcattgggagatatacctaatgctagatgacgagttagtgggtgcagcgcaccagcatggcacatgtatacatatgtaactaacctgcacaagcacatgtaccctaaaacttaaagtataataaaaaaaataaaaaaaataataaaggatgagttcagaccccccccccccaaaaaaaaaaaaagagaaaaagtctatagggaaaattaacgcatggaatttttttctgaactctgaagatggatgaaagttatgtggtcactcaataactaagcagacattcacattccaaaaaaaaaaaaaaaaaaaaaaaaagaacaactcacctacaatgagaaacatttgttaacatgaaaataacatctcaaatagtcctgactacctctgaaagcattcacaattcagtagttggtgtgatagttaatctataattgataaaaacacaaatttgtgagagagtacaacttggctgttatcagtgagtcaacaattttgactgagttgccaatatattctgggacacaaaagttaaagttcagttgattaagagtgaataaactatgtaagagttaagcgttataggaaaaacaaaacaaccttaccaatgttgaagttaatatatggtaaacacggtgcatatttatgggagggctagagaagcaaagcaataaggtttgcatttgttaaaaggaacttttaaaaatactaaactcatttttaatccctttactgtgtatatggaaaaataaaagctcacaaagtttgtggttttgcagaaagaccaggaaaataaattgtatgctagttttttttggctttttgttttaatgaaggccaagaacctaaaagtaaaatgcctggtcttcagctacaaaagatggatctactggaacatggttacagacaaacaaatgcaatgtccaaagaagtagttttatttatgccttctcactaaaagggcacatattttatgatttgtgactctgacaacctgaagaaagattacaaacaccagtaaaagttctaggctgagggttttaggaggatgcttagagatgaccatataatttaccatccaaactgtgacacttgagagtaaacaggaaactattagtgaaaataccaggaccagcagtataaactgggattgtcctgtaccactaggatctgtgattcccttactcagagggtttttttcattcctgtctttatattggagggagactttcacttgtccctgtggaatgcattccaaaatgctccgtcacttttggtttagtttaacattctggtctttcagatacttatgcaggcctcagagcattaacattggatctaattcaccaggcttttattacttaggtggggatttggaatcctggagacctgacttgatccaataagaggacccgacttgatcctgttattgacccagataatcctagatttaaagggtcccttttggcctccaactttaaaaaaaataattaatagactttgctttttagtacacttttagatttacagaataattgggcagatagtacatagagtttcatacgcccacaccacccccaaactcggcaccttccccattattaatatcttgcattagatggtacatctgttacagttaaagcaccaatattgatatgctattattaaaattcatagtttatattaagattcactctttgcattgtacctttctatggtttttgacaaatgtataatgacatgtattcatcattagagttttatacagaatagcttcactgccctaaaaatctactatgctgtacgtattcatccccctcaccctcacctcccccatcccctggcaaccactgatcttttttactgtctccatagttttgccttttccaatatgtcgtataattgaaatcacatatatgtagctttttcagattgacttatttcacttagcagtatgcatttaaggttgctccaggttgttctgtagcaacagaatccattcacctattgaaaaattatcacagtttttttcaactttagtaagaacttcatatattttaaaatataaaaccatttttctatatagccaaataatattttaacagttaataaaataaataattccttagtgtaatctgatatccatagtacaatttccataatatttttatagctagtttatccaagcctaggttcaatccaggactgcatgttgcatccagttgctctgtccttcaaggttccttttatctggcacagcctctttttcattgcaccagcctgttgtagaaaccctactgctggagtctggctgctttgccacagtgttctttacatttctttcctctaacccttgcatctcctggaaacttgtacttgtcttgaatcttgttgaactctcacacaatgtggttcactagaattgggtcctcacagggcatctccagcgcttaatgggaatggggtggcagggaatgaatggtggacattgcctgtaatcatgggcttgctctgctgtcccactggacttcagtttaacccttttatgataaaagatacaactcagaaacagccaaacagaaaagatgcatagggcaaggtatgagggaggggtacggagcttccatgtcttctccagacactcctccaagggtctttcagcctaaaaaaaaaactcaaaggggacaggggaggcaaggagctactcaaaatccatatcctttaagggtggaaaagtttggtgtattttaacaaacttaatattctgtccttttgtaacttatttctttatgctttacccaaattcccttatgattacagcattttgaaatttacttaggttacttattatgttttaaaccctgttcaaaatatgtctacatgtagcaccacattgaaactcacaatagcaccttgggtaagtattattattttcttcagttagcagatgggtaaatatggggtcagaaattacaggccttgattaagatcacacagctactaaatggcagaacaaagattaaaattctggctcagtttgcccacaggatcctttcttgtaaccacagtgcagtcctgctttctgttctgaccactactacgaaggcaactggctttcatgtgaaaacagggagattttatatatatatatatatatatatatatatatatatatatatatatatataatctatatgcttataatgcatatgtgcgtatacatgtttatatgtttatgttaatgtatgttttatatgtatgtgtgtatatgtttttaggtttatgcatacacatacatatacacacaagcatctatatacacacaatattgtatgtatgatatacaatatatgtacatatatttatacatagacacatatatacacatatatacctatgtatatgtagtatagatttcttgtaagtattatatcaaataaaacatacataattatctacttcagtgcctaaataactgcacaataggtatcatcatttggatctcattcaccagatttcagagacacagcaaaaagggcagagactatatttcttttggttaccattgtacacccagtacttaccacataaagatctttgcctggcatatgacttattcaatggatgaatacatgaagcaaaataaaaatattgtaatagtatcagtcagtgacaaacacaattccctttcattccctgtccagaatacatttttctctccaattatacgaatatatcataattaagaactcacatcaatccacaagagaatacttttctctcaacttttgctgcactctatatcactcattgcatcatttatacattaatatctttgcattattacttaactcttctttggatatgccaatgtatttcaaggatgcagggagtaactctacttcttcagcatttttcttcatattcaaagtactatttgtcacagacaaactggacaaagcctgtgtatagatttttgcatctctggtgttcccagtctggatgcctgagtcttatcagcaattgtcatttgattatgttttctcttatgatagtcccctttaacactaactgaaggaatgtataattaagaaccctataaaagatctcatttaacaatgactgaattcacactatcaaatccaatatatacaatgttctaattttcacacatatatattaaagcaatctggattctaactctaataaaggacagataaaacagagcccagagacgctaaggaaaaggtcttctatcttgttttgtgtctagactctcttatctaatttttttgggtttctgcatcacgcaccaatagaggtcagtccagcattcttgggtcaggactaatgttttcattttaaagaattccctctctatctttaattatttcaagttcataaagttcaacacttcatcaaattactttgaaatagttcaaagtaaatgataaaatgtattattgagcaaatttgtacaaatattattgccattgtaaatgatttgcttcctctaatacaggtcctgcaaaaccactgcacatgcccagtaaaggccttctctctgtttgctgggaatgtagccaggagtgtttaatagattattctgaatttttaccagaagagagcaattgtttttgtttttttcctctctttcttttttcttttcttttctttctttcttttacttttttttcttcctctttcttctttctctttgtttcttttctttctctttcttctttctctttctttctttctttctttttctttcttctttctctctctctttcttttttttttttgacagggtctcactctgttgcctaggctgaatgcagtggcatgatcatagctcactgcagtctcaaactcctgggcacatgcaatcctcctccttcagcctcctgggtagctgggactacaggcgcatgccaccatgcttggctaatttcttaatttttttgtagagacagggtcttgctatgttgcccaggctgatcttgaactcctgggcttaagcgatcctcctgcctcagcctcccaaggattgggactataggtgtgacacactgcacttcgccaagggagctatattcaaactcatcatttcttcaaaaactttctctattactcaaaaactacctactaattaatttattctttcattcagcacatgttaatttatggactaatcttccggtttcttttcacattcaattatcaaacaaaattgttgactgaagcagcctgaggttatgctgtttgttttctgtcagaatgaactttccatgcagagctgttgtgaggaccaaatgagataagaattattaagtactgtttactaggaaggcctcccttgttggtataggtgtgacacaatgcgtttgattcagaggtaagaataattattcaagttctgaattttgtatctgaatgtgcaactggtgtcttctgaggtgtgtgtgtgtgtgttccatattgactaatttctaagatgagttgctccattgagctccaggaccaaaatgatcatatctttgttgtaaacaattaacttaatcacacacagataaacatataagatcgaattttgagacaaggaaatgacctgactttcaattgttatgctttgagagtataaaccagaatcatattaccaccgcctacccataaatcaatatactacaggttttaaatcaattattgaatatgaattaggtcaaagaaaaggtaaataaggtaaataaatacaggtaagttggattttatgtgttttatatttcatttttgtctataaaatgtcacactttaaaccattgcttatattttgaatctgcttataatcaacattacctaattaaataatgctcagacatgcaatagaattggctttttttaaactccctccagattactcacatttattttttgtgttttagagacatcaggccttataaatgtgcaacagtattcttactgtagctgtgtaagaccaggcatgtgtaatgtgtgatgtatttggccatacaaattcaccagtgattaaactgattttttgcttgtgtcattgtttttaggctcaatgatgagtcgtgaaactttcctctcacctcatattcattgctacatctggtgtcatccagagttaatatccacgatgtactgattgatttaggaagatgataatgagattattgcttatgcccttaaagcatgacaactgaaatcccatcattttccacatgaggaaatatgctaaatattataatatctgacaggtctatcactgtgggattaagccagctatctgaaacaaaggtttgatattttgatctttagacatattatcttctttcgtcttacaaacacagaattgttgatttggagataatggcagtttatatttgcatgcctacatctttaattccacaaactgttaaggtcctcctggttcatatctgccaaacgaagctaagagcaaacattgttctttcttctgattatgtggggcatgaccatagaataggggaagagaaatgtttaacttggagcatttatatttcaggccaggagaatctggtttaaaagttttcaaaagactgatgagccacaaaaatattaaatgtgtaggaaatctgaccagttaaacaaaatgaagaaggaatgtttcctgaatattcaaagaaggcaagttatagaattggatgagcatgtgtttaaagctaataaatgtagagcgtttttttccctcccccttggagggaaatgttttatagaccatttacttattttattttaaaatgtacatttgatatgaatttcatttcttttactctttcctcaaagattcataatcttctaaaatttagcttcaggaacatatttctgagaatgacaagagcttactgaaactggcctctgaactattcaaaacacagttgcttattgtccatttttaaacattcattggtcgagacttacagtaaggcattcctctctccccttagcatctgtccacaagcaagtatgcacatatctgctttgtgcctaatattatttcaattactatgaggcattcttaagaagtgaaaatgcacatacatcctagctaggagataagacatacattcatttatctgcattggcttgtacatgcattttcaggcttgagacatgtctagaaagtaggatagaaacaaaaagatactagtgcctatctgacattttcacggaggtgtttcctaggcatcttaactatagccagaataccattcctagtttttccactcactgcagcctactactccaccagtccaaagtctagaaatcatctctgtccctttcttttcatgtccacaaccattcaatctctcagcaaatcttgtagcactacttcaagtatatatcgtgaatctatttgttgccataaccacagcttcttgcaactggaatcaatcatggtctctcacttgcctcactgcaatactttctttattcactcttgaccctcctaaattaattatctacacgacagctaagatgattatttaaaaatattaattagatcataatttgccactgcataagaccaacaatgtcttgcctcactttgcaaaaatgggaacactttctacaaagtactgcatgatctggtcctgcctcgttggccttccttcagtatgtcaagcttatttctgccttaggagctttgctctgtctttctgcaatgcctttctccatactttcccatagctggatgaatcttctcattcagttctcagcttaaacatcactgctctagagacgactccccagccagacaaggtatcctcccagtcactatcacacagtctaatttaaattctaagttaatgtaaagtacttaccactatctgacatttttcttatatatctgtttcttactaatgtgcctggtacccatcagacactcagtaactatttgctgaatgaatagaaattatgaccactacataatacactgtttgataatatgaaccttatgactgagtttctcagcagatattagttattgacagcttcaaagccaatctctccttgatatatttaacttttcttaaataatatacagttttaaaatttaaataacttgcaacattcataaacatttatacaaagtatgattagtgcttatttgtaaggaaatactctaattttaatactttaatacatggaacacacttgagaaatatagaaatgcttcctacccaggatgccttaattaggcagacttatttaaacgtgcttatttttaaatttggcaaggttcacaaacattaattttgttacattgctgatactaataatagtatacatatcttaaataaaggtattatgtcattttcccgtaagactttgaagaaatagaactcctaagcatgagtgaaatcccccttacttgcctacagatttttctccactatgaatcgctcccaattcagatttcaaaattcagtatttaataacttcattacacatattatttaagctatctttaagtatgtgggtttttaaaaacattattatggtataatttacatagcataaaactcgcccactatacgtgtgcaaggcaatgatatttttgtaaatttatagagttgtgcagcatcaccacaacctggttttacgatattccaattacccaaaagttttcttgcatcctttagcagccactgttcaccacctccccaagcttcaagaaactactgattcgttgtcctcataattttgtcacatccaatcatttcataaaaatggaattttataataacaaatattagtattttgtgtctttttatcttcatttagcatgtttttatacatgtcaaaatattctgtgctattatggtgtcagtctattttattgctgaataatatctcattgtatggatgtaccaccacattttgtttaccattcatcaacctgctagggatttagactgtgtccagttttggggtattagaaacaatgctgctatgaccatctgtatgcaagtctttttttctggatatatatatttatttgtctgagatagatgatgtggagtggaatttccggattgtatggtacatttttgtaacattataagaaactgccaaactgttttccaaagcagttgcaccgttttatattccaacaagcaatgtgtgaggattccagtttctccacatcctcaccgtcattaagtattatctgtcttttgatactagccattttagtgggcagaaatgtcaacatagtgtaccggttaaaataacagattctgggccaaattgtgtaaattcatatcacaacttgccatcctgtaacttaacattcctgtctatagaatgaggacagtaataacacctgtcttagcctgtttgaacatgctataacaaaaatgccatagactgggtagcttcaataacaaacattcatttctcacagttttggaggctaggaagaccaagatcaaggtgtctggtgaagacttgcttccaggttaatagatggccatctttttgctgttttcaagtggcagaaagaataggggctctctggagtctcttgaataaaagcaccaatctcatttataagggcaccaccctctgacctatcaaacctttgacttaccaaaggcctatctcttaatactaccagattggggttagtattccaacatatacattttggggggacacaaacattcaatctataacaataactatctcacaggattactggaggtataaataaattattacaacttttagcttacaaaaggtgtgtctcatagtaaatttcacatacaagttaaccatgataatttttttattatcataatttgcaaagtgacaacatacttaacctggctgtggattatagttaggctttgggaagctgtttatgttctcttaatgatcgcttccttacatgatgtcagcttaagatagttaagatggttatcacaatgtccaggcactagaatgctaggtactgtgaaaatcaaatcacagattttaaatgacaattagaatggttaaaacttctaaatggtcagattgacctgccagactacttcagtcaaatacgggactttgaatgaatgattgaaccagtggtttattttactaataaaatgtacctgtccatggggataaaaaaggaaactgctgtaggtaagctgttttcctttacaaaattgtcaattgtttgaccataaggaccttcgtcctctgttttctttatcccatttatttgtttccttgtcttcttcctccttcacttgactacgtgggtgattaatggatcactgctgctttgaccaaggaataaatggagaaacggcaaaaggatgatattccccctctcgagttactaaaatgcccattttagacacttttctagaaaggcacatgtgccgtctgcttgtcaaatccctttctgattaatagctttagaagatgttttgcatgcatgcttgccagtttttaaagcacattactgaaagcatttcagagcacttctcctgggtttccagcaacaagcagggatcacttctccatgcttaggtcactgctgtactaatttctccaggttccagcaagccttgggggtaccaatagaattccctaacagcagccaaattttacttgagaccatccaacttagccttctgtattgcatcctgggagtgacttgatttaggttatgatatggtaaaactattataaaattgcacactattttcactcacctgtgtaccactcatagtcatatgaatataagattcaactatttatggattgtcaaggttttctccatttctgaaagtctctgtttctatgaaaatagcatggatagattctatctagttttaaaaagaagtaggccaatgaataaaagatatatgaaggcacatcctccaaaataaggcagaaattgtgtataactttatgaatattcaaccacgttggataatcacaagtgtagaagagagtaatatagtggattaagtgccatactgggccaaaccacagggtgttgaagaagctttcaccaggtgataaaatccagaaggactgggtagtggactctccagaaggatgaacttcaaccaatgcatgacagaaggcagaagggaatagaagatacatttcctctccattttttcctgtgatggattaccccaaggcattgctttctagctagtctatctggagttgttccacgtggccagttggctgtcttgtctcactgaagcttgtgaagcagtggctaactcagtaatgcattaccttgtattcaagtctcatctttctctgtctcatttccatcttcttttactcttgctaccctagaattttatctcccaacaaaacattaacacttgaccctttccttgggttctgctttctaccaccctgagctaagatacatactagtcaaaagctagaatagagggctgtacattttattttaaaatttggcataaatgcataaaactactagcagactggatgatgatgatggctgatgatgataattaatagcttgcatctgtggtacacatactttgcttcagatactgtatgaggtgctttgcatatggttgtgaatcctcacaaccatactacgaggtaggtagtattattatctccactttacagataacaaaattgaagtataaaatgttcacacgtctagtaagcccaaggtcatatagctaatgagcaacagagctgggatttcaacccaaacaatttgatgcattttcatttgggttgaagcattcatgaataaggtggagttctcagtgacttcctgttcttatttggtgattctgagactgatatcactacctgtccagtagcttctggaaaaggtcatctgagtccttgccatattatttatgattacaatagcgtctctagagagccgaagtccactttctttcaagaatgtatggttgttgaggcatctgattctctacctcccaggctattcaaattgtatgttcaaaaggaggcaatgaaaaacacacacttagttcaactaaaatctctcatacctttccttgtagtagaggtttatgaaaggtctacgttattttatatttaactgagggcacttgtagtttcatccttgaatcatttttacccaccatcacatagtgcataccacattcctcctgcgcacaaacaggcacgcccatgcttaggcccatgacactccatcacgtgactggcgctaaaatataaacgttcccattttgtgtggtataagatacttgtgactgaaagtgacctaagcattctttttgcctttctgttgctctatttaaaataatgactacagactctctttcaacaaagggtcatttgtgtcaatggacagaagagaggatcagatcacctgcggtaattgcaaattaatgttctcctggtaatgcactaactacacactattgatctacaattgaatactagaggctactgataagtgatttttactttcctgcttttttgtgtgtgcttttattgctttttccataatgcatttttctttcaactggaattttctctaattgtctccatttttaatttcccacagtgagatgacttctaacttgtaattagaatctgtaaaaattcatgtctctgtctcaaaagccttttagaaatctactgaactgtaactttgatgccataaaccacatatatgatgcacagatacatagtttgagagagccaagctttcgaattttttttttattaatactcagataaaacagaaatccatttggccctctatccaaaatagcaatttgttgagtagtctgcagtaaaacattcaaaagtttcccctaaaagcattttacttggagaacattgatgacgtgtttttctttccaagagcaaacttttaaaatatgagtaaacggtttattacaagataatttttatttttaagtgtgtgagagaagcggggcacagtggctcacacctgtaatcccagtactttgggaggccgaggcaggcaaatcacttgaggtcaggagttcgagaccagcctggccaacatggtgaaacccgtatctactaaaaatacaaaaattatagccagatgtggtggcgggcacctgtagtcccacctactcagaagactgaggcaggagaattgtttgaacctgggaggcagaggttgcagtgacttgagatcacgccactgcaccccagcctgggtgacagagcgacactcgtctcaaacaacaacaacaaaaaagtgtttgagaagaggatgcagatttccaattgagtaaatatttatacacatcttcacagcatacttttgacaatgttaaattttctcatgtttgtgtcaaaaccttaattgaggatctggcaccgtggctcatgcctgtaatcccagcactttgggaggccgaggtgagtggatcacctgaggtcaggagttcgagaccagcctgaccaagatggtgaaactccgtctctactaaaaacacaaaaattagctggacatggtggtgggtgcctgtaatcccaagtacttgggaggctgaggcaggagaatcgcttgaacacgggaggcggaggttgcagtgagccgagatcatgccactgcactccagcctcggcgacagagcaagactctgtctcaaaaaacaaacaaacaaaaacaaaaaacacgttaattgataataattattctatctggtggaaattaacacacgtttgtatttcagtgttgtacttgatcatgctccctgtttagacagaggtcattcatcctaaatctggtttctgaactgtggtctagaaatcacctgaaatggagagatagtctgacagtaatttccttcactactatttgtaaactttaagcttatcattgattttctgtatttctaaataagagacatagttgtgatttctaagtgttttcaggcctgtaagaactttgatattttactgtaatttcttttacaatcattatttgcagctagtcacaattaaataccatcaaaataaatgtgtgcccaaattgtttgcttattttttattcctaagtcatgattatctgtaccaaaaaaaaaaaaaagtaataactgtcaaccgcatggctagaattatataagtctggtactctttcttttatcagtttataactagagacagatacaattacagttgatattcattttacaagcagtcttagggctggaccagagtgctgatggctccctgatgtgccaatcattgttggataatgaaaagcggggcaacaccagggtggctggagcaggagggagatactcggaggactgagactctgaattgtgatactcgctttatcatattaaatatcatttctgtcttattacaatccaatgagataggtactataacttccattttatagataaataaaccaaggtttatagaggttaaataattagcccaaatttatccagctagtaaatgttgagcaaagtattataaaacttcaaagctccttctcttaactaccatagtatacatgacaacagaaccacatctgtatacataatgatagcacacaaatactgtaaagaatcttcaagcttaggatgaactgagatttttgaaaaatgttaaaactaacaacagggttacattacaatatacattaaaagtccagagttcactatgaatccatgtaacaaaactgcacttgtaatccttaaatttacacaaagaaaaaaatgaatgcattaagaatgaggaaactgaatgtactgatttatgaagaaaaaacaaaaaatgaccaaaaacatacttggtattaggtatatacaggtataaggtagagcaattcagctttaatttcatctcactaataagagctacccatccgcctttatacagaggttctcagagcttggttatatttttggtctagagctggagtcattcccgtctagctactgtctaacattgtcttcctcccttttcctcttttctgttctgcctcagcctttagacatcctagatcaaacccaaaaagtcaataaataaatcctcaaattttctaatcttggacgatggttaggaatgggaccttttcaaatctactccataagcaataaactcagaagaaatcagaagtacatcaacacaaggaaaaaaggaaaacaagaataaaataatgatatgccaaatcaaaagtgatgagtgggctttctgagaagaagataacatcagagggtctagtttgttgtgaacacattgaaaatatggtgaccaaacatgagactaattgtaaataggcctatataaacatgagtgtaggtgttaggaggataagagattttaaagtttggtttgttagtactgcaaagagaaattgccttttgaaaaggcaaaggtgcctaaaaaattaaaggtaccagtctgaaaaaagcccagaaaaatctaaatttgttttgaaccctttagaagaaagatagtaatcatcaggtagagagagaagtcctttaaaaaggagagtggccataacccatgagtttcattttataataagcttataattcagtgttatttagaaaatgtaatgaagaaaagttataaagaattgggacagtacacacaaagcaaaacagtggggtacaaaactgaatgtcatgaatggaaactcttagagaggtagatgcttttgagggaccaactgtgaaatgtatttttgtggtctgtattttcattttttgttgcaagataaatagagtggcaaaatctattctcatctgaacccttgggaaaatttttaaatatattaagcacatgatagaactgaatgattctggaaagagatgtgtgttagtctgatttttgcattaatatttaataatgttttcccttgtatagaaagttaatgatgatgtcctaccattaacagaacatgtgctttggagacacgtttcctctagaagtgatgaatttgagttgataaaggcacatttttggggcctgtcacccttgagagtagtaaaaattatttataagcagctaaccaagggtgaaggaggcaaaaagtagccctagaagagaggagaattaaaattatgaaggataaaaaccattatttaaaaatgaacaagatgccatggaagtacaaagtagaaaaggcctactgagcattcactccaggatctgaggaaagcgacagctggtgtggtgttggcctgtgaaaatgtaaagaccttgccactctttggagacacttcactcctcaagtgcagaataacatctaaaatcgttatcatgacctgaagtactccacaagattcatctctgcctatgtctttctcttcatttcctatcattctcacctctgttcagtatgtcttgccatgcctgaaataggccatatttgctcacttgtataactacgccttgatatttatactgttgctctttctctggccaggaggacactcttctctcggggtctctgaatggctcaattattttatcattgctatggtttgaatgtcccctccaaaactcatgttgaaactcaatctccaatgtggcagtattgagaggtggggtctgtaagaggtgattggatcatgacagctctgcccttatgaatggattattccattcacagattaatgcactatcatgggagtgggattcatggctttatacgaagagaaagaaagacctgaactagcgcattagcaagcacaggcccctcatcatgtgatgtcctgccccacctcaggactctccagagagtctctgccagcaagaaaactcacaccagatgcagcccctcaaccttggacctctcagcatccataactgtaagaaatacattccctttctttaaaaattgcccagctttgagtattctaagtaacagaaaatggactaagacatcactcttgtgagggagcttctagcatgcaagcttcctgagggcaggtctcaggtgtctgagaatatccttgtatccttgatgcttgagctctgcctgggatatagtggggctcattcagtgataaagatgccattttatgatagttcattgaggacattattttcattttcctagataccacatttcaaatgtaactaagataaactttttaaaagaagctatactgtttatcttactgtcaattatatccctctatggtttttccacaaaatcttctctttgccatggttgtctccacttcagatgtatacttaagtttttgtacccaagaatagaaccttacttttgtcactaattaactgtgtcttctcatattagatcaatcacacatgcatcttctgatttttctgagtctactttgtgatttactctttaccccaagtttactccaaatttcatgttatccaaaaatgtgatcaaatggatttctgtgcttcccccaagtagagcccaggagccccagagtagccagtcttctagaaatctcaaagttttctttactcagcacgtggaaagaatgttcagaattcaaaataattttggaaactgaagaagtcagggataaattacttaataaagacaaaaacaaatatctcacttataaaattatatgattgggtataaacaaactactcacagatagagctcaagaactaagaagaatcagcaattaataagtgaaagagcaagctttcacacgtttattattttgaattcctctttcattttgctagcacatttcttgagtacagtaacagggagggtgggggatgcagagacaaattatagaatagaaatcaggtaacatggttcctagtcctactggaaagtcaactgataaaatgaacccaaggaaattacaaactgtgaatatgcaaatctataaatggggttaaaaatgcttattgatatacccacagcttcataagaattatataaattaacatatggaaaaggctttttgaaaaaatagaagataatattcaatagatcattaatactctttataatatattttgctatggtctaagagctctctaaattcccagtacagtccaggttttctagatctctaacttagtaccaaagtctataaaacattgaaaaaattttaaaacaaatatcaaagtgtatacatcaaaatgaagtggtcttttcaaaataatcacctgggaagatgttcgcactactcagaacaattttggaacatttctctgtaaactggtaattaaaatcaatttatgaactaacagaaaaaagactcatgactttggatacctaattcactcaacaaccaactttgttcattcatcttggctctctttagctttttaaaatgggaatgaaatccattcccaatatataaagagtagttactacattacctccccaaataactatttctaatagtcatttggatgaacaagacacagttattaaaaaatcagttacccatccaatcacaactcatttcaagtgacactgataaaccagaaatagaggaaaggaacaaagatatacaatgtttagaaagtaatatgtgaaataagaatatctaaacaactgagattttctttcaaaatgaagaataaaaatagtagtttaagactttggtcaagcatatgaagactctttgaaaaagaagtcagaccgttaattagtcacatctctgcatacaattcaaataggaacggacagtagaaaggatttgtcagggacaagaaaaaatttaggcaaggacatttatataaggtgaggaattttctgtagctatacgcctgcaaacatcttagctaactcatgattattctctaacttgaaatagtcattgtgcaatgctattatttttttctatagtaaaactgtctttcaaaaatattagcttgagtttcaattaatttctcttgaatctagatgttaatctttctatcaagtggagaatgtgtagtcactcaaagacgtaataagtttccatttaatttattctctttgcttataaacaacatttgttgcactagaatcaagatgctttttaaatatgaaaacctcttgaaaataacctttcattaaagtaatttaaaataatgtgataactgacacagcaattagaacatcattgaatggataaactaaaagcatttttttcttatatattattgtgagaatattgagtttccatttttaaaaatatctacttacatattattcttaaagttgtaagtgaaacattcattaaagccaggacacaagaaattgcataatggaaagaaaaaatatttctcttttaaccagttatgtgaaatagttctgattccatttaaaataattttgaatgctgtcaagtatttttactacatttgttaccctctggcctgaaactgaatgatgatgaaataaaaaattagaagttattgaataaatattttccacctacccaatgaaaatttgtaatatagggtgcaaaatttttatcacctaaagacacccgtcagtaaagttgaagcaatgaagcctctgtgtatattatgaccaagagataatatgggtaatgcatccatctgcactcaagtggaaacagtgtcatcgtgctgcttcaattacttctttttctctaattttaataaaataatacatttcctgatcacattaaaaaattccatttagcttgaactagctccatcagagcagctttgattattgttaaaaattgatttggttatctgagttcagcgagtggccgtcatgtgaccatgactttccacagcaaatgcccactatgcttcatctttccgttatatttcaggattttctattaactttagtgacaaacccacgcagaaaagatagaattaaacacacacacacacacacacacacacacacaaacacacacacatccatacaatctcaatgaaggcacaggtcataattgtttgtgaattaactgataagttttgactttctgaatcaaagtccttaaggtaatgaattgtaatggcagtatcattaaattaaattaaattatagaaacctacagtcattcagtgaaaaaagtcatatagtatgtatattttttatctatagaggaaggtgaacattttataatgaaacctatcactgaaagcaactgactcagtctgagctttggttgtaatacaaatccctaaatagtttttcaacagaaattatagtctagtacttgaatactagaaagaagatacaggactcattgggaagataagatctgggactaacagtgaaatcaaaacttaaaaaagccaatgttaatttattaaagttctcccttcaaactgttttgaaggtgaattactagttatttatttatttttctcttcatgaagaaataattggcagtcagaagcaaacttctttttttcagagtagccctcaaaaagatttcaagacctcaagagtttatgaataatttgagaatataatttaacaggaaggtttttataaatatcagtacctgaaatttactgataattttcatctgtccttttcatatttctaatttgcatattctaactaatgaaatcctgtcaaataagattaaaaaatcagggatttcaaagacactgaagttcacttaaataaattagaagtcagttgggttgactgaagaacttataagagcatttacccaggaaggcaagcctgtaatcggttttgaatcttatttctaggccacggtgttacatctggttctgttgtaatagtcattttcactccaaagttgtactaggaaaatgatctggagtacccagattactctctagctaattccttagtttttatattcaggattcattgaagcattttatccattttaaaattatacagatttaagtgtactgcatgatgttttgttatacatatacacactcaaatgatcactacagtcaagccaattaacacatctctcattttacacagcaacattttttttctggtggtaagagtgtctaaaatctactctcttagcaaatatctagtataaaatacaatattattaactagattacttgtgctgtgctttagatctccagacttactcatctgacatgactgcaattttgtatccttgaactgcatctctttgtaaccttcctacttcatgcacccacatatgataactacagttctactctctaagtagtcaactttttttttttttagattccacatataagagagatcatacaacattttcctttctgtgtttggcttatttcatttggcatagtattctctaggttcatttattttgacacaaatggcaggatcttttttacagctgaacaaaactccattgcgtatatatgctgcaatttcttcatcattcatctattgatagacacttaaggttgcttccatatcttggctattgtgaataatactgcacagaatatgggagtacagatctatctaactatctgtctgtctgtctatctatctatctatctatctatctatctatctatctatctatctatctatctgtctatcatctatctatatgtagtgctgatttcatttcctttggggatttacccagaagaaggatcgctaggtcacatcgtagttctgtttttaattttttgaggaacctccatattgttttccataatggctgcaccaatttacattttccccaacaatgaacaaaagttgccctttctttacaccctcatcaacatttgctatttttatcttgtttgataatagttattctaacaggtgtaagataatatctcattgtagttttgatttgcattttcctgaagatcagtgatgttaagcatctattcaaatatctgtgccatttatgtctcctttggtccattatttactcaggttctttactcaaagatatttactcgggttctttattcaaagaatattaacgtctacactcaagacacataactctcattcatttttctatgatttcacattttttttcttcaaagatcctgagtaaaaaattttgaaatcaggttgttttttttttttttttgcttttgaattgtgagagctccttatatattttaaatattaaccccttaaaagacatatggtttgaaaatatttttccaaatccataggaagtcttttcatcttgttgattgcttccttttttgtatagaagttttcagtttgatgtagtcctacttgtttatttttcttttgttgcatgtcctttgatgtcctattcaaacaatcatagccaaggccaatgtctaggagcttttcccctgtgttttcttccaggagttttatgatttcaggtcttatgtttaagtctttaattcattttgagtttgagtttcagctgagcccagtattacgctgaagccaaacccagaaaagggtactataggaaaaaaagtataggccgtatctctgataaacatggttgcaaaaatcttcaccaaagtaataacaaactgaattcaacagcacattaaaagaatcattcaccatgatcaaatagcagtcatcttagagatgtgagaatgattaaacctatgcaaaccaataaatataacaacacattaagagaatgaatcacaaaaaccatacgataatcttaatagatgcagaaaaatcatccgacaaaattgaacatctttcttaataaaaactctcaaaaaattagatatacagggaatgtacttcagtacagtaaaggccatatatcacaagcatgcagctaacatcacagtcaatagtgaaaagttgaaagcttttcttctaatattaagaacaagacaaggatgcccactctcctcatttttactccacatagtactggaagccctagccagattaattaggaagaaaaagaaataaaagcacccaaatcagaaagaaaaagttaaatagactctgtagataccatattatatgtaggaaactcggaagcctccaccaaaaaacagaacagttagaataaatgtattcaataaagctgcaggatacaaaattcacatgcaaaaattagtgatgtttctataaattaacaaaaaattatccaaaaaagaaatcaaagagttaatctcacttacagtagcataaaaataaacacttagcgataaatttaaccaaggaggtgaaagacctgtatactgaaaattataaaacatgaattaaagaaattgaagaaagcacaagtaagtgataagataccctatgttcaaggactggaagaatcaatagtgttaaaatatccatactatccaaagcaatctaaatattcaatagaatccctacaaacattccactggcatttttcataaaaaaaatcactgaagagttttttaaggtaagatgattggatgatttaccattgaaatgttgacatcttgtcaaagcatgttacagaataagatcatagaaataaacagtgccacggagaaatgatacattccaagaaaattcgctcaaaaattttgaagcaaattttgctatgaaaagcaataattgggctgggcatggtggctcactcctttaatcccagtcttttgggaggctgagtgggtggatcacaaggtcagaagatcgagaccatcctggccaacatgttgaaaccccgtctttacaaaaaatacaaaaattagctggatgtggtggcacgcacttgtaatcccagctctactcgggaggctgaggcaggaaaatggcttgaatctgggaggtggagattgcagtgagccgagatcgtgccacggccactgcgctccagcctggcaacagagtgagactctatctcaaaaaaaaaaaaaaaaaaaaaaaaaagaaagaaagaaaaaagaaagaaagaaaagcaataattgcccaataaaatgtaatctgaaaccctaagagacatttcagtttatcaactgtgaggtggaccctatttagctgatgtgattactatgcattgcatgcttatattaaaatagctcacataacctataaatatgtacacctactatgtacccacaaaaattttaagaagtttaaaaaaagtatatgccctttactgatcaattacattatactaaaatatattataaaataattagagataaatgcaatttggttttctcagcactgcttaaactagtagtgaagaagaacccatataatggattttataaataaatttcagtgcatttataatatgggataatatgtgaccactgaaggtagcactatataccgaagtatgttgagatgcaaaatgtattttggtatatcaagtgataataaggttcagtttgattatacatatgaaaataaataaataaaaataaactgtgaggtgatatacaatattttgtgaacttacatttaattcctcaattagcaaaaatttaagcaaatgatgctgtaacctaggttttttcttcaataaaaattttctaggatttacaaccatcattttttaataaaaatattatctttacaatgaagtctgtttttttcccacagcacttatcttatgttaaatataatacacttacatttaacatttattgtatatttttctgtctctgctcacaagaatgtaagcccaataaggtaacagactttagttgtttttttttttaattcacagaaatactctaaatttctacaacaatgctaagaatatatagtagggtctcaatacatatttattaaaaaatgaatgaatgaattattctctgtgatgcatataaagcaataaagaaggtatgcgctatcacacttatgcaacttatgaaaaaaattagctttccattcttgaaatgtcattactcttcttaatgtcagtcatatggcttaatttacaaacatagattcatttggaacagattttgaaattactaatttgagtgtaaatctttattttagcagtgaactcacttaattacataagattttgaaattactaatttgagtgtaaatcttaattttagtagggcactcacttatctacatagtctatacacatgatgaatagtgtatgagaaaaatcagaatcaaaatatttatttatattactatttctacacccattacaggacttctatttctatactctagtgtatcagcaccataacctagatatttaaatcaatttcatttgtctggttatacctgctataaagaattcattttgttggtacacatttcacttgtgaatagaaatcattagaaaggtggatttaataaatattgtaaaaccagagaacagaattcggttgggcaatgagaggcaatgaaaggatgatatgagagaaatgggaggatgatgatcaagaggctaagggctttgagctgtatgaaaaagattcgaactaactgcaagaaagaatttgaggctgggtgcggtggctcatgcctgtctgtaatcccagcactttgggaggccgaggtgggcggatcacgaggtcaggagattgagaccatcctggctaacatagtgaaaccctgtctctactaaaaatacacacacaaaaaaattagccgggcatggtggcgggcacctgtggtcccagctacttgggaggctgaggcaggagaatggtgtgaacccgggaggcggagcttgctgtgagctgagattgcgtcactgcactccagcctgggcaacagtgcgagactccttctcaaaaaaaaaaaaaaaagaaaaaaaaaaaagaatttgatgggaagtaaaaaaaaaaaaagacgaataaaaagaaatactgactagtacccaagccccagcagacattaaacactatgtatttggagtaagcccaattgcagagttacattaatttctctaataatattcaacagcttaaaactatactgaacgaaaggttaggttaacccaagattagggagtggaatgaagtgaaattcagttagaatggaagaaagatggaaatatatattctctaccctccactgaactaccaaactaaaattataaattcaaatatttcccaccttatgaccatcctaagtatatatatatatatatatatatatatatatatatatatatatactgattttaattcatactttagctaatattggttaaaaaaacatgttctggctgagttaaaaatctgactcaagctaatggcagagctgaaaaataatctttaaatttctacagattagattgccagctctctgggcaataaattctcctaggtattttttagctgaaattgtcttgatttcctcttcatttctgaagtaaaaacctatgtgtgaaactttacatttttaacaaaatcatttgggaaccaatattttaatagccagaaagtctctgggctattcccagctagagctaaagagataatgatttcttttataccatgtgaatccttgtatcccctcttcacaattctggtaaaaacaaaacaaaacaaaaaacccataaccaagcacattcatttaacaaactcattcaaccaaaatttactatatttctgttacacaccaagcagtcaatacatggggtaaccaatagcttatgatggggcctggcataaaaagataaatttaggcaaacagatttcctctcttagcagtctgagctgtacacaaaggaatataaatcatcccattataaagacacatgcatatgtatgttcactgcagcactattcacaatagcaaagacatggaatcaacctaaattcccatcaatgatagactggataaagaaaatgtggtacatgtacaccatggaatactattcagccataaaaaggaatgagatcatgtcatttgcagggacctggagggagctggaggccattatccttagcaaggtaatacaggaacggacaaccaaatactgcatgttctcacttagaagtggaaactaaattatgagaacacatgaacacatagaggggaatgacacacactggggcctatgagagggtgaaggatgggaggagggagaggatcaagaaaaataatgagtactaggcttaatacttgggtgataaaataatctctataacaaaccacatgaaaaaagtttacctatgtagcaaacctgcacacgtaccctgaacttaaaataaaagtttaaaaaaagaaatccaagccaatagacagtaagctattgggacatttcatggagaaatgagagctaaaaggctgcaatgtggcgtgggtctaagggtcatgacagccatgtgatagaagttcagaggaggcaagagtaagccatggagagaacaagagtggacagaaatttagtttcttctgaagaagaaatcacatggctcacaaaagagagatggcaaaggtcttgccccaggactgtcccactggttcttgcagttccagttccagggtcctttcatgtccagaatacaataggcttcatgtgcatagtcagtgagtttctgattttccatctaagaggagcctaagtagaaactgacatttgaataattatttcaccattcatttctatgaggacacatagtactctatgtatatttacatactaggatctgcaccctgagcacacatctacacccaggacacataactctcgtttagttttctatgatttcacttttcttctcttcatagaaacttgactctaagaggtaagctatagcctgaacatgtaagctttgagtgggcatggaagacttgcgtattactaatattcccgtcttacaggtcctgtgatggaagacaggcaatatgcccagttggaagagtatttgctttgtggctgtgaaactctagatgggaattctggctccattgctagtcatgtgactgctattaaagacacacctaagactgggtaatttataaaggaaagaggtctaattgactcacagttccacatggctggggaagcctcacaatcatgtggaaggcaaatggtgagcaaagtctcgtcttacatggcggcaggcaagagagcatgtgcaggggaactcccctttataaaaccaccagatctagtgagacttactcactgtcaggaaagcacaggaaagacctgcccccatgatttaactacctcccaccaggtccctcccacaacatatggggattattacaattcaaggtgagatttgaattgtaatctcacacagagccaagccatatcaatcacttttatcctccaagccttagttgatgtcaataaaaaaaaatatttaaaaatttcactctcaagtaggttgtggaaatactatatgtagcagcaattactaccagcacatggtagacagtcaataatctttacttccatgtgtgacttgcccatggtcacatctgacaatgagcaagagtctcttctgaaacccactcataactccattgtatccttcagctcaggtatttctacatgtggatgaaaataaattcaggtgatactcaagcctggatactgttatcttccagattctttttgaagacactgctccatattcttcctttcttcttgatatcctaaggtgccttcttttatcattttctttcttctgaaaaagctttctttagccattcttttggttaaggattcctggcaatacattctcttagtttttcttcagccgagaatgtcttgatttctggctcatttctgaaggatacaggattttgagctgacagttcttgttttagcatttgaaaaatgtcccactttcttccagactccatggcttgtgatgagaaatcccctgttattagaattgtttgtccccaataagtaaggtgtcatcttcctcttgctgttatcgaggttttatctttttcttcagttttcagaaatttgaatatgatggattttggtatggatttctttgaagctgccctctttggaagtctaccttgacctcttgaatctacaggtttatgtcttttgcaaaaattggaatatttttagccattattttttttccattcctgcctttttcacctctcctctgggactctgaggacattagtgttacatcttttgttatagtcccacagttccctgagggctgttttcattcttttcttcagtctttttttctctctgtttttcatattggccaatttctattgccaatttctattgctctatcttctagttcactgattttttcttctgttctcttattttactattgagcacatcagctgagttttatatttaagtgattgcatttttaagtccaaaattttcatctttatatcttctatttctttgatgagactttctgttgtttcatttgtttcaatcatacttgtagttgcttgttaatgcaattttataatggaggcttaaaatatctgacagataattatagtatctctgtcatgttaatgtgggcatctatcaattcttttttatgatccagcctgaggttttcctgggtcttggtatcatgagtaatttttaattgaaatcttgacaattttggtataatattaagagactcttgattttatttaaactttgtttctgctagctttccttggtgtcagtctggcaggggaagtggagaatgccacctccttaatgccagatagaagcccaggtatcttacttggctttcttggacacccgaggggcatggctcctggttactgctgggaggaggtgagaattctggctctccagtaagcctgcactgacacatccctggctaagagatgcaggcacgccttgttgctgctccctacttggccttcactgacaccataagaaggaggaaaggagagtggccttattaccacacggtgatgatgaaggtcctgactctgcactagacctcctctactactactgcagaaggggggaggacggacacctcattactctcaggtgagggtagaagtccaggcttctgatatgggatgggggtgagggctcatttttgcccagtggggatgtgagactgcttggtgagggtggacgtctaagatccctacttgtcctttgcttgcatggatgggtgtagggatggaatatttatccgtggtgttgggtggagcagggaagttatgtctaaaagttctctctcttgctagactgcccctttcctggttctttggctagagagagcaggcttttcatctgtgcctattgttgtttctgggctgttgagcttctttggctccaagtgtgagatgagatatgtgaggaaaaaaatcgcaggaaactcaccactgtgttgtttctcgggtcttgagatccctagccaatctgccttctcttcacctttcagtcttcttatatcatcagttttacatataagggtttttagctgtatacagtgggaggcacagagaaaagtaaatctattccatcttcttggaagcagaagtctgcctccattagctttctaatacatattatttccaccatagattgtaggtatttcatagaacaatgttaattctgattgtcaagttagcaacatgaactatttacactctacccttttgccagagaatatgtgatgccaaactttctgctttccaattaccatcaatgctaagtagtgagaagtcattattaatggagtattaccagagagttcacagttcacagtctagtcatataaaaagcttggtccctaggtcaattcagactacaaaacctgaatgagaaattcttatgctaaaatgtgctgacagtactaagcccatgttgagcaacattatttttaaaaagtatatgaatactttttaatgttctaatttttattattttaggggtattattaagagtacaattcactacatctcacagcatccctttaagaggacaagggaagaaagaagttccctcagctttgtaccacaagaagctgaacaatcaatttattttaatattttaaaagttataaagctaataatttatttctttggctgccaggaatctcaggatcaaatttggtaatgacatagattttcatacccttgatttcattttgtttttcaattgagattttacttttactcagatttcctcatgtattgtttttccaggaggacagtactcattttggtacctgatcttatttatttcaggatcacatgggtgaataaatgtattaagaaaagacagtgggttcgtaagccctcaacaggacaggaaataaacctcaggtctcttcataacttgtcagaggaacttaatacatgctgccattttgatcccaaatggcctccttttcaagaggcccaaaaacgaatctattttttttttgtcacataacttacattgcatttgtgagatggagatttttaaaagggacagacaaacacaatgactacctggaggacggaagcaccactatggagaaactgaagaccactttcagcagagtcaattccaccagtagccaaaatgggaaatccaggcagagcacgagcaatggaggtcacagctctcaaagcaataggtctgattgctgtccctacacaaaatcagaataatcaatggttagcacactgaccacttgagtatactgtcttatattacttctattactatgatgtgatgacagcgtcactggacaaatttcaaattactttatctctgtttaagatgtatatacatatgtagtgtataaatgttatgttttaaagcatgttaatttgttaatggatgtttatttattttaaggactttgataccaatattgaatttagacatgttatacaagtaggtatagcaaacacagaattctctgtgcacacatattacatgcatattacaattggatatacagtaatgtgtaaaagattgcatagaatatttgagcatcagtggctcacgcctgtaatcctagcactttgggaggccgaggtgggtggatcacctgaggtcaggagtttgagactagcctggccaacatggtgaaatcccatggctactaaaaatacaaaaataaacattaaccaggcgtggtggcaggctcctgtaatcccagctacttgggaggctgaggcaggaaaactgcttgaatccacgaggcggaggttgcagtgagccgagatcacaccattgcactccagcctgggtgacagagtgagactctgtctcaaaaacaaacaaacaaacaaaaaacaaggaacagcagattttgaaaagaaaaacaatcccatatagtacatcagtagacatacagctatgttatgtttctttagagtacaaagcagatgttgcgaacatagactctgtaaaaaaaggcaaggtgctgatgaacttacagattccatgttgctttttatatgtacttcccacaatttgaaaaaaaatagggagtctaatccaatttttcacatattagaaagttttaatcaagttaaagagaatttactagaatccagtaattagagtgtatgaatttaattttttaatatttaattagccagacattaccagtatattattccctaatagtaataaaaattgtatggatagaaagaatactttggggctattttaaaaatgagtatattgtactaaagctactttgaattctcaaatgttaaacatcccagagtacattaatgctttcataataaaggaatataatttgatattcctggtgttcccttataagtcaggggtcctttaagcattttctgaactaaaggcagttcaacttatgcaagaatttgacactgccttaaaccagggcttcacaaacaacataaacaaataactggttcagcctcacgtggtgagttctttgtcatcacctccaccaccactagtcaccagcaatatcaatatgtatttactggagtgcttactctgaggtagcacacacagccttcctttaaaaaatggccagaacttaaaattaaattaaattaaaaaataaaataaaataattaaataagaaaagaaacaaaaagttaaagggctttcaatttgaaaaggctagatagcatatgattccaactatatgacattctggaaaaggaaaaactgtggagacagtgaaaatatcagtggtagtaaggagcgaacgggagggataaataggcagagcaaagaggatttttaggacagtgaaaatactatatatactataatggtggatgcatgttgttatacatttacacacacacacacaaaacacacttagagaatgtatctgttacactcatagaatgcccaacaccaagtgtgaaacctattgtaaagttcggactttgggtggttaggctataggtgtcaatgcacgttcatggattacaacaaatgtatcactctagtggggaatgttgataatgagggaggtcatgcatgtgttggagcagtggatatattgagtatctctgtatcttcctctcaattttgctgtgaatctaaactgctctaaaaaataaagtctaaaacagaggctgggagtggtggctcacgcctataatcctagcactttgggaggccgaggcagagggatcacctgaggtcagaagtttgagaccagcctggccaacagtttgagaccagcctggccaacatggtaaaaccccgtgtctacaaacaaatacaaaaattatctggacttggtggcgggcgcctgtaatcccagctacccaggaggctgaggcaggagaattgctggaacccaggaggtggaggctgcagtgagccgagattgcgccattgccctccagcctgggcaacaagagcaagattctgtctcaaaaaaaaaaaaaaaaaaaaaaaaaaaaaaatcggtggctttctttttatcctgttcatatctgtttcagataaaattgaacgtttgcatgactactgcttttgtactcaacacaaaaatgtttgtggaaatgtctacttgtggctcccacacctcaaacatcttcctctacatattactatagcattccttagttaggaatattcaatgctgacacttcaaaattcataatagacattttggatacaaagtattaagttgggcaaattagaaaccggacattaagattctacttctatattatttatcagtgattcctcacagtttttatgttttaaccataaaaaggctaatagtggacagaatttatagtgagaatacaaaaacacacatatatatacacatatcttcagttatactaaaagaaatctacataacaaaagttaaaggaaagcattttttaaggaaagctgtaacaaactttttgatagacacacagctatctctgcataatataactggcatagccaatacataccaacccaatggcttctttacatacacactactttgaagtaataaagaaatattggtttttttcctcccttatttagttgacccaagagagtaaatttgagctaagtagataaataatttatttctacctccactgttagaagactatcattaacagtaaggggtaaaatttcaaagtggtatacagggatttggccacatattctattgatattaatggacataaaaaggcaacacagctttgaaaaattaaccagtgacacttaaagggcaacattattacacaggtgttaaaaaaatcagcaaattcttattggcatttgaagatgttcaattaggtcaataagacattttccaatttatgcttttcttcctttctaacgcttttataatgtacctaatgaacagaaaatcttttcaaaaaataagagtattttttcaagttaagagtaactatgttctctgaggaaatgagatccaaaaaatgaagaaatgatctctctgttgctggactacagtaaattcagtttttatttccattataaacccagtttgattttttataactcaactgatttaatacaaaatataatctacctgttctcagcatttttatggggaatagttcttaagaatgacttcatccactaagaacggtttctagaaggaaaatgaaggtatataaaaagatctttctaaattgctatgtagaatttatttttagttttaaaatgacagaaatgaagtaataataggttcaagataaaaataaaactgttggtttaaagaaaatacatatatcaatgccatacaaaattgtacatatgccaattaaaatcataaagacttcctgaattacaattatcgagataaaggtcttttaaaattttgtcactgctacagtgattaatgattttagaccaaagactagggaggaagaagccagtgtgagaagttcaaagaatgtgtatgcgggctctatctttaaggaaacaacaaggtttaaatcaagaaattgaaatcctatacacttaattgaactaacaggtaacatgcaatttaaattaagccctcatctacatggggtggccagatgaacctaatggggaattcagttacatcaagccattctgcttcaactgtgtggaatcctccaataaaaatcaagccattctgagttcccacgttttgaaacaagctgcaggttcgaacaaacaaacgaaaaatgaactggacttatgagttgcaacattgctaccaagaactttgctttgcattatgtggctcttgtggtggactagactgaactgtaacttttggtcaataatcattctaggccctccatgtagtcataatttaaaatacaaatcagtgtgttgaattcatagattgtcttagataaactacacagaacattcttgaattgattcatgtttcagaaaaacattttagtaagccagagattttgaattaagttaatcaatctgattttgatgaaaagtatttttcttaagaaaatgaactctcatttgtcagatatcattttaaatacaatttcagaaatgctatcattggctataatattatatattgatatatgtgtattaatgtattatgacaatcaggttccttactcagtcttcatttatccattcatctgtctatccacaaaatattttttaagcacctatggctttttttttcctggttcatcagtttgtgtcctaactatatatctacgcttgactcacaaaacaccaggtcttatcattgtagtaggttatttcaagttaataatttgaatccagttattcattctctaccagtattccattagaaacaattcacatttgttagaacattatacattttataaatactattaatatgaattctatcaagaaggcaatttgaggatgaactagttaccaacatcagagagacaactgggccaactgttgaggttcaaatcttagttccatttataagctgtgtgactttgtgaaaatttttaaatcccaccgaatctcaattttgtcatctataaaataataaaaattgtaataacgtcttcatagagctgttttgaagaataaattacataatatatataaaaggcgaggacataataaaaattgtagaagtgtttgctgttataatttgtactgccctcaaggacaattgatttcagagtgagcatttatgtagtttactttgacattgccttctatgttcttgtgtgtttagtgatgcaattaaaaccaatttttaaattggagacaaaagcatgatgcctatgatgacagaactttatcctctgaaaccttaagaggaccatacatgtcccctcctttttctcttttcctaacagctgtcatttagcagtgtcataatgttgatgaagattactttgaccccaaaggaaaaaaagcctcaaaaggctgacatcaatatatttaagattttttttttttgagaagcaaaatgtccatggattttaattacaatatctgaactcaagtttattggtgaaaaggaggcagagatgtacttcgcatgactaaatccttgaagaaaaaaggaatttttaatgagcaagagagtgtggaacatatgctaaataactggaattttgaataattgagtttaattctgtttgtctttctccccctaatcatttgactcctctaggacagcgactgttacacaattaattgttagaactaagtccacaataaactccctgataatagctctagctggcaataaaacagaaattgggttataatactcattcgtgctcactgtgtatgcaaaaagaaaatgtagttttaatttgcttacattaattaaaatataatgaattaagtggataacaaattcattagaaattgaaccttgactgtctaattgttaacagttttaacaccatccagaagaaaaaaaattagtaaatcaagaatttcaaggatttaggaggtgagagattgatttttataacctacatataaatgaaccaccaacaaatttatgctttactaaaattaagtgtacaatgttaatgaagttaatatactaataaatacatgggacacacctatttaaaaataacatctttacacatggattagggtcctctgagaatatttgcataattcaatcagaaactgaagtactaaaaggatctagggttatatgtagagatgtgtaatttaaagagaagaaatggaaaaaataaagttgattatttgatgttattttagttttttcagaaaagctaaaaatttcttctgaaaatgttttaattttagttgaattttttatgttttctccaagtcttcctatcttcatagctatgtttttctgcttcataatgcattcaatatgttcctagtggattcatattaaataactcagtacctagcatgtgtcaggcatttatttttaccaagagaattaataacattcaccaaagagggccattctcctttctgaaagtgtcagctactgttactggaatgagtaggatcactcattcatagagtgatttccacgtgcagacactgaggcaggggcttcatgtacactgtgtactttaacccttgtaactctgaagctaggtgctgtcctctctattttgtacataaaggaagagaagctcaagctgaataaataacttatccagtgtcacgtagtttaaaaaggatgtaatacattaaaaataaagtctctgcgacatgaaagttcccattttcagttattattgagaagtgacaatgcagcaattaccaaaagaaccatctctggattatttttgcctaagaaaactagtatcagtacagactgatgctatgagaacacagaggaagtccaaccaattaggtgtaagtctcaaaccatttgctttatacaattgtagctttgagcaagctcctcaacttcctaaaacattggttttccctaattaaaaaacaaggacattaatactaataatattccagggagtttggatgtattagatgatacaactcatgggaaagacttggcacagtgcctagcttataatgtgtataagctaatattagtgtcaaagccagagaaaattgatcagaaaaataaacattcagctataacacatataaggataaacacttaatttttaagggttgttaatattcattcctagatataacatttggggttccttttgtaacccatatattatttcattggcttcaaaattatgaatattcatagcttgagtctatggtagtaaatgtgtgtatctgtgtgaataaatctttattagatttttaagtgtaatttgcaacgtgtgtgtgcgtgtgtatatatatatatatatatatatatatatatatatatatatatatatcttctaagtcttttttgaagaatctgttccattagtgcttagacacaaagttacatatacaacaatgttcctggaagtattactttctatagaaaaaccgtagaaaacaatctaaaggatcatgagtagttactctattaaataaattatagttcaccaagatatgatattccagaaaacctttaaaattgacacgcaaatagctctaatttataatgttaagagttaatcacaagtagcagagcaatatatatggtatgctcccattgttggcaaaaaagtatgtgattacatttagtatgtgtgcatgtaaatgcatataatgttgaatttcatactgttcacaggtatcatctctgggaaagggggtgagtcctgcagtaaagggattgaagacctttcaagtttatatatatatactttttattgttggattctttttgataaaatggtgttataatttacttctgtagtaaaaatatctatttttataatgttcctaaaattcaccttacgagaataagcatcatcagtatatatgatgtgacatttttatatatgagtgatacatacagtgattctatcctctgtacattacaaagaacatgtttggttctgtgtccaatattttagataaaagatctacaaacacaacagagtgaataggatgatctctcttgatctgtctttctcacacacatatcatatatatctatatagtgattaaaagaaatcctataaatggtcatcaaatatttgaaggataatcatgaaaaaaagggcttatcctatgtagcaaattggaacgaacaattcagcatacacgattggttttattattcttatttttataattaatttattgtaaattcagcaatgaaagcagctacaatggaacttccctattccttgaatcttgatggctacttgacagcaagatgcaacagaaagacttctctgtactacaggaaatattggattagtttttctcttccaattcaaaatctggggatactataacttattcttggtagtttaagagcaattttatatgctctatagttttccaacagataccagtgattaacttagaaaagaagcaagtatgagttaacttttaagattaaatatgttaaatataaatgctcctcttttgagtgctttctaattgacagatagtttcctatttatttttgcatacattgtgctggtcacattactatgaaatagatatttctgtctctatttttatagatgtgtaaactgagattcagcagggataaatgccacatcctcaagatcactctgttagaaagtatgggtccagtatttgaatccaggcctacctgactcccaacaccatgctcttaaccacaatgctatgctgcttcctgattttaagtgtctggatataaattaagctttagaaagaagagttaataataataattgttataattaataaagatatattatccaggtatgataaaaccataaaaatcaacattatagaaaaatagacattatattaattgttggataaaaattaaattagaagtagaatagctagtaattgtataactagagtaaccatatagcccagtttgcccaagagagtcccagtttattatacctgtatttatttgtaattacataatgtaacaatagctatcttcctttggtctaaaagtatcccagttcagatgataaattataaaatcatactagctataactaaagataattatgtccaagaataataggacaaagacaattacagaagcaaagtgaaatttgttttagaaccaaaaccaaatttatgaggagcttagaaactcactatactgtccaagactcaaaagatggcatgaagagctaaatgtctttaaatttgtcactagagagaaaaatatatggcatttactaggcataattagtctatatgtatgttctttctattttcaacctgtaggtggccaccacaagctacacttattaaacaactcattagtagcattttcaatactgtcatcttcagataattagcaatttatttaaataaccaatttctgtagaaataattgccatgaaatgccctgaacctactttttataaactataataaaagtgttaagataatccctgacatttgcaaatgccattagttcacctttccttttgatagtgctatggcattatgtttaaacaattacccgacaacacagcagtttaatgaaacagtacagtgagcacattcttcaatatggccagagaggacattcagatttagaaagaaatccagtgcgcagagaggtttacccagaggaaaaacacagctaaaagaaaaagaattactgaattaaggacattattgctatttccaagttggtttagtttccatggtagatgccgtatcatatgtactctctttggaaacaagaaaggagagttttacaagttgatttatgtgataggctggtgtgaactataatcatatatatctacgaatatgtataataccttcattgtattatttgctctaaaaccttgatgcaggaacaagtagtaaatttttcttactatcaaccttaaatgtacttttactttaaaaatggtgtgcactttcaaagtagagttattgaggaaacgcacaaatggttttacatcgcagctagtatttatcatttaaaatagaccagagttctaactcagtttcttccttgctattcagttccttatactactaagatccattgatgtgggattatacagtgtgtcttggttgcgagtggtaaaactatttgaagcctttataatttttaagctggtgtccacttcatatgaaaaaataaaattagaattcaaagccagtggcaatattatttttatggttagactgaaataacttgagaacctattaagtaccagttgctctgctaaattattcactcgttatttatatcctcacgacatcattacaagtcacatatacattatctccattttacagacatggaaattcaggctcaaggaattaaatagtatgtgcatgtaagaaaggcagggccgtgtggttagataatgcattacaacaataagacaattagtctgcaatatcaccataaaattcactgccgggtttgaatgtgaggacttttctttatttccagattaacacatgcctcaatctctccaaataagagcttctggcaatgctttttgcctacaattttaaaggtttacctataagtataaatagaagaactatttaaaaaagacatatttccccagccaagaaattattctcacctatgacagacttagtggacttgaagtaatatttctcatgtgattttgcttaaggatgtccagagcaaatgttacacagcataaaaatctcaccattctatgtgttttcaaaaatgattatttgagtaggagaaggaggaagattataatgacaatgataatgccgatgaccggagtttcattttactcttgggagaatccaggataacaagtgggcattattctgagaacatacagaaaaataaaaaagaggttccacatccattaggatcctattacttcttcctttggaaaatcacaatttcttttctctctgaaatcctgtgctctgtttactctgtgggtggttctatggccagggtgtccatggcagcacttgctgtactgtaaaaccattcctttcactctcagcaacacattctctttcactttacaaagaattacatgtgttaatctctatgctctgtgataaggctgtgtccctcagagtctactgaaacacaggctgtacagcagttgatggcgttttgttctcttctttggcctgtacaactctcaaagatgtggtgtggacaaggacatctctacctgggcccttatctgaaccctctgaatcaatgctcactctaaaactgaccaggcactttgaaaaagagagatcctactgtttagttgctctatcaattagttgacaataacatttcttcctaaatttcaatagggtaaaaaatgaaaaatcattttcagtcaaaattatttcttgtacccagcaccatggctgttgctcaaaggcagcagaagagatgtctcttctcagcaagcttataaggctgggtcaatgagataaaaaacatggacaacccatgttcacatgcccaattttgtgggtcagacaacagacactgctgaaacttagaagacaaggagagccaggaaatctgaggtggtctaggaaggctttgaggaagatgcaggacttacttcagttgggctcttgaaagataagtgggtaggtctggggctaaaaattaggatatttcaaactgtggcagagtttgggaacaaggtgagaaaaatttcagatatagtaatgaacaaatcatatttataaaacacgttaacagcaaaactaaagtagcctctcaggttgggaaatggtatacagtgcattacatagtgtagggatgttgcctcgtaggcaggaaaacagcctacccccagctctcgcagctaccaatatcaatttctatatggcattttactttttaaaatgcattaaaaaatattgacctagtataagaataaacaggtttaaatttaaacaaaatatcaagtaagggaagttcaaagctatttattgttaataaaaataatattcctattttaatagcaattgttaattattaataaattaataaatattgctatttactgccaataaaaatatttctcaggggacactaaagagaatctgtactctttatacatgtccctgtctgcagcctttctagagatcataaagttctttctagtctgatgaaaagtaatattaggatttttatcaaacagaagggataagaactacaactagaataatatgatccactttttcataatatagagagcttatataatggaagagaacaagtgttccactccattcaaccattcagtaactattgccagtaatgtgaattatcattttcacagatgcatctatacttttaacaaacatcataaatagtgcaggaatctgtagcatgtattaaaaagagcatatgatcaaaaaactaggaaaggaaaaagaacttaagactacattatttcagacaagatctcctaaagtattacctaaaggaactgtaatactaccctagagcatgaggatatggagcaatctggcaacctctcttaacataccacaagtcagctacttgccaaaaatgggaagctagtttcaagctgtgcatatctgtgtggcccctgagacccctgatgtttcagggctttggactacaagctgaggatgtgcctcaaccaaatggatgataaaaactagtagtgatttgtatagccactgagtaggcatgaatttctaatgtatctaatacagaaccaaatagaataaaatagaataatctatgtaaagcaggcagcacagtgacaagcacatagtaaatgctttaaaaatgccatcactacagtttctaaaaatataaaaggataataatagaacaatatgagcaatgtcatacaataaactcaacagttgaagtgaaatgcacaaattccatgcaaaacacaactaaccaaaattgagacaacaaaaaacagaaagtcaaaattaaaaatagatccataactattgcacaagttgaattcataataaaaaacattttcacaaagcaaactgcaagcccagatggcttcgctggtaaattctattaaactaaaggaaggaataataccgatcttacacaaactcttgtagaagatagaggaagaatgagccaatctcaactcattttataaagccagtataatcttgatattgaaacctgacaaataaactaaaggaaaataaaattatagaccaatatccatagactcaaatatctgtattaaataaattcagcaatatataaaaggtgtaaagcatcatgatcaaatacagtttatcccaggaatatgaaggtaatttgatatggtttggctgtgtccccacccaaatctcatcttgaattgttaactcccacacttcccacgtgttgtgggaggaacccagtgggaggtgattggattatgggggcgggtctttcctgcgctgttcttgtgatagtgaatgagatctgatggttttaaaaacaggagttgccttgcacaagctctctttttgcctgctgccatccatgtaagatgtgattgctcctccttgccttccaccatgattgcaaggcctccccagccacatggaactgtgagtccaattaaacctctttctttggaaattgcccagtctgatgtatgtctttattagcagtgtgaaaatggactaatacatggtttaacatttgaaaatcaattaatgtaattcaccaatcaactgaataaaagagaaaagacatatgagtatctcaaaagggtacagaaagtgtacacaggaaaatctgaaatccatccgtgatgagaactgtaagcaaaacaagggtgagactatcctcaatctgacaaagaacatctataaaaaaacctatagctaaaatcagactttatgttaaaaaattctttctctatatactcttcatactttctatatactctattccatatactcacaagaagcaattagaaagttaaaaaatagtattcacaatagcaccaaaaagcaacaataggagtacatttagaaaagatatgtaagatctgtacactaaaaatattttgtaaaatatttctgagaaaaattcatgatacttcagaaaataaagagacatactaatcatagacttgttgactcaatactgttaagatgttaaacttcaccaaattgatctgtagattcaacacaactcaaaacaaaaatccaaaaaggtttctttgaagaaactgataagctgattcttaacattatttaaaaatacaaaggatgtagattagcaaaaacaatcaggaaagaaaataactcaaggacacgatttcattttaggacttgctttaaatttatagtaataaagacaatggcattagaatatacgacaaataagtgaaagagaacggagtcctgatatagtcccacaggtaaggccaattaatttttgaccaaggcaggaagtcagttcaatgaggggaaaaaagccattctaacaaatggtgtgagaaaagcaggatatttttaagaggaaggggggagaaaagaaaagaaaagaaaggaaaaaaatgaaaccatggcctctacctcacttcatatacagtttttttaaagattcaagatgaattgtaaatctaaatgtaaaacttgaaaccataaagttcctagggagaagaaaaggagaatatttctgtaaccctgaattaggcaaaaatttcatggaaaggatgttaaaagcaacgactaatttaaaaaaaaaattgataaactggacacttgaacaaaatacatcattaagaaaataaagaagccaaagtctagaaaaaaatatattcacacacatatattttaaaacgaactcatatgtaaaatacatgaagaactagaaaccaacagttaaaagattacaatagacaaaatacttgaacaatactttttaaaaagacatacaaatgatcaataaatacataaaaaagtgttccacatcagggaactcgaaattaaaatcaccatgagacaccattttaggcccacaggaatggctaaaaatccaaaagactgataacaccaaatgttgataacaatgtggaacaaaacgaactctcacatgctgctggaaggagtataaaatgataaatcacggccaggcatggtggctcacgcctgtaatcccagcactttgggaggccaaggcgggcggatcacgaggtcaggagttggagaacagtctggccaacatagtgaaaccctgtctctataaaaacacaaaaaataagccgggtgtggtggtgtgtgcctgtaatcccagctactcaggaagctgaggcaggagaatcgcgtgaacatgggagacggaggttgcagtgagccgagatcacgccattgcaccccagcccaggcaacaatgcaagactccatctcaaaaaaataaaaaataaaaataaataaataaataaagataaatcactttggataattgtttgacagtttctttaaaaaatgacatacatctatcctatcacccagcaatttctttcctagatattcactcaacagtgaaaacagaactaaaaaagtatatgtacaaaaatgttcatgacagccttacccataacagctcaaaactggaaacaactgaaatatccatcaattggagaatgaataaacacattttggtcaatcagtagaatgtaaactactagcaataaaaatgaaatttctactgatgtatgtgacaatattattttaaaaattatattgaacgtaaatgaggccagacatgtcccctactcacacacacatggaagtagcagggaagaaaggtaagaaagagaaagagagaatagaatgaatattatttagtttatatgaagttttagtacagataaaaagagtctatggtggtataagtctcagctggagatggagaaattgactagcaagcaacccaagagaactttctggtgtgaaggaaatatcctctgtcttgtttcagattgtgttactacagatgtgcatcattttgaaagctaacttatctgaacatatatcatatctgtgtattatattgtatttaactatactccattaaaaataaaaatatatgaatacataaataagaagtagcaaaatgtccatctcaaaagtgagcatctcctatatgaatccacttctaaaaaattcttttgatggtcagaatctttcaaatacttaattttatgaaatatgaggacatcttcccatttgcaaatagaaaatgaatctgtggcagggcacggtggctcatgtctgtaattccagcacttggggaggccaaggcaggtggatgacctgaggtcaggagttcgagaccagcctggccgacatggtgaaaacccatctccagtaaaaatacaaaatcagttggtcatggtggcaggcgcctctccagcaacttggaaggctgaggcaggagaatcgcttgaatctgggaggcggaggttgcagtgagccgagattgcgccattgcactccagcctggccaacaagagtgaaactctgtctaaaaaaaaaaaaaaaaaaaaaagaaagaaaaaaagaaaaaaaatgaatctgtgagcttatattttaaaggtgaatgggactgaagatcatcatctacagtacatcatgtaaggtaaatcaatgtcaacttagatgacccagtgagagcaatttttatggtggtgttgctcttgttaatgttcgtaatctccatgaaattttcttgagagcaatgcttttaaagaagccacatatatcacatataagcacgtacacacaaacatacacatacacacacacacattgtcagtgataaatcactagttactaagaataaggacacatggagtacaaaatgatgagcatataaagacaggtattacggctagactatacctctaaatcgtaactcttgaattagccaggcatgctaaaaatcactctatttagaaaggcacagcttcaatgaaccaaagaagcagtttggccctttgctgactgtagtgctaagtgagaccccagagccaaatttcaaaaaatgccatcaactgatcacaagtattgttaacatataatgagaatgtctgtttctgcactttatgcccaaattggtatttgagtatatctttacctctccaaaacgagagaggagtcactcaagggtgttattcctattaaaaccttgtagtcataaacttaacttcccagacaaatctttaaggaatatttggctcatagttatgtcaagtctatggtggatttgtaatgaagtatcctttctctatttgctattttttcaatctttaatgttttctgatgaaatttcaggctcttgtcaaattgaggtcattactttgtctactggcatggatatgcaggcaaattggccagtgtgcaaccctggatgactcaacttattgccaaatggcagttagctaacttccatttgcaagaagaggagacagcctattgtcaggaccaacttggtggggaaaggatatatagtctgtgtctaatgcacatatctaagcaaaatgtgatgcatatatttttccacattcgtagatgctctttcttgtttttttccaatttatattgttgacataagtgtctcatcgtccaaatgcttaaattgtgtataataattccaaacagcattcgaccattcagatttgggcattgggcatcacagatatgttaaatctagttacagaggcagagctagagcatggtttccatgccttgaggggagagacatttttcagtaacctttgccaaaaccgctatatactgtttttctcaacagagctcagagactcattgtaattgtgtagaagtcaacagaaatcatattaaactataacactttcaaattttttcaagtatatttgcaatccagtgtaaatagggccaatggtcacaatgtatatatttttggaacactaatatttgttttactctaggcaagtgttttcacaggtagtaactggtatgaaaaagatctgctttcactctagaagattatttattcataaacttcgaaatacaaatcataagactcccagaattctaatttactaaatgctgaatatattatgaagcagttcttaaaatttaaaatttgaaaatggaaatgtattgaaaaagtttcagaaaaaaatgatgtatttcccatatccagcacaaactgaactagagaaacatattatgattgccaaaaaacgggctatcactctaaaggctgtaggcaaacaaaatactaacaagtttaattattcacaatggcacatttatggagagtataatgtcacaatcaatgattacaagcccacacaaatagcactgtaataatcctacaaggcgtgttcagaagtgaaataatttagaatttgaaatcaatagcatttatagacattggaaaatgtcaaatggaaaacgaatgccagtatttgtattctttctggagcatttttacttctcagcttttaattattctttaaaagattttttagtatctgaaagcaaaagcaaacatttccctttcatgtctcaactaactctttcaataaacttagatatgtgagggtattgttttatgtatggaaaaatgagaagtctttgtgagagctaaggttttgctaagtgtttccctttaatttcccttctcgtggcatcgttcccttgtgccattctcatcctccatctcacaatgtttttgttccattcatttcccatcactattagcatttaaattccggttttggcacaaaaactttccaacacaaggtattactttgacaaattcttaaaatactccttgtaattagagacagggtaaattggatgagaagtatatagggattctctccactatcttttcaacttttctgtaagtctaaaatcattaaaaaataaacctttatttttaaaagtttcccctatataacacttggattcttcttgctcttataaaaatatcagtttacctatattatttgggaaaaacaaggacacaaacttgtgaatattgaaaataattcttaaaaatataacattcatagctattttaattaattgccatttcctagcaaggaataatagcaataacaataactatcctttgttgaatgaactaaatatgcacacagaactctattaaggcttttattaatattacttaagttactttatctaaatctcacagaatctccaggagctatcactttttatgctaaaaattgttaaatatcttgtctttataagagtaactggaaggtctcagattctacccaaatatgttgactcccaaactagggccgtttttcacaaacattttgccttccttcaataagttgatatttgtatgtacctattggctctaggcattgcactgtacatatactttttatatatatacttatttgtatgaatgctcaaaaataaccctgcaacaagttgctattaattctaaaaacgaaaggaaaaatcctgacattttctagtaaaagctgttctagttacgaaagcatttaactgtcaactctggtctttgctgacacttttttagatttctgaaaaaaaaactgtatttaaccatttgtccattaatggagtgatgtccaatcaccttatgtaccatcaaattacctatcaacagaaagagaaagagaagaaaatttaatttcaggttactccagaaactatggcaaccaggctgtttggcagccaaagggtgtaaaatccagattagatagatggatgtatttacatattcacttttacattaaacagagtggatgacacatccctgtataaaacctattatttaaaaacttcaagtgaaaactgttaaaataaatggctcatgacttatgaagtgttaaaataaacgtttatttcaacactatacatgtcataagccatttatttcaacactccctacttcagaagacttacccaaaacaagaagaaaagatctcacttgctaagtgtatgtcaagaggccaagacgcagaagataaaaccgaagttttgatgctagagctttggtatgtggaagttcagatcagaaggtggaagaggaggtttgatgcttaacacctggtaaaagctctgtggttgtggtaaactgttcatcatcaccacctacattggcttcatttagacatcacgtttatcttaagtcattctgagagtttagggcatgcctgagtatcaaattatgaatgaaatgcactgtttgaggtgtttctgcaaagataatatatgttttattttatgtccccacttattagagaaggctcatgtaatcaaagtcttcagggagcaaagcttcagggacaaaggcccagtttcataagcataagtgcatacacttatacagcacttcctatatgacaagctctagtgtaagtgttatacaaatattaagtaatttaatcttcacagtgtttaggagggtgatatggtttagctgtgttcccacccaaatttcatcttgtattcccacatgttgtgggagggacccagtgggaggtaattaaatcatgtgggcaggtctttccctgctattctcatgatagtaagtctcatgagatctgatggttttataaagaggagttcccctgcacaagttctctctctttgcctgctgccattcatgtaagttgtgacttgctcctctttgccttctgtcatgattgtgaggcttccccagccatgtggaactgtaagtccattaaacctccttcttttgtaaattgtccaatcttgggtatgtctttatcagcaatatgaaaacagactaatacagaggggtaggtatttttatttttgccgtttttttttttcagatgggaaaacaaatctagagtggctgagtaatctaaccaggggaaactggtaagtggtggcaccaggattttaccccaagcagttagcgccagagtccacgttccttatccctatgctaggttgctgactttcagcagcagaacagcagactatctcatgctctagaagtcatgtgggcttgagaagtcaagttcatcatttcattttcgggcagggctagcccaaatgggtgacaatttctctcctttataaacaagatctcctagatgaaaagaattaatgctatttctataagaaattagtattgactgatgactgatgatagttgattatgacagctttcagttttgcctattttaagactttatgttcctaccaaaagttgaaggcctatggttgaagtgggaacgtctgacagtgactgaattatttccctccaggatgtcttttattgcccgctaataaaagcgctagtaaaacatttccattgttaagcatacccaataatagcagtctttatattctgaaacaatgctgtatagctcccaagcttctctctccctcccttcctcatccttccttctctctttcttttatatttccctcttgatatggtttggctgtgtcccccctcaaatttcatcttgaattgtagcttccacaattcccatgtgttgtgggagggacccggtgggaggtaactgaatcatgggggtgtgtctttctcatgctcttctcatgataatgaataagtctcatgagatctgatggtttcataaggaggagtttccctgcataagctctctctttgcctgctgttatccacgttaagatgtgacttgctcctccttgccttccaccatgattgtgaggcctccccagccatgtggaactgtgagtccattaaacctctttcctgtataaattatccagtctcaggtatatctttattagcagtgtgagaacagactaatacacttcctcttatttctctaacatctcttctttcctttatctcccatctttaccttacctctcccctctcctcagacaccttagcactaagaacaaaattaagtgtggattgcttaaagtccctcagtctttataattttataaatctgtcaatagttggaacatatgatgtaaaatcatgtagtctatctgtaatacatatccttgtccacaaaccagactttaaaatatctacacccttcctctgcccacccaccttcccacttcacactacgcaatgattaccaacaagttcctttggaaatcacaaagccaaaaattggtaaaaagaaatcagaagactcagtgcactgtgacatacaaaaaacaatgtgcttttaacataccacaatggaaagaaaaattctgagtttttttgattagaacatttggcatttgaaagaagaaaactaaattattataaaattatggaatgtactcaacaaaaaagtgacataattaaaaaaataataggttggataatatgaaaatatactatatactcacctatttataaaatctctatatttgatatcttgttattagaatccaaactactccaactagtaaaacattcagatgtatttatactacataaatgagacctatatttttataagtgacacctgaaatgtattttctgagagcatattttgatatttactactggtactaaagtaaaagtacatatacatacgtatatatatatatatatagagagagagaaagagagagagagcacgtgagttatgtaaatatacatataccatatctctatatagtgtgcatatgtatatgtgtgtgtatatatgtatacgtatatatatatttgtgtatgtatatgtgtatatatatggtacaagtatatcttcccagctattttttcaatttaaaaaaagtttcataccatcaatttgaaaaaattctaaatttaaaattaatttttatacaaatttaaactagacattaaaaaccaaatattttcattcattaaataagtagacatttattgaatgccagctatgaagcagctattatgtttggagctggtgacataaataggagttagacattatccctgtctttaagaaatgtacactctagctaaatgaatatataaataacttattataatgtatgttaatgactccagtaaaccttagaaaatgatcatgacaaatcagagaaaagtgtattgtactttgtctagttgggtcatctttacttgaagatgaaatatgaactatgtcttaaaggataactagcattttgaatgcagagaaggaatggagggaatcacagataacggcatgagcaaaaggatacagatctggctggaatgttaggtgtgtcgtagggcctagagtaaagatggattaggagggagaggaaggagacaaggctagatggagagtggggcagatatttctgggacacacactacagcctccttgaccacctctaattcaacagcagctcttctagtcagttccatgtcagctctgactgaccccaagaaaacagagccccacttcatgctttgctaaacttctttgtaccccctgtcccagggcctctcctgccaccacaagagcctactaagcctgtgcttccaagccacaaaagtacaggcaagtgaataaatactttcagggacagcccttaggctgctcccgccttccatccttcagggggacaattctataaggcttctgcacactttctaggagttcataattgtgatctaaaagtgatacctgcttaagttgacttttgctccttctttgtctcatatttcctcctccctgatgtctatttcccaagatcaactcccaaataggccactttcatccaagtccttgtcttcaggctttgcttttgtaagaactcaaactaaggcagagatgcaatgaggcctgtttgtgaagggtcctatactctgcattcagcattctggacagtttcttacagaagtgagagggcctctgagaattttgagcaaggtagttaccagataagattgtattttggactttgtatatgatggtggtgttgcataaggaccagaaggacaagaaagtgaaagtgattagcagatggtcatttaagaattgtctataaacacaagggcttggactaagtcaagcctatataagatagaaaatgacataaaagatttcattcacattcggagatggactatataaaaccttgtgactaattagaaatgcagagtaaaagggtcaacagtgtcaagaggactcaggttaatgccatttactgtgataatttttaaagtatttagaggataacaaatttgagtttgggtaaatacctgaggctaactggatggaaaacagctgagctacttaaaaacatgaaatataacctattacttatgttttggtttgccatgcatggtatctccagtactgtaaaactgggattctataaatgccttatttataaataggatcctagagctcaaagagattgtgacaatgctgactactagaaagagtttgctaaaatgttattcaattgaaaactgtgtatgaactttaggatcataaaaagcttggtatacattctcctttcctctcttaacagcaaccacaaactggaatttaccgattaaaaatattattatttttgagtcagagtcttgctctttcacccaggctggagtacagtggtgtgatcaatagctcattgcagactcgaacccctcctcaagtgcccctcctgcctcagcctcctaagtagctggtaccacaggcagaaattgaaagaccagtggccaaggatcaaagtattcaatcaaggttgggcagtgacttaggattagcagatgagatcaggtggcataatgggaggcaaagtcagtgtataaggtcaagatggtataatggaggcaagaacttcaaagactggtgagtgaaaactgtacaataatgatttggaagaagcagtgaaataataaaacaattatagtaacatcacaaattttgattacatacaacaagaatttcatttcttgctttcaattttcatccttcttctatatctgtacaagtcagactagccagactgaaattggaagatgatatgggcaatggttgacatagatagatatgtacacatctctttacatatatacataaagttacctttcaccactgtcattcttggcagataaaacactataatcactttatagttgaatggcatataatgcaatgaaaggtcttcacaagaaaaaaaattatgttttcacctttttactttctttagcagtgattagttccagaaatataaggtatcatcacttctcaaaaagcgctgtaggttataagattgctcttctgaagttggcaacatgtaataaatgtgctttattcctaaacatcaatcagtttcaagaatggcacttgcttgtaaaatggtaataatagaaatagtcagctaataagtactataggcattaaaacactggatgacaggtgtgaagacttcttgttataaaagaatactctcttatataattatggttttataactagttacatcagtttctaaatatttagtttttaagatttctgtatcttttttggtaatgaaacttatatgatagtattctgtactatcatatttataacaaataaaatatagagatatagccaaaaaagacaatgaaagtattctggagaggtgtgatggctgtaggtcatttaatctgaagagtaacaaatttaaataattattaaaagtgttgcttgagaagatattaatttgttgtataagtatacaattgaaaaatatttgtgtaagtcttaaaattaccataaaattagaatgtttcagtaatttatgaaatagttgcatggataaactttattgaatgtgtggtttagtagaaacaaacaaaaaacactcaaatacaaaacaaaaggacacatggtgattttcattttccaaagcaaaacttcactctgtgtcaaataaacagaaaaatcaggttcctaacctaaatggagttatattttgctggagagaggatctgcagactgaacataactatataatgtacgaaatctaaatgccaggggaatgtagcagacagtccagagggagttcagagagcaggcaagttccagaaagtacatggaggcagtaagcattttaagtacaaaatcagataaatggaccacaggcatatcaaacttcagaaatgttttcaaagaaggcatgcaagtgagaacacatattttgttttcacagaatgaagagataatcgttcaccataagtaaacagtttgtaaatgatcactgaattgtagataggggtgtaaatagttgctggattgtgaagacttagtctagaattgtgaagacgtatgacaaacacatgacaaacaagtcactggcaaaatgtctggagttctctttccatgtagcttttcgaagtagattcagaaaaggcttttaatataaatttgaaaggaaagaaagggaaggggagctaatggatgcctctatgcgctgggcactgtgatggacacctttaactttagaatacattatttttatgacagctactttattgtaaatatatgtatctgcaatcacatctatccaaaattaatgtagagatccaactgcacaaatatgagaaaattaagtatcaagtgacacttgctagtgtggatgaagttatgatgactttctttgagaaaatgataaaagactatgcatctttttttttttttttttttttttaaaaaagaacgatttgtgtctctctcctaacttgccaagcaggaaaattcaaagggaaattgtgccaaatgactattttatttaaagaaaatagtttgagatggcagttccaaaattacttctgaaggtagcaaagggtatgaatttagttaagagataaaactgtgtttttagaattgagaacttaggctaggcaggcatttggcatacattagctaatttattcctcataatagctctatgaagtctgatttttggcattatcttcagttcacagtgaagttactgaggtcatcagctggtgagtgtgtttctgacattaaaactccgtaagtttttttcatcattcatgtgacttctacctgataattccttaaacactaaactatttgctgtttcttgaaaatatcataattattcacacctctgtgtgatttctcctgctattcctactgcctgaatttttttttgtttttgtcttcttctctttgtttgttaaggctaataccaaatattacatcctttggggagcactcctagaccatcctcaatcaccagattcctttctttttgttctctctagcatgagtgggaacaacatcttgaataatagcaatacccacctgcctcatcttttaatgtgtgagctccgtaagggcaggagaaatgtctagttactactttgactgtaggtatatccattggaaagaaaataaaggtaatctttacgcacactgggcatgaccagataagctccttaagttctttgagtcttggtttcctcatatatgaaatgaggccaatggaagtatctatctcatgtgagttagatgagcgattgcatgtaaaatgctccacatagggttgaacacattgtaagcccttaataaatgtcagttcttaccaacatcatcacctttatcattattattcctagtaattaacaattcgttcttcaacttcctggacaataaaaatgggttacattttccactaaaacttgaagacaattaattttaactttttaaaattctaaagttttgagagtagtaatgaaaaataatctttatttcttttatgatctatattttgtcttaacttctgaacgaagcctctacagaattagcagtttgggatatattttcttttaccagaagctatataaagaacaatataattcttcttatttctttttctttttttaggaggtgaaaattataagacattttctgatagagaagataatatcagacttaggtctacagcaggttcattctggatccatgctgggagagaaaacaatgaatgttacacttcatttataatttccactgtgaacatgataagggctagtatattctcaaatcaaattaatccacaattctagcatttaagatacagtgcaaatccctaattcaagtataaagtatcacctacaaagccaaaataaatggggtaagataacagttctcagtgttgggttatagtgtcaatgcaagacttgagctgtgttaattcaacaagcttgatcttgattgccaaagcatgcttgtcaatatttagctcccagagggcatgtcaggggcctttacagaaactagcttaaatacaaaatactatagcaggatttgtgatccttttcctaatactcagattaaactgctgattttctttcttttagctttttaaaccaagaacgtgttttccatactcctatggtaacaagaagagaagaaattgcatagaagaattgtaaatgctattattagagttccttgaaacccagataaaattctgtcacatgaaatcactataaagcttttatctgaggtctgaaataccatttccccactatgattacaatatagaaaaaggcttggaaaaaaatgttaatctttattcaaaaacaaatgtaatacagatgagatgatgggtaatgattcccacaaacttaaaaacaaatagtttacaattttaataactctgcacttagaatcttctgctacaaggatgctgtgaggttttgaagcttatatagccattattatttattatttaagggttgaaccattaaaacaattacacttaagaaaatatagtgggaatcagtagtacactgatgaaaacctataccctctatggtgattaagtataatacatgatatgaaaaatagcatttttccaaattaatacatttgtttgccttctaacttttattcctcattagatatcaattaattggacatctacattctccttttcactgaacctgacaaaacattctatgagattgggtatggtgagattctgaccaaaatatttccaaaacaaacaaaataaaccctaccaccacaacaaaaacatgttaaacacatacttcagataattgaaaaattacccccttcatttgatgatcaaaattttaatatatgtcaagtacttataacatggctgaaaatagcccttgatattatcttttttcttttatctatttttttctaaaataatgactaaagataaaatcagatcaatgctgcaacaatgagaatcaggctgaaatggaagagccagatcatgatctagattcttttggttacctacagatagctatgactgccaattctgaatcttaatagcaaaattctgtttttttttttttttttttttttttttttttggacaaagtcttactctgttgcccaggctgaagtgcagaactcattgcagcctcaaattcttgggctcaagcgatcttcctgcctcaccctctcaaatagctgggattataggcacacgccaccatgcctggctagtatttttttgttttatgttttttgtttctaatttttagtagagatgaggtcttgccatgttgcccaggctggtcttgaactcctgagctcaagcaatcctccctgcttggtctcccaaagtgttggaattacaggtgtgagccaacccttctcttcccactttatacatttctgaattgaaaattccagtgatttgtcgaaacaataccgtttccattaatcatatttgttttactaagctaagacaaatgcataagccacatccctaaatcctattttaacttttacacagtaataaatttttccatcattgtccctaacttaagcttcctaaatgtcagctgatcttcacaattaccatattttatagataataaattgtgctcagatggatcaaaacagcacaattcaacaccacaaggcaaagctaatttatatttaaattgggactcgaacctgggtctgctgactacaacctttttgctgtctttatccacacatcagatatttcttgatcaaggcaaagcttaaatataaaaccactatgacttcgagacctgaaagtgtttttgttttcagagaaatgttattcctcagcatgtgtcaaagatatggttatgagaaagacaaaactttatagttttcagttatattttgccttgtcccttcaattttaccccaatagatagtaatagcaagactgtcccgttcatccgtggacagtgccattattagatactgggaatcctcgttataaattacatcataccactttcaccttgtttatcagactcctgcctcactgatacttgttgtttcttaaattcccaagctcatggtagtaggtcctttgcatgaccttttccctcttcttggtgttctaaatccatattattgcatgattggcactgttcatacaagtcttagcccaaatgtcatttctcaaagacatcttctctgacccctaatctaaagtcccatctctttttctatcacaattataccacctagttttgctattttcataacagttagaggtatttgagattattcttatgtattttttattctctcctccccacagcaatccctgcttcctgtctgctcaatgctctacgctcagaatttagaacagcacctggcatatggtaggctcttttacaaatatatgtttaatggataaataattgaatcagagcattttaacatctagatgtaatatatcctacaagaattgttttaagaataacatttgtctttatcagtcccacctgtgggagtttgaatgtggtagaatttgtgtcattgtgatgtacaaaaaatcttattatctgttttttattatgtagtgtatagtttttatatcactactgtttgagataaatgtgaccttttaatcttcttattaaacttttaaatacaattttttctttaatcattccaggtctctgactaacatgctcaatttcaaacatgtactctatctactcataagttagaaaattttgatactctctacttagatgactaagtttctaagaaaaccccatcactctattttggtctaaatttgattcctttactcagaagtttacaaattaaactttctatatgagatgcattctacagcattttaattggtaaatacattgtgctttaagtaaaggtaaaaattacttttaaagtcacatgaatttagacaaatagtactacacaataaagttactgctgatcaccaggttttttagctaatagggacatctagaaataaataaacttaatctaagtttcacaataattagctcataatatttttagtagaatatgaatttcagggatatcctgtgttataaaatctgtgtcatttgttcctttgagttcagaagggtattaataaatgcccctaggcagcagtatccaattggcttagcatatcaagggagaatactaactagagaatgaaaaatagcacattagtgttcagaatgctcatctattaagagaagatacgtctgcaccatggagagagggtacaaggacatcaagacaaaatctaggagtgctatctaatatcaattaaacaaatcattgctgtgtcctgcagttcagggttctgcatctttggtgtcttaatctgctgtatgctgctataacagaatactatagactgggtaatttgtaatgaacagatattcatttctttttttattattattatacgttaagttctagggtacatgtgcacaacgggcaggtttgttacataggtatacatgtgccatgttggtttgctgcacccattaactcgtcatttacattaagtatttctcctaatgctatccctccccctgccccccacctcatgacaggccccagtgtctgatgttctctgccctgtgtccaagtgttctcatcgttcaattcctacctatgagtgagaacatggggtgtttggttttttggccttgtgataatttgctcagaatgatgacttccagattcattcatgtctctgcaaaggacatgaactcatccttttttatagctgcatagtattccacggtgtatatgtgccacattttcttaatccagtctatcattgatagacatttgggttggttccaagtctttgctattgtgaacagtgctgcaataaacatacaggtgcatgtgtctttatagtaacatgatttgtaatcctttgggtatataccccgtaatgggatcactgggtcaaatggtatttctagttctagatccttgaggaattgccacactgtcttccacaatggttgaactagtttacactcccaccaacagtgtaaaagcgtttctatttctccacatcctctccagcatctgttgtttcctgactttttaatgactgccattgtaactggtgtgagatggtatctcattgtggtttttatttgcatttctctgatgaccagtgatgatgagcatttttttcatgtgtctgttggctgcataaatgtcttcttttgagaagtgcctgttcatatcctttgcccactttttgatcaagtggaagaaagggtatcagtgattgaagatcagattcatttcttacagtttcagattgaagatcagattcattttttacagttccagaagctgggaaatccaaggtcaaggggcctgcatctggtgagagccttcctgctgtgtcatcccacggtggaaggcagaatggcacaggcgcacacaagagagaaagagattgaactggcagcctcaagcgcttttataatgggcattaatccattcatgagggtggagctttatggcttatcacctctcaggaatcaccctcatgaatgggcattaatccattcatgagggtggagacttatggcctaatcacctcacacctcttattgctgttgcattggggattaagcttccaacaaatgcttttgggggacacattcaaaccacagcattccaccatggtccctcaaaatcatgtccttctcatatacaaaatatgttcattccatcccaatggctttaacccattccagcacgaactcctaagtccaaagtccagagtgtcatgaaagtcagatatgggggaaacccaaggcacaattcatcttgaggcaaattcccatcagtctgggaaatcgaacaagttatctacttccaaaaacacaatggtgagacaagcataggatagacattcccgttccaaaagaaagaaataggcaagaaaaaaggagtaacttgtttcatgtaagtccaaaccacaagaagggaacattaaattttaaagctagagaataatatgttttgactctatgtcccacctcctggacacactggggcaggggttgggcccctagggattgggcagccctgtttatggctttgatgggttcagtacactcagcagctctcacaatttggcgtcttatgcccgcagttctcctaggctacagttgcatgctggtggcaccacagttctggggtccagggactgcctcactcccatggctctactaagtaatgtcaaagtggggattccctgcagtagtctcactcctgcactctgctgtgcattgccctagtaatagctctttgcagtggctctgtgcctatgacaagtctcttcttagggacccaggctaaccgagagatcctttgaaatctaggtggagggtgccatggccccagagctcctgtattctatattcttgaagaattagcactatgtggacactgtgaaggtttgcagcttataccttctggagtgatggatcaaggtgcccctaggattgcttgagccactgctggggaagctgagggtgatggacaaaaattcagggaacaaagtctcaagatagtgcagggcacctaatgctgaggtccgatatgagcccctgtctagaaaccctgccttcaatgtcctacctaacttgccttgaagatctcagaaatgcctccatggtcattctcccatagtcttgatgaataaaacctggatttcttctatccatattaatctctttagcaaacagtcgcttagccacacacttagtattccctcctgaacacattcttttattctttatgtggctaagttgagagtttttcaatgttttctgttctgtttcccttttaattataagttccatctttaaaacatttctctctctcattttactgtaagctgccaccatatagcaccttgaatgctttgttgcttagatatttatcctgccagatgttgtttagatagttcttcttaagttctgtcttccacgaaatcctagaacatagacacaattctaccacatttttttttgcaactgcacaaggatagctttttactcaagtctccaataccacattcgttatttccatctgaaatcttatcagaatgccccttaccatccacatttctacaacattctgattatgaccacctaagtaatccctaagaagatttaggctctccctgtagctcttgtcttcttctgagccctcaccagaattgtcctgaaagctctattcatggaaacctaggctttttctagccttctcctccaaactgttctagcctctacccgttacccagttccaaagtcatttccacattttcagatatttgttatagcagcagtcacacttctcggtaccaatttcctgtcttagtccattttatagtgttttaacagaataccaaagactgggtaatttataatgaacagagatttatttcttatagttccaaaggctgggaagtcggtggttgaggtgctggctgattcagttcctggtgagggctctcttcctagcttggagatggctgctttctcactgcgtcctcactcacatggtagagagagagctctgatatctcttcctcttcttataaagtcaccagccctattgcattagggacccacccttatgacttcatttaactttcagcacctcttcacaggctttatctccaaatacagtcacattggaggttaggaggttagggcttcaacatatgaactttggagggaggggcacaattcagtacacagcgctcaatatctttccaagtaaattacttcatcagcaaatttatgataagatttaattgcccaaattccctctgaaaagcatatgagattatgtcacatcatttggctcaaatgaagaactgtaaactcttccatatttcaggtgcttttcggagggacataggttataagcaccacgaaggcctggggccatgtatgtttccttcatgccattccagcagagtggcatatagaaagcactctatttgttaaaggaagagaggaggcaagaaaagtagtaaagaaagcaatagaatcactaacaatttcccattaggagtctaaattcataaacaaccggagaatgggtttagtcttcccaaaggaaagatatatggtcatcttgcggttgagaggcatcataatattccagtagaatgtgtatagactataattttttattcttccctaccccaatctgtgttcttgcaatatctcaaccaagtgctgatatttctcatattcaagctattcctttgtgttaaatctagaaaaatctaattaaaacacacacacattttctgtgaaagatcattaactacaacatttacaccattccccattcatatggacctgtgctctaaaggctgtgagagggtaaaacatggggctggtaagctctgctgcaagtgtggggccagaaaatatttcatatataaacaattgctacataaggtagagtttgggagaaaaatgtttgtctcaaatgaagaaaggtgctgtgaacactgggaatttgtctgctaaaagaggaagtaaaagtgagagggacaaagataaactttgtctggttatgttcttcaagagccatccttgcctatttaaacagtttaaggagaagttagttatgtaagttctctcacaaactcttacatatttcgagcaaatttattcaggaagatttctgctcttaatacctgcctcttttattctttccccaagtgtttattgagtgcctactactacataccaggtactttgctaatgcaagatttaaaaaatgaccaagaggacatttctgtgctgaaagaacttgcaaactgctaaaagagaaatgcagtaaccacacaaaatgataagtcctttgacagaaacacactgaaagtatgtttcccatcaaaggaagcatcaaattcagctaaagaattcatagagaaggtttgttggcacattgaaggaagctgggatttccccagacaagagataaggcacggagtgtggggagcatggtgcattagagagtagaacagttccctctgactggagcacagctgagcctgggggcaggcagggaaagctaaggatagaaacgttcttaggaatgagcttgtggacatcattaacaaggattttgaaaataaaagaaaattaaatgtagtgtagagaatggacagaagggagagaaataaaataaaatcaggaagaagttaattgcagtattcccagagataatcttgtggaattagacaaaaaggaccagctcagaaaaactttaagcaagtaggttctttgggctttagagatcaatcagatatggcaatacttatcaaagcctcacctgtcctcttagaagaggtaatgtgtactggaggaaaaattgtaataaagatcaaagagagattgctattttaaattcaacctttttcaagaaatctgcatattctccacattctgccgatattatattttgaaaaccccataaaagcatgttttgctaatgcagattaaaagaaattactagggcataaatatatagatcattttcaatttagtccctactcactactgttttgtaccttaccacatcctcaaatagctgcattctcctttctcccacttggtgaactattgaatcacaatatccaaatggaaggacttccacactttgaataattgatctcaagcatgttccctgatgatttgacattcactctgttcttctccctgaagtatatttatatcaataactgcagcttcagttgcccttatatcacagtgttcctttttaagagcaaactgataccgtaagtaattgctagcctctttctgaaaaattttattctttctgcaatttgaacttagagcaacagactttgtcaaaggcaaaccagcacatttttctcttttaaaaacacaagttttgaacgcctgtgaaaggtctccattcaatttgacactcagccaagtcctaggaaaataaaactcacagtcttgtttactttttctctactttttctccaacttcctctatattttaaaacatattttctggcctcatgaataaaaacaaacaaaaatgtggcagagagcacaagcatgaaagttaaatttcagaatgggctacatttagctattctgttgcttctagtctgactctttatttgcacagcaattaatcagctatggtatgtcttttaactgagtaaacgatcatcaacctctcctaaacatgttaagaagttcatttccgtctgaattgtcctgacaaatactaaaatagataaccttaataaggcactaatgagatcattataactagttttgtctgtatttaaagtacagatttaagatcttcattaatgattaactactggaaaactttgttcaatcccttgagttatttttaatctctatatactataattacatatattcaatcataaaactttccatggtgctgaacacaattgaactttgaataagaacaagtacgttacacatcttggctgtttaaaaaggttaatctttaagtagattaatgacatagtgatcttcactcagttcaagctttttttctttttgactgaggaaaagatacgttactacaagctatttcatatctttctgatggaacttacatgaatgactgctttagaatattgaacaatcagaaccctgaactttctattataaggtgtctctgagatcagataagtaggatgtggcctatcactggtctttattttcagttgtgctaaaatgaaacaagtgtgttttctcccgtcagtttcagaggagagtggatattaaatgttaaatcacatttaagctgaagtcaatgtacaaaactttcaaccctaaagttgcctaagggaatcagaaataagggcattttacgggtgttactataaaattaaagaggagacagaaatgtgggatgtttcctttcattaaatgccaaatagttatttcaaacaacttgtagatgactgtattttaatgttatgacatacaattttcaaaattaaatgtgttttaagtcaaatttgctaatagtatccagcaaaaagataaattttagaaacataattctctaactgttcaggcctttcaaaatatagtttgccatgggcccaacaaggccaagggtgaaacgcaatattttctgatcctaaaatctttgcaaaaaaggaatgcagaaaatcaatgcagaattatataaaatatgtttgaggcacagactagctcttcatctatactccaactaaactactccctctcacaagataccactttttaatatagtacaattacctccatactgactgcaaaatggcagttaaacctttaaagtgtaaatctttgcttttgtgtgtttacctgtcatggactttaaacagtgtggagagaggactaaggaaggtggtaagctatttataaattggaaagtctttttgcatttatctaggaatatagacattgtcaatatgtgattgaattactgcaccagttttcctggaggatttgtatgtttattgcttttttgtaagacatttatccagctctctcaatcctgttctctttcttgcatgagttcacacatattaaaatgcaagtgtcttgcttgtctgatatgtcttttgcattatttgaaaccctgaagccccaatatttcttgatatctgtacaattctgaaacaaaattatttagtaataatattccagggataaggcaataatgaaatgtatatgcaacaaaaagttcacaagccatcatttcaattttcctcttgaattttcagggtaaagttgaaggaaacatttacttttgaagaaagaacaaaactctaaattattatcatcacagcctgtgaattattctttgatgcctattgtgctaaataggagattttatacaacataaagttaaggcaatatttactttagcagcttacattttaaagaataaaaacgagaaaataaatatgaatttggatatatacatctaaattcaaggaacctagaacatgatatggtttgtatatttgtcccctccaaatctcaggttgaaatgtaatccccgctgtcagaggtggggcccagtgggttatatttgggccatgggggcagatctctcatgaagggtgtggtaccatccctgtggtaatgcatgagttctagcaatctattatttcacacctgagccgcttgtttaaaagagcctggcatctctcttgtgccctctcttgccatgtgacacatctgatctgctctccctttgttttccccgatgatcagaagcttcctgaggtcctcactagaagcagatgccagcactatgcttcttgtagagtctgcagaacctggaaacaattaaacctcttttctttataaattacccagccttgggtattcctttatagcaaggcgaaatggactaatacaaaataatatgaaccaaagtacaaatactcattcatgatgataaagcagaaaccagcatttactattaggttggtgcaaatgtaactgcagtttctgccattactttcaatggcaaaacgcgcaattacttttgcaccaacataatatgttctattacacaggaagttgctccaggttgtcaaaaagtgatcagtgctggttggtaaccattgtatcctagtgtgtgggtctagggatcagttatatgccaggcaagtctctgatcccctgaagttcacagataagaaattatatgtagaatatgatataaacacgagagagatgcacaggatgcataagatgcatggaatcaggggtaagggcttctaaagtagtttggggagtgtaaggaaaatattggactgagaagctggttctaagggtagaaatgcctctgtgtctaaggtagcagtatgcttgtaggtaccataggtatagaagcaagagcaaccttggcattaggtaaaagtgtgagtagctcagtatggttgattatggcctggggcagtggcaggggatggcaacagaaaaggctggagatgtaagctgggacaaaatcatccagagcatggaataccatgactaggtaacttttatcctggaatcatattctttcttcaagttttagttaaaatgttatctctcccacaaagtcttccctgatccttccagtaagaagtgatcactcccccatggagctcctacagatctttgtttgaattgctcctttgacaggtaccaaattttctactgcaataggtaatggagtgaaaagtataagaatctaggattcagagggcaagaggttctactcccaattttgtcactttgcagtggtctatttgcctttgggcagatctgttcaccttattttcctttacctgtaaactctgcgtaatagtagttacaaacatttgtcattcagggttattatgagtatgtgaaagtggctttagaaattttgaaatttctaaaaattgaggtgtttgaatatatgtcatctatttcctataagaatgcacacaccttaaagggagcaagatttagattctagaagaggtggataatagtttgccaattatttataagcctaaaaccttgaagattaatttatctcaatccttcctctttccaggaaatcttccttcagttcttttccatgataagtcagcttcctgttagcttcctctctccttgaggcatagacatgtgcatagctatctcactgcacatggcttatcatgccttctcctgatcttcttcctctcagcttcttttgctggatcttcttactcttcctgttcataaaatgctaaaatagccattggacctcttttttttctttatctgtatgcatttcttagtttatctcaacaggttccacaactttttataacatgtttatggcatgaaggttcaatttatgtattcagttctttcttctccttgaacttcagggtcaaatatctaactagttaatctatatcttcatttggatgtctgataagatgtcttaagttcaacatatccaaaaagaactattctttcccaaggctgatgtccagaatggtgtttcctaggttttcttctaggactcttaatggtcttatatttaaatcttatgactaagttctcaaaagcaattgcaacaacaacaaaaattgacaagtgtgacctaagtaaactaaatagcttcagcacagcaaaagaaattaccaacagcttaaacagagagcctacagaatgggaggaaatatttgcaaactatgcgtccaacaaaagtctaatatccagaatctataagaaacttaaacaagtcaaccagcaaaacataaataactccattaaaaagctggcaaaagacatgaacaggcacttctcaaaagaagacatacaagtgggcaacaatgaaaaaatgaaaaaatgttcaacatcattaatcaccagagaaatgaaaatcaaaaccacaaagggttaccatctcacaccagtcagaatggctattaagaagtcaacaaatgtgacacagcaagactctgtctcaaaaaaaaaaaaaaaaaagtcaacaaacaacagatactggtgaggttgtggagaaaagggaatgcttatacactgttggtgagaatgtaaattagttcagccactgtggaaagcagtttggagatttctcaaagaacttaaaacagaaccagcatttaatgcagcaatctcattactgggtatatatccaaagggaaataaattgttctaccaaaaagacacatgtgcttgtatgttcatcacagcactattcaccatagcaaagacacggaaacaacccaggtgcccatcaatggtgaactgaataaagaaaatctggtacatacacaccatggaatactatgcagccataaaaaagaataagatcatgtcttttgaagcaacctggatgcatctggaggccattatcctaagtgaattaacgcaggaacagaaaaccaaatactgtatattctcgtttataagtgggagctaaacactgggtatacatggacatatagatgggaacaacagacacttgggactaccagagaaagggaggaaggaaaggaggtaagggttgaaaaacaactcactgggtactaagctcactacctgggtgacaggatcattcatatcccaaaccccagcatcacacaaattacccatgtaacagacctgcacgtgtacccttgaatctaaaatgagagttgaaattaaaaaaaaaaagagaacacaaaaaacacaaaacaaacaaataaacaaacaaacaaaatgcccctcaaatcagaaatgaactattgatcctcctcccttactcttttgccataaagctgttctccagagtttacttaaaatggcactactgtttgttcacatgctcagcccaaactatttgaagttatttataattccctttcctcttgtatcacacattcaacccatcagttaatcccattgaccttctctaaaacatattctgaacacaacattctccctcctccaattcctccattgctactacactggtctaaaccacaactgtctcttgcttagattcctgaattagctttaaaaataattgccctgtccccattcttatgctgtatagtctgtctgctacacaacagccatggtgcccatttatttagaaattgaaattagatcatataactaccttaacaattagaataaatcccaaaatccatgcagggcctacatgatctctggttagtcctccaatctcattgtcaactattcactctcctattcaacttacttcacaccatgcatccttattgctgtttctgagcattctactatatttagccctttgtctttgggatttctgatctatttatttagtttgtgattgcctagttcaccttatgtgactaactctgactaatgtgccagtgttaagtgtttactgtcaattcatctcatgactcagtctgttccaggaaatgcaaagattaaaaagaatttctcttgattgcagcttaatattttccttattctaaaatgtttctttctgtcttgagcaatacctaactactagtaactaccagaaatgttagtgaaagtttgcctactcaggggcttcatctcataagaaagtaccagaaaagccaaaagtaatgcgccagtctataacaaatctgtgtttttgataatctaatttttaaaagttacatttactttctgactgccccttatcacattacagttcagggcagaacaaccagaaactacagaaagtaaatggacagggaaagagatgtgccattgttgttgataatgtgccggcacatgactaagctgtgatagttcaatgtttcttaatgttcttaactcaatgcctagatttaaaaagtcacagatcagagctgcaattatgccaaatacctggtggttttattaaacccccaaacagatttcctgttgttgctcccctctaaaagtttcaaaatatgcagagaaaaatgaggacagccaaatgaggataatctgatgtgtacagttgaaaataaagcatcatttaggaagaaacaaagttttctgttatgtagtaatgatgcaaagggctagagaaatctataaccctgaattctgacagtgcagataataatctgtttttcttgcacaatgaaatttactatcagtgtatgaattttaactgtgtgtagatatatatgcacactctaacacatatatacataaatatatattacactcttactaagacaatggtatttcgtaaaaattttttttttcccacagctctttgcagacactaaacttgagcttctgaatggcagaaattgacttttaaaatatatgacttcttaaaaaaattcaactttgattctagattcaggtgacggacatgcagatttgttccatgagtatattgcatgatgctgaagtctgtgatatgaatgatcctgtcacccaggtagtgagcatagtggtgaatctgtaagacattagattctgatattacaatttccaagggattgtttttgaaattacattaagcataccccatactttgtttaaacatggcagattccccacacatatatgagaagttttggaagatgaaaagcagattgtaaaatgataactgacttagtagaaaaaaaagaacattcaacatgtagaactcccaaaaaggcagctaaagacagggtactggagagcacagttcaagcagggaggcacagtgggtgaaatgtgaagactgtctgaagatggtatatagagccaattggaccccagtttccatcacaaccctgtgcaatcaggtttctagtggtccactggagacagagatttgtttgtttgtttgtttgtttgtttgtttacttgagatggagtctggctctgtaactcaggctggagtgcagtggtgcgatcttgggtcaccgcaacctccgcctccggagttcgagcgattctcctgcctcagcctccgagtagctgggacaacaggtgtgcatgaccatgcctggctaatttttgtatttttagtagagatggggtttcaccatgttggccaagctggtctcaaactcctcaccttaggtgatccgcccacctcagcctcccaaggtgttaggattacaggcgtgagacagaaatttatttttatagaagtgtactagagatactccagatatcaaaactagtggaaggctgtaattgagacaggaaactgaaagcaaggaaatgaaatgaaagtctgcatattgaaagctgggactaccattcatccactgatcccttttttacagaaaggcacattgctttcatgacggagatctgaggatccttctaagaaattgtttatccccagagaaaagacctgaagatactcacatttgtcagccacagtaaaaggaagagcttaccactcaatctcctctgcaataaagctccctagctgttaaatttcactcacatactcaaggcttccaatcaactttttaatatctcacacttaaaaactaaattgaggatgtcttgaatctccagacatttcagaagtctttttttttacatgaactagagaaaccaaaacaaataatcaaaataaataaatgaataatgaggcagaagatatagagatttatatacgcattgaagggaaactgtaagaaaaaaaccaaacatagctaacatcttcagagacagtacagaatgaactgcatccaaaagataatgcaatcaagaagaaaccaccaaagaaaatgatatcaatatgctgaagagatatctgtgctcccatgtttattgcagcactattcacaacagccaagatatggaatcaaactaaatggccatctatagataaataaagaaaatgtggtatgtacgcaatggaatactattcagccataaaacagaatgaaatcctttcatttgtggcaacatggatgaacctgcagggtattacgttaagtgaaataagccaggcagagtaagacaaatactgcatgaactcactcacatgtggaatctgaaaaagttgatttcatggaagtagagagtagaaaagtggtattaagagactggggaggggtagggggagcaggggcctggataggttagtcaatgaatacaaagttatagttaggaagaaacatttctgttgtttcattacacagtagggagattacagcaaataacaatatagtgtatatctcaagatacctcgaagattttaaatcttatctccacaaagaaatgataaatgcttagagtgatggatatggtaattaccccgatttgatcattatacaatgtattcgtgcactggaacatcactacacaccccataaaaatacaattattgttcgattataaatacaacattattttaaaaactatcaaaagcagaaagagttgtacaaaagttaaaatataatgatcaataaaaaataagttacaggtatgatatcaaagaaatctcccaaaagagaaagcaaaattcaaataggagaaacaaaacaaaataaatcagaggggagaatgactaaaagaaagaatggagaaaatgggaagaaaaaatgataaacagataacaccagagaatttccagacctaaaaataaaattttccacatagaaaagagctgagagtaaaacaagaaattaaaaggaaaatccaggttgtgaaaaccagatcacaagagataaagagtagatcctaccaaaaggataaaacaatttgaaagagagaaaatatataaatatatatatggatgtgcatatatataatttaaatcaaagagcagataacagatgagatcagccctctctataactgatagaagaaactagaatattggctataaatacttaattaaaaattgttttcaatataaaattttatacccaatcaaattattaagtatgaggatagaataaaaacattttcaaatatgcaaattttatctaaagtttctcagaatgcttagaatatctcaggaagttatcaaactaagtcccagaaaaataagtaaatatactaagggtgagaaatgtatgggatccagaaatagagggtttaacacacataagctaaggaacatccctaaataacatcaattaggacacacagggaataattttaattttttcccccatgatgtataacaaagtgcaatatcatgagtagggtataaaattatctacctcatcattatctttgaattatatattgcctttaaatattttaccaatttgatactcaaaaatagctcaccattgcttcactttgcatgtcttcgcaaactgagttttaagagtttttgcacataagttattggcttttttccatctattgctcaaataactttaaatatctatctctattttaagccagagcagctcagagttgcttttattgacttaccacttgatattatgtttgatattaaacctacactgagggatgttgtaagagaaaacccactggtgttactgtgttgactacaaagcttttgttgaggatacagctattttatgacatcatactctctgagtgagaagtcatagaccttgattctgaagcaattgcattattgttgtcttatgaacactgtttcatattcgtcttctaattttgttctttttttgatatataaaaaattaaagacaatatgcagtcaaatatttgcaatattttcactgatatttttccatttattttatctttacaaagctttcctttaccattttctctttttttcagagatgcagaggttgtttaatattaggaaatacattaatattattttatgactctaatagacaaaagcagaaaatcatatattttctagatacactagtttatttgactagacagaagctaatttactagtataaaatttttaaaataaaattcaacttttttcttgccaacatttattttaggttcaaggggtacatgtgcaggtttgttacatgtataaattgcatgttgcatgggtttggtgtatagagaattttgtcacctagttaatcatcataggtagtttctatcctcaccctcctcctaacctcctctctcaaataggccccagtgtctattgctcccttctttgtgtccatgtgtacttagtgtttagttcccacttccgagtgagaacggtatttggttttctgcttctatgttaatttgcttaggataatggcctccagcttcatccatgttgttgcaaaggccatgatttcactttcatatgctgtgtagtattccatggtgtttatataccgcattttctttattcagtccactgctgatgggcatctaggctggttccatgtctttgctattgtgaatagtgctgtgatgaacacatgtatgcatgtgtctttatggtgaaatgattttcaaataggataaacatacacctatcttttttcttttttaatagtttaatttagtacaattgttaaaattttagtctactatttattttgatacatagtatgaagaaaagttaatacttagacttttttctaaataaatagctaatttatccattgattatctgtttaataaaacatcttttgtttccctgacaattggtttgagtgtcttcttttatatgcgatattcttggaaatacgaagactatttcagagttctctgttccattggtttaatctactggttcttgtgccagaaaacattgtcttagttattataattttgaaattggtttaaataatctgttatgtatgtcctttttcacctttcatctaggtgaaaaagttgcttagtgattttttcctgtttcctcttgctcttaaattttaaagtaattttatgtgtcttagaaaaaagctcatttcaattttgtaattgacttaatttgaaataactgccatattcatttctaatttgaactaaatgccatattatgagtcttttattataactcaatttaatataactcaatttgaaataaacgctgtatttactatgagtcttctactataagaacatattgtgttttgtcatatattcaaagctgcttctctatgctgaagtagttatgttgtttctttcagtcccatatattatttaagaatgagtgttttatacttcgtttttgctagtttgaatgctggtgtataggaaagcaattgtttgtgtgtctactgtacagtggaacactgggtccaagagtataagccttggaatcagtcagatctgacctcaagtaccaatggacctcaggccttggtattgtttttctcatttataaaatgattctttgtgaaagctgcctaactcagagcctggtacacaaaatctccttaataaaaggcagccgatataataccttaagcatcaccattatcatctcactatcttatactttaattaattctgagatttaaattaactcttcacatttcctaggtatatgaacagagcatctctattaacaataatggtattttctagaatgatacgtcacttctttcatgttacatgtgtcacacataactttcacaacaatattaaataacaatgttcatggtatatatctttgtcttgacttttattttaatggaactatttttaatagtaaactcactcattaagtgtgagtttgacttttggtttatgatgtatattctcaatattaatatttatcataaactacttttagttttctaagattttaaacagaaagtgatactgaaattttagaatgagtttccagatcatttcaaaagaattaagctttttcatattggatacagttatatagtatattatgttaataatgttcataatattaagccatctttgcattcctggaatattcttctttggtcaggatggctatatcttttaatgtgctgttgaatttaatttcccagcaattaatataaaattaattgctagtcaattttttaaagcatcaaataaaagttttagatcaatttcatttatgaatataaatgtatattcattattctgctcccccactcccatcctgctacttcatcatgaattcattttgggttgtctcattgtcaccttctctttcataattttgattactctgtcatatttttctacattttctggagaaattcctatggctatccttcacaacacattcaattttccatgatctcaattctgctctgtcacaacagcaatgtgtattttatttgtgctgctgtatttttgattctgtattgtctttccatttcccacgtattttcctatccattctgtatcttcttgtttcaacccagtgtgaattgccctgctttttctgtctgcttgtttgggaaaatccccttttcaggactagagacacacacaacattgatgctaacgggtctggatcaaagccaaattggcagaatctagcagatttttatgggactctacaagactaaaggtggagggttttaacttttcctccttgccttgacctctaacactctgtatagaagggatatatgtaaactacaaaattcacagtaaatagacaggaaacttgaagtctctgattctacttgaagatcatggcttctgaaaattagacctcttaaacattaggcattgcttccaacaactgcttgctcgcagaaacgaagagaaatgaagaggcttccttcactgtaggttctatcctatggcatcagaacaagagcaatcctgcttgccttaaagtaggtataaaagtgccaagtgcttcatttctctatttttatctattcgtagtttagaaaacaaacacaaaaaataaaatctgaaccacttattacagtatccttataattgctctttgatgtatacaatcatatatacataccctcagaaatacctggtcagaaattaggagtagtaaagaaggactactactgctgaatcccatcactcaaagtttaaatccatatgtgaagttcactaaatggaatatttgtgaaaatttcttggccattctgacaattggctgaaagtcaactttttattgttcctttaattttttttttttttttttgagacagggtctctttctgttacccaggctggggtgcagtggcataatctcagctcaccacaacctttgcctcctaggctcaggcaattctcccatctcattaaatttttgtttatcctctatgtcttcatatattttagtgagacttttggagagtccacccgagtgtccaatcacaaacctaaattccttttaactggaccatttagtccatttacatttaaagttaatattgttatgtgtgaatttgatcctgtcattatgatgttagctggttattttgctcattaattgatgcagtttcttcctagtctcgataatctttacaatttggcatgattttgcagtggctggaaccggttgttcctttccatgtttagcgcttccttcaggagctctttagggcaggcctggtggtgagaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgctgagagatccgctgttagtctgatgggcttccctttgtgggtatcccgacctttctctctggctgcccttaacattttttctttcatttcaattttggtgaatctgacgattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccccgtcactttcaggtacaccaatcagacgtagatttggtcgtttcacatagtcccatatttcttggaggctttgttcatttctttttattcttttttctctaaacttcccttctcacttcatttcattcatttcatcttccatcactgataccctttcttccagttgatcgcatcggctcctgaggcttctgcattcttcacgtagttctcgagccttggctctcagctccatcagctcctttaagcacttctctgtattggttattctagttatacattcgtctaaattattttcaaaattttcaacttgtttgcctttggtttgaatttcctcctgtagctcggagtagtttgatcgtctgaagccttcttctctcaactcgtcaaagtcattctctgcccagctttgttacgttgctggtgaggaactgcgttccattggaggaggagaggcactctgctttttagagtttccagtttttctgctctgttttttccttttccccatctttgtggttttatctacttttggtctttgatgatggtgatgtacagatgggtttttggtgtggatgtcctttctgcttgttagttttccttctaacagacaggaccctcagctgcaggtctgttggagtttactagaggtccactccagaccctgtttgcctgggtatcagcagcggtggccgcagaacagcggattttcatgaaccacgaatgctgctgtctgatcgttcctctggaagttctgtctcagaggagtacccggctgtgtgagcagtcagtctgcccctactgggaggtgcctcccagttaggctgctcgggggtcaggggtcaggcacccacttgaggaggcagtctgccccttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcatccttgagctgtggtgggctccacccagttggagctttctggctgctttgtttacctaagcaagcctgggtaatggcgagcacccctcccccagcctcgctgccgccttgcagtttgatctcagactgctgtgctagccatcagtgagaatctgtgggtgtaggaccctccgagccaggtgcaggatataatctcctggtgcgccattttttaagcctgtcggaaactctcagtattagggtgggagtgacctgattttccaggtgccatctgtcacccctttctttgactaggaaagggaactccctagccccttgcaagacacagactggcaaattagataaagagtcaagtcccatcagtgtgctgtattcaggaaacccatctcacgtgcagagacacacataggctcaaaataaaaggatggaggaagatctaccaagcaaatggaaaacaaaaaaaggcaagggttgcaatcctactctctgataaaacagactttaaaccaacaaagatcaaaagagacaaagaaggccattacataatggtaaagggatcaattcaacaagaaaagctaactatcctaaatatatatgcacccagtacaggagcacccagattcataaagcaagtcctgagtgacctacaaagagacttagactcccacacaataataatgggagaatttaacaccccactgtcaacattagacagatcaacgagacagaaagttaacaaggatacacaggaattcaactcagctctgcaccaaggggacctaatagacatctacagaactctccaccccaaatcaacagaatatacatttttttcagcaccacaccacacctattccaaaactgaccacatagttggaagtaaagctctcctcagcaaatgtaaaagaacagaaattataacaaactgtctctcagacaacagtgcaatcaaactagaactcaggattaagaaactcactcaaaactgctcaactacacggaaactgaacaatctgctcctgaatgactactgggtacataatgaaatgaaggcagaaataaagatgttctttgaaaccaacgagaacaaagacacaacataccagactctctgggacacattcaaagcagtgtgtagagggaaatttatagcactaaatgcccacaagagaaagcaggagagatccaaaattgacaccctaacatcacaactaaaagaactagaaaagcaagagcaaacacattcaaaagctagcagaaggcaagaaataactaaaatcagagcacaactgaaggaaatagagacacaaaaaacccttcaaaaaattaatgaatccaggatctggttttttgaaaggatcaacaaaattgatagactgctagcaagactaataaagaagaaaagagagaagaatcaaatagatgcaataaaaaatgataaaggggacatcaccactgatactgcagaaatacaaactaccataagagaatactacaaacacctttacacaaataaactagaaaatctagaagaaatggataaattccttgacacatacaccctcccaagactaaaccaagaagaagctgaatctctgaatagagcaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcatgttatgaggccagcatcatcctgataccaaagccgggcagagacacaatcgaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaacatacgcaaatcaataaatgtaatccagcatataaacagaaccaaagacaaaaaccacatgattatctcaatagatgcagaaaaggcctttgacaaaatttaacaacccttcatgctaaaaactctcaataaattaggtattgatgggacgtatctcaaaatcataagagctatctatgactaacccacagccaatatcatactgaatgggcaaaaactggaagcattccctttgaaaactggcacaagacagtgatgccctctctcgccactcctattcaacatagtgttggaagttctggccagggcaattaggcaggagaatgaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaatgtacaaaaatcaaatcacaagcattcttatacaccaataacagacagagagccaaatcatgagtgaactaccattcacaattgcttcaaagagaataaaatacctagggacccaacttacaagggacgtgaaggacctcttcaaggagaactacaaaccactgctcaaggaaattaaagaggatacaagtggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaagagagcccacatcgccaagtcaatcctaagccaaaacaacaaagctggaggcatcacgctacctgacttcaaactatactacaaggctacagtaaccaaaacagcatggtactggtaccaaaacagagatatagatcaatggaacagaacagagccctcagaaataacaccgcatatctacaactatctgatctttgagaaacctgacaaaaacaagaaatagggaaaggattccctatttaataaatggttctgggaaaactggctagccatatgtagaaagctgaaactggatcccttccttacaccttatacaaaaattaattcaagatagattaaagacttaaacgttagacctaaaaccataaaaaccctagaacaaaacctaggcattaccattcaggacataggcatgggcaaggacttcatgtctaaaacaccaaaagcaatggcaacaaaagccagagttaacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaccaaacaaccccatcaaaaagtgggcgaaggacatgaacagacacttctcaaaagaagacatttatgcagccatcagacaaatgaaaaaatgctcatcatcactggccatcagagaaatgcaaatcaaaaccacaatgatataccatctcacaccagttagaatggcaatcattaaaaagtcaggaaacaacaggtgctggagaggatgtggagaaataagaacacttttacactgttggtgggactgtaaactagttcaaccattatggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtaaggaaatggatgaaattggaaatcatcattctcagtaaactatcgcaaggacaaaaaaccaaacaccgcattttctcactcataggtgggaattgaacaatgagaacacatggacacaggaatgggaacatcacactctggggactgttgtggggtggggggagtggggagggatagcattaggagatatacctaatgctaaatgatgagttaatgggtgcagcacaccagcatggcacatgtatacatatgtagctaaactgcacattgtgcacatgtaccctaaaacttaaagtataataaaatacaataaaataaaccctaaaaaaaaccctaaattcctatatttgaattactagtactagaatgatcactgactaaatttaacctaccaaagatatatatttttcatttcattctccttaaaacaaacattttaaattttttttacacaaaattataatgcgttataccccacattaggttttattttttttcctttcaaagtggggactaaagttgcatgtatcagaatcctctgagatgctaattgaaaatatatatgcttggccttaacaaacatctactgaattagatgctctaattccaagaatctgtgtatttgaaaagctcctcaggtgactattatcatactaaagacttcagtgacctctgctgtattataagctacattggtctgttctcatgctgctattaaaggcatacccgagactgggtaatgtataaaagaaagagatttaattcactcacagttctgcagggctggggagacctcaggaaacttacaatcatgtcagaacgggaagcaaacatgtccttcttcacgtgttggcagcaaggagaagcgcagagtgaagtgggggaaaagccccttataaaaccatcagatattgtgagaactcactcactatcatgagaacagcatagaggtaactgcccccatgattcaattacctgccattgggtccctcccatgacatgtggggattatgagaactacagttcaagatgagatttgggtggggacatggccaaaccatatcacaagcctatataaaaagggtgaaactaaagaaaggtctttgagagtgatttcaaataatgtacaaggaacaaacacccagacacaaacacacatgcgtgcacgcgcgcgcacacgcgcgagcacacacacacacacacacacacactatttctacaaaatattaccacaccctcatctagtataagcttgctattaaaacaagggtttggggatctgggaacactagggtaaaaagatatttcaacaacacaaggcattgttgttggcctaattcatttctattatgttttcattttaactacttaatagagaaattcataatttcattttagtattggagtaaactaaaaaaaagaccaaatgtttggaactattgaataaaaatccaacatagaaataatttgatccattaaacctttggcatctgccttgaaaagtacatatgtttctttgtgttatttctcagtatattaatatgagaaatgcatgaagcacagaggttaataggaatatggagaggtttactagaccacttacagtgtaattgtgacctgtcattactgtgaatttttttaaaacagtgattaatctcagtgttatatttatagattgttttcagtcaatttttttgtcaagtacaaaagtgactatatattttcatcctacaatatgttaagacattacaaaagcttaatggaataaattaatacagaatgagcaatggagaaggggcagctgaagcacagtgcttaagtgtacagtatgaagagtcagacagtagagattcccatatacctggataccagctgtgtgatgttatagaatttacttgacctttctgtgtctcagtttatatttcaaaaaagcaggcccctaattgtgcccacctgattggtttgttgtactgattaaatagcataacatgtgaaaagctcccagcatctgacatctaacacatagtaagatggcctatattctattagctagaatttcttactaagtttccaaagctcaacagcaaaatcaagatggctggcaaagattaaaagtcagtccaggccgggtgtggtggctcatgcctgtaatctcagcactttgtggggctgaggcagatggatcacctgaggtcaggagtttgagaccagactggccaacatggcaaaaccctatctctactaaaaatacaaaaattagcaattagccagcatggtggtgtgagtctgtaatcccagctactcgggaagctgaggcatgagaatcgctcgaacccgggaggtggaggttgcagtgagcagagatcacaccactgaactccagcttgggtgactgagtgacactctgtcacaaacaaaaaaaaccagtccaatcactaaatgctcctgcttgtatgcaactgaatattaagaataaaatggggtttcttacatgtctactatgtccctgaaactttcataaattctggaggagtcgatatgaaggaaacaacggctcttgcttttaagatgtttataatccaaacaggtcagtcatcaaccgaatgtgctaaatgaactgagactaattaggaacattccttggactcatggtttctgttccatacacttcttttcaaattaatacacactaattaacatttctcacaccatatcatgacagatatgtgctaagacagtttaaccttcttgtttatttttgtttatttatattatatatcgttttgttgtaaaccaggagaaatgagaaagagtgtgagctcctttttcacttcagaaaggacttagtataggttttttaaatctcaatttcttccctacctcaccgtcttcaaaatgtccttctctttttcctcatctaatgaaaaggtagcatatctgaattacttactaggcttttgcaagctcagttgaaattataaaagagatgatgttgctttggggaaaaagatgaatctgttcgaaaagaaggtgagacatatgcaggaacacaggtatttgtaacttactcaggattacaaagaagaaattaagaaggacatccaaagttgctcttggcatcacagttagactgagtgctcagacggttcatccaaggcagtaagaaataaagttttttattactatattgatggcagctacatttctagctgcatgcttacacttcaagaaaaatgcctgaatgatgcctctcatttttgttccttgaaacgaatccaagaatgtttccctaatttacctatctgactcaattttccaagatagagactgagtgaaacaggtaatatcggcccataattttaacaagggtcacagaagagtacactggcagcttttcaaaaccagagagaataaatgttagattagtaagtgacacttgtagactattagaatttaatgagtatactatatttagacagatatgacagatgttaatctctgatattaataaaaatgcctaaaagttcattttggagaaagatctgagtatgaacccagactatgacatatcctggttatgtaaactctggcaagtttcttaagtatctagacttgagtctctaagtctgcagaatgggcccaatggtatccacctcccagggttatttaaataagaatgcatacaaagtgttcaataaagttctgggcacataaagattgtattattccaaggcctcgatattcccacacagctgctatgcattgcttgaatagccagtgctgctgaggaatgcagaaatgttgatcaattttctagcaatacaagtctgtcaacataaatttccaaataccaaaaagagcacatattaacttaaatactgagatttataaatctataaataactttttttttttatagggtctcactcttttgcccaggctggagtgcatgggcgcaatcttggctcactgcagcatcgacctcccagactgaatcgctcctcccacctcagcctcaggagtagctgggactacaggcgcatgtcaccatgccaggctaagttttgtgtttttggtagagacagggtttcaccatgttgctcaggctagtctcaaactcctgggctcaagcaatctgcccgccgcagcttcccgaagtgctgggattccatgtgtgagccatcgctctcagcctgataattttcttaaaattgccagtgctactgtaagagacatagttaagtttatattaaaaggaaaaccaaggtattgcttagttgtcataaagttgtgtgaagattaagtgaaatatgttagtggttttctcacagagtatacacacagagagttacactttacacagaaatctatatatcccacaagtaaactgattttaagggaatcattttctagtttcccaatttccatatgtatgatgtcttaaattttgtatgcctgagaaacaatgcaatcaaggcatcccgctggttcttctgtctcaactcctctgtttcaacagtctttcccttactttcgaaaaaaagcatatttttcattgatctcaaatattacaataacatatacatagaatataaaaatttggggataccaaacaaaataattcaaaatattggtgttggttttgagaaaatgattgattctaatgattgagtgacaaaaattcttgcaaatcaggtaaaacccaggtttctgatttcaataaaatagaaagagcaagtcatcaagttgcttaatcacttttggtgaagatcgctaactaattttaggcttacaatggagaaggtgtccaaatatttaggtaaaatgactataataaactccttccagtttatttatttagataaacaaggatttccaatgtctacacctaaaaaaaagaataaaactgatgataaactctatttaagaataatatgtctcgatagatacatgatcaaattatttaaaaagccatatgtttctcattaataaatgaatcttcaataaaattcacttttattttgaataattgtcaatatttatgatatattcatgctgttttgataaagtataaattataaattctaacaatacaggaaatcatttatcatttaaagactgaatctaggaatttttaaaatgtaaaagtccatttatagacatatattttgttaaagagtacttccaaagaggatccttaagatgttcaaattttaaaaaaaacataaaaataggataaaatttgatggagaaattgttttaaaatatgagtttaaggaggaaaaaagaggcaaaacttcccactatttgttagagcatgtttatgaatttttaaatgggtgatgataaatataaaaaagcacagtggtgttatttattcctagtaggtttatttaaaaaatgctgaaacaatttcatttaaagaattcatatttgcaaaacatgggggattatgtcttttgctagcacttgaacttactgctaaaattctcaggtcaactaaaatgagtgaggagtatatggtttataacgttttaattgtagggtatttgtaagcataacaatttgaaaaccacagaaataatgtactgtatataaaaatcttcagtacactttccaatccaacattttttcactgaattgaattgaaacgttggactctccaaaagcatagcaagtaaagttaagctggcctgaccaaattcctttctcttctctattctgataacaactcttatcatcactcctgtataaccctggcagtctccaccttcaagtatcagacaccatgtatgtgtctcaaaggtttactatgccccacacttaaggacctcttggaatttgaggtgttttctaccagccattcacatggtactaaatttttgggaatgcacatcaggacatttgtctgtcagagaaggtttcaagcagcttccaggattgatgaataatatcatgaacagtctataaagatgactttggaagagctcagtgcatagtgtaacagtgctaacagcagggacactgcattgaaatagcatatctccaaatcattgattatctcctcccttccactaataaaaggatagcattgtctggggatggcaagaaagcagtaaattaagagagaagagcagtaagctaccagcactgctgtttcccacactttaagggtttgagaacataactaggtaaatttgcatgtaagcactgtcctagaagagagctgttatttctcaatatgctagtgtctatacaaagttaagaagaaaaacataacatttcacaatcgagaacgtaattttatccttgcctaactcacacctgtttccttttcaaaggactagtgatatccataaattgtcttcaatggcactcataataaattctctttgcataaacaatggtttccactcaacatttaatcttaaaagagtgaatgttattccctactctgagacctcaaagactgtgttccactttttctaagaattctgacttcatttactataatttgtttcagatacttaactgtgggcagagattcttatttatttatcaaatactatacccctctaattttaccattgcttaaagcgtttgacattattttggaaataagatattctaactaaaatgctcgatgatactaatctttcttcatctactgttctcaaagtgtggttcccagatcggtagcaaaagcatcatctggaacttgttagcagtgtacattctgatacataaggccctccaagccttatgtatcagaaactctggagaagaggtccagcaatctgtgtcacaacaagccttccagtttctgatgcatgctaaagtctgagaaccactgatctactggaatctcacctcaccaagaggatgttgatatgcaaaaattggctacagtttacaagttaaataaaaatatttttctttactaacatagatgaatcctgatccataaaagactcataaatataaatcttaaatcccataaattaagaatctgatttcttcttatgtaatcagacatttgcttctagcaggtttcaagatcttcaactacggagaggcaatgacattttgatagtcctctagatttaaggaataaatatgctggctgtatagtcagagtaatgctagagagtttggtctgatgcttagggatttaggacgacgaatggatagagatggtgaggaatctcattccagtcatgctctcctttcctaatttcccttttcactgtttggtcttctcccccttttccttagggagtcgagtgattgatagcctaatccaatgactgtattacagctgcctcaactaggactcttttccttatcattagcagttagcctatggttaaattcacagctcactgcttggtacagcccctgagatttaagggtctggcctttagaaaatatttaacataaaactgaaatcttgacatactgagaactcagttctctgcaaggcttccttaattaatccaatgtactgtaccattgttctgtatgagactgtgacatggtgaactgtttctgaagcttacagagatgtgtagttctaaattaaacagccactgacgtgtacctacactgattttttagtacagtagatatgcatgaatctgtgaatatttaaattcaagctcaaacagtgacacaatactctctagttttactttcataatagaacattttttgattaatttcaagcttgaaatcattctttatgaaaaaacacacacagaggaaagaaatttaataattcattaccactgctgcaaaggtaagttttcttaatatgcttgtcagagttctttggtttacaaagtctatcaaatattttcttaggaactggaacagacattaatttattttcctaatttttaaccaaaggaaaatatatataatatccaggtacccatgaatttgttggctcttaaatactatttggttctaccatttatctgcaggacaatagttatcttaaaatacctaaggaaaggatgtagaccttgatctatgctttaaacctttgcccttgctccagtctgtccatgagctgtaagcatctatgaatatggcagctgagtcccagatgaaaaattatgcatctcataaactgctattctgctgaaatgtcaagccaaggcaaggctgtacctcagactcagcacttggcattttccttctgtctgctttgttgccatgaagcaaacatgaacagtgaagatttgtgtagggcaggtagcaggcgagctcactgtcaaaaatctattattagggccctggtctcctgcacagaccaacgatggctaaacagtgagatactgaggctctgagaaaggcaacataatgaaagaggggattctttgtcaatctgtacatgaatatattcaaatgagcattatttaaatgagaatatttctaatggtaagcctctctcaaccaaagtgataatttataataaaattgtaatctagcatctgtatttgaaatgcctacttttgactgttctgcaaatatagtacatacatatttgtataacaagttctttaatagtttgatcagttaaacttgtaataagctaagaatgtttttacataggtgaataacaggccagattttttgcattacttttgtccatacaaaaaaaggaaaaaagtgagtataaaatggaaggctctccttttaattattctttttgcatgaattactacatttttatccatttaaattctatctttatctatcaggttattttagatcttcaatgttaaagcctaagctcttatcgatcaagatgattacaatagatagcttaaatttgatgacagataataggcatgtttttctaaaagcaatttatgcatcgataatcatgtgattgacacataaaaaaatccagcacattaaaaacaacttcccaattaaaaaaatactaacactgttttttatgatggaattgtaatgtgtggtgtaagaacttaaagcaatcctgccaaaatcttcagttgctggcatgcgtgaaaatagttatttaaagaaaaatgtaactaaaacttctgagtttgtaatctgttttgttttgccatctccctgattttacacaaatattcactaataaatacaacaaaataagtgtatgattagagtgggttacactggatttgtgtttacgtaatgcccagtagcacagtgtatgctgccaagttattattgcattctaacaattcacgcctaagtaactatcttaaaaacacataaactatgcgatgtgaagtcgatgcctaaaatccctttctaagctactatattgattcacatttgtgcaagttttctaaattatacactttgtactcacttctggccctacactgacgcagatctacaaattactagctaaatttctaacttgtaccttcttttattagtatttcctatgttggatttacaatgaaaacacctttaggaagctagtaaccatacaagccagtgtccaatatctcacacagctagatttcaaatcattcattattcacttgtagactctaagaacattcatggaatattccattataacttatttagaaatacacagtcatttactggattctgtaataacctctatgagaggagtaactttgagctgaaacagaaaatcttaaaagccatcttttatgaattattcagaaatcaataataaagtttatgtcttaatactgaaaaaaatgtgttctattgttgtaattgtataagttcatacataatgaataacttcaaacaagcattcaaaatttgaagttaagaacaagaatttcctttcctttggtgaaaatagaacaaatttggcaaataaaataatttaaaataataagtttttcaagcttgtgggaagtaaattatattgagcctaaagtgtctatcattatttcaatttaagtgccttctgcactctttcctatatatgtgaatgtgcatgtgtttgtaagtgcaacacacaaaatatatacaggacaatgaaattcattccccattaataaaaaaaagttaaaaacacaaggaacaacaacgaaaacttcaaatgaattcaccccattgaaaaatgcttgaatactgtttctcccgaagcacctgtaaatgaataaaggttatcctcatgaagtcagctgcaagaaagacatctttagcttatgccatgcaggactgattcttaaccagctctgaaagaatcttacccacagggaggatttcatgtgaaaatgtcacaccacagctggataacaccatttatataggtgatagtaatcactgatttgggggctatcttaagatgccctcattatttgggaatgaagtcagaaaaaaaggtcaaaatttcaaactaaaacaagaaaaaaagaaattaaactgggaaaaataatgggtcacgcagtcaaggatggagtttataattgttactgagattagggtttttttccaatcaaataagtcaaagaatttcttcttcctttcctctctccaaacccaataaactattcagctgtgtgatgatacatgaattaactgctgtttgatgcaacagaagttttctgcatggattctagaaaaaggaaaggtcgtaacaacttagtgttacatctatactgtccaaagaaaggtacagaattatttagaatcaatggtttagacagagtacttatatggtggagagctgaatcagccatccttgtttgataaaaaatattccttttggataccaaacaagatttccttttatactgttctcactatgaaatcatctggtatataattcaactttttaatggagcaatactatgatgtatttctcccataattgaaattcaagtttataaatcactttattatgagtttgtttcatatatttaagcaccgccccccagagtttaatcatctgtagatgaattagaaaaagtgcttctaaaatagcaaagctgaggataagaccttggagtgaggtcctaatttgctctcttgatgtaacttttaagctacagcaggtagaagttatctttctatagtcttattgacttcttttatttaacaaaagagacctccctctgaaacagtaactctcaaaatattttgaagttaactaagtaaaaagtgcgttttacattatggcatatataagtgtatattatgtgtataactgaaaaagaagtttggccaaacaatgcttatcccaactatatgcaaagcattctgacatttcttattctatttcattatttaaaatgttgattacagttcactaaacttgattgcatagtatactcatgagttgggaaccaacctttgaaagacattgctctcaaatccaggctacttatatcggaaataattccactgacattccttagctgagatcccgttttcccaatgcaagtcactgtcccttattagctaatgcattttctctagaagaacattcctgaaatgtgcccagttttctacagcaggtatactactccaggtgcctcactatttccgtatttaaacaaaacataatcttcatttcaaagagcagaaatcttattctgagaaaaataataacaattgaataaacagctaaagaatatattgaaaggggaaaatatccttcactggcaatgaaaagtatgtattgtgttcaggtggctatccaaaattaaactctatttagttttcactttttaaaaatctgtgattcatgcagcatctctgaaagcagacattgccatgctctgagacaacacttgagcagatattagcactgtgctatggtaaattttttaaaaatcttataaaaatatctagcttattttgtgtaactttcagtattaaggcagcatttgaagtcctgacaaccatatttgatacaactctcgtaaaatttgaaaccattattatttaacacaattttgctaggctaagttttgctataactcatactgaaggtactctgttatagaacttgctctgtcctaaaatatattatcattgcctatttaaactgcttttcagattctattacttttaaacttaagcaagcattactttaaaggaggaaaactatattaattctgtcaatgtggagaaaggctattttcaaaacagattgtttaatgtgaagaaacttaatatagaacctattagaaatgaggtacaagtcctttaaaatgttagggattttttgttgtttaaaatgaaagttctacccaggcttacctaagcttatagcccaagtgaatatttatatatgaatttataaatcttagaaatagagttttatggaaatgctaacaggccctgaggtatgactgagcttgttttcaggtactgctataatttccagtgtgtgtatgcttaaagactgcaacacaaaagactttttctaatgctgtaattttgtagttttattagactgagttatagtatgggagaatattcagacattgcagcttaaatgagaaaacatgaatggtgttacttatataaaatactactgcaatagttcttttattaatttttaatgttcagcaccctctgtgacctcctttattctcttgctgtcaacatggcaggctggaaaaattgaaatgggctgacagaaaacatagtgcatgttacagcccaactctggagtctcttgactctctttctgtggcacatgctaacgcggtccacgttattctgcattacaataatatttaaggccctgtttgatagctcctgataaaagcgagctgtgtctggagcctgagcaggtgctcctcgtcagccttcttctttctgacattgtgggaatggcattcaattaaaagcagaatataaccgtttttgttcttcatggctcacaggcatacttcatactctcaaaactgaatacctcagcatggatagagctttatttgtgtctgtccagcctcttccaaaagcacattttggtctgattcagcaatgcttttcttgaacagtggggcactgttatgttatgtatatttaccactttctctatcaccaaggagactaatcccaaaccagtacagtcaagaaccttacagcattgtctttgcaagaccaagttcatgttgtcacagtcacagagtgcacagggtaaagatactgaacaggaccttgagattaaaacctctctttctttttcaaattcaagcgtatgctgatgagaaagagcgtgcaaaggtgtgaggtctgcaaatgtcttgtcagctgatgcttaattcagtgttttaatggcttgtttgggacagttgggacaaggtttttgaagaaggtagatgtctaaattctaggaagaatgaaaactagtccagaccatgaaaaagatattataatgagggtacttatatttttctctcagagggccctcatattaacccttactagtaagtggcaaaagaactgagagacgatgagaaattcttaggaaagcatggaccacaagagaatagaatttgtgcaagaccttatcttgatattctctcatcctgtgctgtcacttgagctttcatattcaatccgttctgtcataactattaggaatattgatcagctatgagttataagaatttgggatcataaagggcacaaaactcttgcaacatgaccttctgatttttcagcaacctccaagaaagcacaatgcaagaagtgggcaacacctaccagacactcctccatatgtagttcgctttgcaatccccactgctggccaaggtgtgccatcagattttaatcccatcagacctgagacagtgttggtggctgtaacgccattggcaccacctatgcaagacacatcaacattttcatgcagctcttataagacacgatagttaaaacccattcaaaccctcacatcccagaaaaatgcattctattttatcttgagaacatgtcttctcctcaaagttcttcactaatttaactcctacatttatgtttaaaattttaaacattaaagaagttttaattaccacaactttactttctcaaatattatacagacttgttgttaccaaatgttttgtatttggtgttattttccaggtaatttacaatgtctttgcaagtcagggtgcaatttccctgggatggaacacaagcacgcatgatttttgtattcaacagatatttattgagcatgtgtttaaggaagtcagctaggccctacaaaatatgaagagaactcataagaaatttcacattgtgcaaattgaattttctttttttcttttttactcattaaagtttaatatattgaattgttacattatgaggtcatttattttggacgggtttgctgtgactgtgttttttgttcttataatgtgtgaaataagtgtttattaggaaaaactataaaggatcttgtgtttccagatcaaaattcatggtcaatttgctagcatgagtccaggtgtaaatctcctgtgtttgtgggatcaagtgctcaactggaaacttttaaaattgagacaaaaaatatgcacatgtttgtaggaaaagacatacttgagtatggctacataatgtgggccaatatttacaatagcgggcaactgattcaagtcaagttcttaccttcctttgcagctcttgcgatgctcacaatatcagtgacatttggggtcagcttggcaaaaaaaggaatctgaacagcttgcctaacccagcggcagatgttccgcaccagctctggatcctgttcaaataggtcggttaaatatagaacaaaattaaagaattgtgatcaaaatgtgtactggaacaacagcaaagctggagacgtgcaagacaaatccaacttgacaatgagctacatgatatatttctcaaattcctcctcagtattacacctagactcattagggaactaaggttaacacacttcaagtgaactgcaaattcatcacataaaggttaaattcctcaacagagcctttagaaaataaaatttcaaagaacaaaatggaagacagtgtttcccactttcagttaaatattatcaggaatgaaacacaaacttttgatgttaagtacaagaaacattacaaaatttctagtgatctcattggtttaagcaaaataaaaaatatttaaaactgctgactcaagtgaatgatattaaatctaaagcttgttttcattattagacttagtcttgatgtgtattcaaaataaaatctatgacttcatcatcaatctacatgtgatatatagtatatgcaaatatggaataattcagccttgtattatacatgagctgatcagtaactttaatttacttttgtaaatgttaccaagatctgtgcagcattttcagcactcacaaacttgacagaattgatcaaaatgacaaaaatgaaataaaatatcaaatgctcattttaaaaagcaagaaatagacatttccatgtgcctattttctgtgattttccaggctcttattttctcatggggcaagtatcatttagagggcaaacacctatcctctccattgaataacttagctacagtacagtaatgttctttgatttcaacacatacaatagtcctttttttcattacttttagtgcaaaatttattctgacaggtactgataatgtgctttgataaattaccttaaagtatgcaatagcaattcattatcgaacttggtaatattatcttagcaagttaaaatgtttttgaataaaagaaaaacccagagaaatacagtcatatatttaaactatgaaatagcaggcaagcatatcatttgtaattaatgtttttgtatgtaagaaagttgctctttgcattttaacctttcgaattcctttaagatgagatttgtaatgttataacctttagaaagaaccttctcacttaggtttaatgtgtcttgatccatcatcctgtattactcaaaaagttatgcatttttgtgctaagatactgcaatgaggtaatttctgttgattgttatcatctctattaagcaaaacttaatacttttaaaaagaagtctttggcttggcttattctctttttagaacagtaatttcttcattaaacataaatattaaaaaagtgctatatggaatgctctacagggcatagtgtgcattatgaatagtaaaatgtggagacttagctgtacaaattctaactcatgaaaatggagatctgcccctgcccatgcaatgctcatgaaatatttataaccactgcattggtattatgaaggcagttgcatctttgtgactttcatttctaagttatgaatttccatgggacttagcctagaaatgacagtaactctagatgatatgaattgcatgtcctttgtggaagctctctttaaggtagactttgacaataatttaaagatcacttgaatggcataatacatggaatgtgtcctgataagaattactgaaacaaatttgaaatattatttggttccaatagagtaaacactaataatctgatataggcttccaagtggctttcaatactattgacccccatgccataataatttactctgaacatctgtcagacatttttcctgattttcactaggtgactgctttaaatgactgcctcttacccattgcttaatgatctggaatttgttcaaagtttttcaaattcttagaaacacatggttttttttggttagcactgtttacttgaatcatctgtctctattttgagataccataatttgaccctccatgagtaaatttgaccctccatgagtaaagttgacggtgttcacatatatttttctcatcttcatacttaggcaagccagctgctgactaatcatcacagccaagggtaagtacagtttggctacctgagaattttaaaaacaacttctaaccaaaattaccataaaaattaatgattgttctgtaaattgcaatgttttgtttgacaggtataatagagaatattctaatacaactagaaatgtggtgaggtcaataacatcatgaaatgaatctatatacttcagggaattcacgaatagactgtaactatttatattttcctggtttcttcaaaattttgatatgaatgttcaagatctaaaagcaattagtagtgtttctacatcttgaccttctcattttctagtgatagcatgagatggctttgccttttgtaacaagccagtttttagaatcttattgaaataaataagttttagacaatttctaattcttcccaaaatcttcaggatctgaaatatacaaaagtactcttatctctcagacaaatcaagagtttaccattaccaatacatacaaggagaagaagaagaggaagaaggaaaacaaaaaacaattattgactgctctatttctgggcactaaaaaatatatgttgtgtcaatgaatgagaaatgagtgaaaacttggcaacttggcatattttcacattatttccttatatatccatcaaaatataaactatgtctagatttaagaaaaacccagctatattttatgacaatgtccaaaagcatgaaatgtaggaagactactttacaaatcactggtaattctgtgaaaaagtgatggataattaagaaaaacagaatagcttaacaaaatcttaaaaatgtctaatacacaaaaacgtctacgtagatcacaaaggctttattggtgctttctaaaggcattaatgcttctccctgaacatgatttgcaatctctgtcacagtagttgcttgtcttgtgtgtgtgtgtgtgtgtgtgtgtgtgtgtgtgagcatgttcttcaatacctgttaacccttttgctattcaatgtgatcaccaaagaaagctctgaagcaacaaaatgatttcctgtgacagaggtgcatggcattataagcagaaagacacttgaagcccctaagagaatgagtgacagatctagggagcaaatggtggtcttgaggatactacataaagtgaaggtaccagagcagacttgtgaagtgctgagaagagttttgataaaagcaagctagaggcaaatttggcctatttgaaaattttgatgaggtacagcccagtgtctgcctgcaactaatcttatcgggaatagattcctatgaaaatcaaacaacggtgacaacacaactagaaaaggtaatgctgaggaatgcagattacttgctgcagtaatgtccattatgcaaaactggttgtttttaaagcttaatttctaatctgggacacaagataataatttttaattctagtaactactctgtatttagttacacattaagggagttctataaatgacccatcctgctgcttttgagaccctgaagatgacctcttcattgtagagcaggtatttctaccaattacttagggcatcaaatctcactggtttcatgtcctctgcaaaggaataagcactacagaatgagactgagaatttcctgataagctaaattacaagtgaaattttgacttgaagaaacatttctctcccatttacctagtaattttcactctgtacaattcatttcaaaatggctttcttagaatctggcatttcaataaatccactgcaaaattttaccagttataaaatgtttttcactaagcaactcttaagtcttaattcatatgacatgccaagaggtggctagaattttcattacatccatgtttctgatggaaagaactggggcccagaagatcaatctgagtaccaatttcaccttcttaattttctttcccattatcatgtcctaaaccttcatcttctttagcaaaattgctccctgaagtgaaattcagccatcaattgtaaactagaactatcgaaggcttctacttcacttattcctgtaagactagaagtagctgcaacataatgagcaaacgtgatgtattatccttctatgtcaataaaacaggacaggcagtcaactgttccaggcacaattataatattagtgaatgcaaagactatgtgttgaaatggagatgtttttattaactattttttagcatgtgtccttcttgcatctgtttttctgacttaagtattctaaaggtggtccaaccactttggaaattagttgtgcagtttcctaaaaaggtagacatggacttactaattaacccagaaattcaactcttaattatatatacaagtgagatggaaacatatttctacattaaaacttgcacatgaatactcacagaaactttttcaaaataggcccaaatttgacataatgccaatattcatcaatatgtgagttgaataaacaaaattgctgcatatccacgcaatgaaatatgattcaacaacaaaaagaaactaatgaatcatgccacaacttggaattaataaaacaaaatgatgctaagttacagaagtagacattatatgcatacatttattaaaattctgtaagaggaaaaaccatgagtatggaaagcagagcagtggttgctgagactgagaattaggctggaggagcaattaagtggaaataagtataagaaaatttttgagggtaatggaaatgttccattttctttaaaggaaaactattgatatatttgaagatattaaaattaaaatgttaatatatttaaaaacattgtgaaaagacaaggcacaaagtgggacaagattctgaagcacaattcataaaggagtagtatccagaatatataaaggaccacctgaaaattaatgagaaaaatgggcaaaactttaacatacttcgttcaacatagcatacttcattggatttcattcaagatgaaatccaaatggccaaaaaatttatgaaatgtgatcagccttatgaacacctttcacattttttccatataaggacaatgctcatttaaaccacaatgtgatgccattatctatctaccagattggggggttgggggaaagtcaatacaccctggggagaatgtaaatcagtacaagagtctttgggaaacagtttcacatgatctaggttccactcttacgtatatgtccttttaaagatgcaaactccagaatacatgttcaaaatatccatagtagcactgtttgaaatagccccaaagtggaaaaaatccaaattgtccatcaagagtaaaatgaaaaataaatggtaatatagtcatacaatggaataaacacactagagctatatacaatgataaggattaatctcataaggcttagcaaaagaaaccagtctcaaaagtatacaatataatttgattcatataaattccttaaatagaaagtaaatatggtctttagagacatatatatgggtgataaaactacgaagaaaagcaaagcaaagagtagggatggtgttaaagtggacagagagggttgtgttagggtgggacatatagggagcttttgaggtgttggagatgttctatttcttgacctggtggtcacatggtgtgcacattatgagttgttaaaaaatatatatgtgtgtgtgtaggtatctgtttataaatgcatacatatatgtttcatgtatgttgtctatattccacaataagaaaatatacaaatgaccagcaaatatgaaaagacatcgaatctcgctagtaattagaaaaacaaaagaataaacatgatcacctatcatgatttgccgaaaatgtaaagactgataatatccctctttgctgaggttgcaaagaaacaggcattctcataggctctcaataggaaagtaaattaataactcctttttaagaacaatgtggtaatatgtataaaaatgtaaagctcatcttataagttttaaattccaattccaaatacctagcctaattaaatccacatgcattcaaaatatgtgtacaaagatgtctgccattcactacagcattgtttgcagtagtggaaaaaaagaataaatgtcaatatgggaagatttgtgaaaagtactataatccatacaatgaaatactatgcagccattaaaaataaatctttgtaaactgacatggaaagatatccaaaacatattaagtgaacaaaagcaagacacagaataacacacagatagcctaatcctgtttttaaaatataaatatgtacatatatttatatagaggtctgaaaaacagactatgcatttatgctgtaacctgttagcagtgattacctctgaaacgttccatattttgaatgtggtataatcgggtatagacatttgccaaaacacatcaaactctatacttaagtgtgttcatgctaatataggtaaattatttctaatatagataaatttcatctattattctaaaaataattctaaaggcactcaaatataaatagaaaaatgaaagaaagtggcattgtaggtaatgtgggttctacccttttggcaaatatttattgaccatgaggcactacaaattttccgtgctgaacactaagatgaatgaaactagagtctgcaaggaaatgcaaaccaggcacacaataaaatggacatctgatattaagtgtcacaaaagacaagacatcctgaaagtgttctatcatttcagcttatttcagagcatgtagcgcagaacctgacacatagtaggcattcaacagtattgttgaattgatagagcctacaccacacaaattgacactgactttcttatttctatgtacttggaggaaaattgagagtacagtatactgggtccaggataacataatagataactgttttaggtactatattggataatacagatttagagatatgtaatatgctatccctgttctttaaaaacataaagcaaaatactttacaatctaggggagacaaatgcatacaacaaacacataatgtgattataaaatgttgtaactgtatatacctggaatgtgtacatgtgtgcctgtgtgtgtgtgtgtgtgtgtgtgtggctacttccttgtgccttaaatagaagatgacatagacccacctgtgtgtcctctcctccccaagcacatagccttctctattctgtttctcatttcaagttttttcttatttttctctttctacctggaatgcccttcattttttgtcccttgaataacacccttcaacgcagccctccatgacaaatccttccatctcacttcagcataggatggattagtaaatgactgcctctttagtgctcctataatgtttctttattactgcatttatcacagtgttttatagtcatcttctctgttccataatcaatttctttctactagactattagtcttttaggggatgtattttactcttttatcctagcaaagagcctggtacatgaaagacaataaataccatgttgaatgaaagaatgaagaatttctaattgcataccagctttccatcatgaaccacaaaacatttgcatctcctcttccatggagccaaaataagctggagatacaggatattagcagctcttgctccaggagccaactgagtttgaaaacagtcttttgatgctctccatcagtgagctaaaatacttggagagaactgtctcctactgtggcctagaagtccacgagaacccacctgaggacccaggctgaccatgatcctttctgtctgaacctttaatatattgagggcttttccagagtttgtacctctgaccctgaccctgcctcaactctcagtctttagtccctgggaccttgaggggaagggagatgctgtccatatttttatcagctaaggggaactatattcctgttttgttcctttaaatatcatttctggtgaacataacttaatgatgtttttttcttcctttcagacaaaatttccctagtgtaccattcctctgacattcttagtgtcaatgctccccattccacttagtcgctaaagctttctttttttttttttttttttttacaaatggacaagaattgccatacactactcactgtttagttaattcctgactgccagcgttctttcaggcactattttaattctctgtgaggactctcagatcctctccaccagctcacttctttactctcaaatggcagtgttaattgtagagatcagccctgaaagctgttcaaatttcagatctcctctgccacaatttgtccctatggaatcagattcagatttcatagaattatcttgcttctgccggctaatcccaacaggaaatccacggcctcacctggccatggtaatgaagtttgagaggtacctgcccaaataaacagatcaatgaacaccttctgcccacagtttcatgtgctattctagacactgagcctctcaggggcactgtagcactgttgctattttaatatgtaaataccttgtctctattccaggaatcccatgttgcatcaaagaaatggaagcagggctcagaccctgcatggtagagggggctctgcaatttaaagggttaactttctgcaatgttgaggagtcgcataacttttcacgagaactgatgagtagatatgctaaagtaactaagttctgaaaacgtctaagaaaaatacatgcagaagcaggcaactgcaacagacacagacatgaaccactcggatctaccttcaggaacagactctggcccagctgcaggagtgtggtgagctgactgcctctaactgcttcctcctttaggtgtgcctcgcttttaaactggggtcatgctcctttcagggagaccccagtgaatgatagcaaaactgtagtacaagggtctagctatttccggtgaatgtgggactcctctaataggcactttttgtcctgaagctccctactgggctagcaaagacttttcttgtgtctgtatcagggtccaatggctccccttttccaattttgcttccacttttttcctttcacaagcatttctctccaataaacctttggccctcctaactccctctctgtgtctgattcctggaggactcaactgacacaacagttctctacttgtatgaagaattctccctgtaagaggattacgctatattctaggaaagtcaaagaagaaagaaacttgcccaagtgaccccaggatatcttactgagaggaattcaagaaagctacgctgaatccaaacgaatctctcaaatttcttctgaattctagttctacccttggcttgacagaacaaggtctcttggaatgtcctgaatacagttaagccttgttggtgacctacccagcaatagccaatatatgctcaggggaaagaaaaggtccaataccaggaagcagggctaatttttttcctagaaaaagactgcttttagggacatggtaggagacaatgattgagtgacctctgcaaaaagacaactcagagacatccttaaagagtttggacacttacttgatcttttgattcagaacttgctcaaactcactattgtgatgtgggactctggaagcaattgtgcaaatgcccatggataaaggacatgatgcctttgtgtccgcaagacaaaattatccatcaagggaggatggccagaggaatcagtgtagatgctaatactcattccaattctttgtctcttacagatgcaatcaatgacaaaccctttaaaacatcactgagaggctgggcacattggctcatgcctgtaatcccagcactttggaagactgaggagggtggatcacttgaggtcaggcgttcaagaccaccctggcccacatggcaaatccttgtctctagtaaaagtaaaaaaaagaaaaaaaaaaacaaaaaaacaaaaaaccaggcatggtaacacatacctgtaatcccagctactcaggaggctgaggaatgagaatcctttaaacccaggaggtggaggctgcagtgagccgagattgcgtcactgcattccagcctgggagacagagcaagactctgtctcaataaaataaaataaaataaaataaaataaaataaaataaaataaaatatcattcattgagaggtcagatgaaacttcttccaggtgtgttgggcctccaatgccctctgttctgaactgtactccattctaatgtctgccttagctttcataatccattctgcttgtttgaagtctagttctccctttccgctatctgtactctacatttctagactttatccattgttcacttctttctggattggatccctctgagcctctatgcctgcctgaattgacctaaagttgcctaccttgcacccaaaattgatccatgacttgtctgtcacttaggggcagccattcctttctgccttataatgtttttctttacctatggtgtatattcccaggtctatttcccttgtctttaattttatcatgttttttttgtaaaaccaagattgacacaggttccataggcctatcttcacaggcaaacaaaaaactcttcgagagccatacattggccatatttcgcagtaattaggacacctccaaatcttctacattaaagcatttcagaatagtttattcttttgttgaatcctttatactgggccaaaaaatgagcttgaactttctttatgtgtgggatattatttatctttaaattaaaatgctagttttatctaccatacaaaaagggtgtcatccatagtttgcttattaatgagggtatgcagcataatttggaagatcttaatatatgcagaaacaggtcatgtacacattttcctgataccaccagtaggtgttcaaaattgtggaccagctgagccaaaatgaaccccagcaggtttcctaatcattgcttagaacacattaaaaagacctcagtgggttatgaaatataggcagctgcttgccctactatgtatggattcattttggataagggcaagtgtgtatgtaaatgtataataaggagtttttattctttgcagacttcaagcagcttggcatttgttttcttaatgcaaagcattagtgtaaacagtataacaatttatattttatacatctgctggtctattcacttagcttatgtatttcagtgctagacttagaaaacaaccacaagcataaaacctcagtatttttataattccatattgaagtgaatgattaaccaacacagggaggaagctagtgtggggcaccattctgccctggagcacccaccatgctgatacatttaggatgaagagagtctagggaagtcacgcttctgtcctgggaatgttatgaaatccaagcaagaaagaattactattgaggcaattttaaataacctatcagagaaaaactgcaatcccttggcaatgaatggttccgactaaggagaactcatccataacaagttggtatagttctttaaagaatttcaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaactggtaccagccgctgcaaaatcatgccaaaatgtaaagaccattgagactaggaagaaactgcatcaactaacgagcaaaatcaccagctaacatcataatgacaggatcaaattcacacataacaatattaactttaaatataaatggactaaattctgcaattaaaagacacagactggcaagttggataaagagtcaagacccattagtgtgctgtattcaggaaacccatctcacatgcagagacacacataggctcaaaataaaaggatggaggaagatctaccaagcaaatggaaaagaaaaaaaggcaggggttgcaatcctagtctctgataaaacagattgtaaaccaacaaagatcaaaagggacaaagaaggccattacataatggtaaagggatcaattcaacaagaggagctaactatcctaaatatttatgcaaccaatacaggagcacccagattcataaagcaagtcctgagtgacctacaaagagacttagactcccacacattaataatgagacactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagcactcctcagcaaatgtaaaagaacagaaattataacaaactatctctcagacaacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaacctaacatcacaattaaaagaactagaaaagcaagagcaaacacattcaaaagctagcagaaggcaagaaataactaaaatcagagcacaactgaaggaaatagagacacaaaaaacccttcaaaaaatcaatgaatccaggagctggttttctgaaaggatcaacaaaattgatagactgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagcagttgaatctctgaatagaccaataacaggctctgaaattgtggcaataatcaatagtttaccaaccaaaaagagtccaggaccacatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatacagcatataaacagagccaaagacaaaaaccacatgattatctcaatagatgcagaaaaggcctttgacaaaattcaacaatgcttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaagaaataaagggtattcaactaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaagtcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagagtcaatatcgtgaaaatggccatactgcccaaggtaatttacagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaatcaattcaagatggattacagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaaaaacagccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaacaaacaccgcatgttctcactcataggtgggaattgaacaatgagatcacatggacacaggaaggggaatatcacactctggggactgtggtggggtggggggaggggggagggatagcattgggagatatacctaatgctagatgacgcgttagtgggtgcagtgcaccagcatggcacatgtatacatatgtaactaacctgcacaatgtgcacatgtaccctaaaacttaaagtataataaaaaaaaataataaataaataaataaaaggaattaggaagggaaaaaaaaatttcttcccactgctgctgtaggagctggaaagaaatatctaggccattttgtttgtttgtttgtttgcttgcttgtttttgccagctctgtggactgatatccctttttgaggtaaatactcaaaactaaatactaaaggaaataataatactaaggaaatactaaagtgggtgactttggtagaagtctttggtgataatgtgggatagagaaggctttaaacatgaccttttgtaagtgtagtattcacaaattcaaaatgaaattcatggatactggattttatctaaaatctttagcaatcttgaacctaaaaatccttgaatatatttattacactcatgtggtggtttataagcatacatgtcataaggggtgtgtctgtgtaaaaagagagttctctattttaatctttcaggtgtcaaggaaaggaaacatggcgaggttaccccattttggggagtttattacaactatacatggaaaaataaaaaagtaagtgaaatgtttttggtaaaggaagggctaggcctctggggattgggacaccataaatcattttgtaagacatacagcagctctaaagagcagctcctgttttcttgttgttactttaggaatgggtgtctattgttttaaggattaaaaactctgcaatacgaatacatctgctcttatttctcagcatctcttattccatttctacttctactcactttctcctttttcctatattagctttttggttctccaattcaatttttttcaaaattgagttgaacttggttttccgattcaatttttttactattttttatatatatatgcatatatatgtgtgtgtgtttatgtataggcatatatatgtgtaaatatatatgtatatatacatatcatatatacacgtatatatatccacatatgtgtatacatacatatgtatatatgtatacacatttatatacttatatacatatgtgtatatgtacacgtatatatacatatgtgtatatgtacacgtatatatacatatgtgtatatgtacacgtatatatacatgtgtatatgtacacgtatgtatacatgtgtatatgtacacgtatgtatacatatgtgtatatgtacacgtatatatacatatgtgtatatgtacacgtatatacatatcatatatacatatatgtgtatatatacacgtatatatacatatcatatgtacatatgtgtatatatacacatatatatacatatcatatatatacatatatgtgtatatatacacgtatatatacatatcatatatacatatatgtgtatatatacacgtatatatacatatcatatatacatatatgtgtatatatacacgtatatatacatatcatatatatacatatatgtgtatatatacacgtatatatatacacacacacatatatatacatatatatataatatatttaaaaacaaatccacagagaacaacactcagtacaaatagcgttctttatattttggctgtctgaaatttgacttcccttcctatttgcaggaaatttaaatcatatgaagcattggtaggacacaggaactatccccatttcgcaagtctttgaaaagagggtcttactctttctactgtcttgcaaccaaaaaaccagtacatgatctaggcctaggcaactgaagatccagcccaaagttttaacctcacaatcagaaaagtggttaaattgtatttgtggtagtgtgttgtgcagcatctcctgacagtatcccatgatggcagtagtggtggatatcaaccctggtagaggctgtattagctggacaactcttggtgttcattctctgagccttttcgttttttgcccattttctaagcctgctgttcctgccttctttgattccataagccatcttgtatcctgccaataaatctcctttcacttctgacagccagtcagtttctgttgcttgcaattaagagtgttaattgatacaggcagttggccactatccagtgtggagtgacattattgcctgggttatggcatcacacttcctgacaagttgctgacctctttttatttagtctccaagtggttgctttttgctcagggatacaatatctggtccaataaattgtggtcaaggtagccaggacacacacttttacggcaggtgtatgccaaatactgcttctgtttacttttctttagaaaggagctattggcctggccgagcaggtccttagtttcatggactatgtggaaattacaagagtaaggcatcaactttgtcctcaaagaacttacaatcaagttatagtttcagttgtgacacttaaactatgtcaggttcagcagaatataaaaatggcctttagaattacaatacatctctattcctctataaatcatttagcattttaatatgtcataatgagtaagccctcatataattcaggagacccttgcagaaagaagtgataaatatcacccagatccaggaaagctttatttgaaatgtattaacagtggctatgatttctacaagatggatatgtagacagagaacagtaatatagtccataagggaaaatatcttgaggcactgaagttaaattaaaatatgatctccctttcattctcaatacctgcatgattaccaattcgacaaggatctttcatttatcccaactcaactttacagaagtgcctgaagcctacattgttgataaaacagttgatgaagttttcatgggggaaaaaaatctttaaagtgcttgatatacaaaatcatattagtactaaaacagatgggtatttacttttgcaatattcaacaaatgcagagtacccaaaggactgctaaatttagatagtttaaaactttgcgctttttttcacttaacaaggaacatactatggtgaactttgctggttatgtaattaacacctagaagcagcagcacctaattagatttttacatcatctgggcaaaggcagcatccagcactataaagaagtctttatttcatacctttcaaattgctactattcctagaacttaacataaaactgctaaaatcacaaatgcaactcacagatttcttactgctttttcctttttttgaaagtgaataatttgtgggaatactgaaaccttctgaatctggaccaatgtccttaaatgagcacttgcaactatcctgcctctaaccatgaaagctttacagtcttcatggtttaggccattctgggtttggtaaaataaacagacataaaaatgatccaaaacaatctgctctacttgaagtgtttatgaagtgaatgaaaacttagcagtggagtgattactttttattaacttctagagtgtgtgtgtatgagagagatgtgaggagacaacagtgaaggtgattgtagtttggaatcttgagggattcacaaaatcactggctggagtagagcctatggaaaaatgtatgactaaaaaatacttaagaaaaggttcaaaagcataggaatgcatggtatcatatgaaatgggaaggaaactagtgcatatgaaggaagcagggaggagacatgtccacatggttcagctagagtttagggtcaatttttgaaagattttgtgccttatcctttaggcaataagaaaacatggaaggccatatgtttaatccatgttttagaaacataactcttatatatgtctatggggtgagagtataagagtccaagcaggagaccaatcagaaagagaaggtatggctaatgtgaaacaatgtcagtgaaaatcaataatttcaagtggactaggatgttattttaaagatgaatgttaaaaagtttcaagataaggacaaatcagagttggggaatgaaaatttaaaattttgcagatttcaattgctggaggatagtaatgtattcaatcaagttaggaaacacaagagaagcaggttttggcaagggctggggaagggtgaatgaatttcagatacattgagtttgaggtctctatgggacatctacctgaaagaatctggttgagagttaatagaaatctggatctcagaaaggagttttggaaacatagatttgagagtcattggcataactctcaaattaaactctaattagtagatggtggttgatgtcttgtgaatggatgagaagatggaaggaaaagggcttaagctttgggatcattaatactaaggtgcagaatccttataatggtcagagagagaggagaacaaccaggaaaaatataaatgagaagaccacttcccctaaaaaagatgtggatgaaattattgaggtaaaatactgcagagaaattaggtagaatgaagactgaaatgtaagtaatagaatataccactcacagttattggcaacttatgggaatgtagttatagacacctaataagatggaaggcagattgcaaggggttaagaaattaatatttgcaaacatatagtcaaagaaaactaacaataaattaatctgaactatcagagtctataactgtgttttacataaaatacgtataaaacaaatatagcaattaattatcattttacagttctcacaattagaactaatgacatgatgaaagagatcatctgttatgttacaaggcaataagtgtatgtaaagataaagagattataagacattttaaaataaatcaattgtggtttaaacaacatcctgaattcttacaatgtgaaaccagcaactgtctgagacaccaaaaatgaactttgcttattaaacacataattgagatcacaggcctaaataggacctgaagaagttcccagacaatattaaaactaacatatataccacagttaatgattttccaagtcctctcacctattagctttacggtgcttaaatcattccagctttcttattttctttcaaattatccctagcaacagatacagtagactctgcttctcataatatttataatcatcaaattccaatgaatatctttcttatcctgctacagattaaaatcatatctacttgtcttaccttgaatgagaaaagaaacaactatttaccataattcattcaatattcctacattatatttttcaaatgttattttcctgattataaaaaaagttcttaattattgtggaagcaaataccaacttgaataaagaagaaaaaactaaaattactcataatgaaacaactaaatagaaataaaattaaaaaggtctatttcctttgagtaagaaaattttactcctttattgagtaaatacactgtactcaaaatttaatgcttatcatttttagttatatatccttcatttttatataaggtgcattccctatgtcactaagcttctttaaaaatactattttaacagtcatatatttcatataataatttataaatcatatagatacaccctattttacttaattatttatttctcaatttttggatgttgagattatttccaggttttgttataaataacatggcactaaatctcttctaataggtggtgctcatacattgccttgcttttgatgctacgtgctgtgttcataggcaaaactgatattacaaaaagcaaatacataacaataggcatttagaagatataacttcttagaagaactgggtaatccatagctctgggcctggcacaagcaggaactttgatgctgtatgttaacacaagggcaactgatgaaggagatataagtgggtatttcagttgatgcacgatacccatccacaattggtcttcaaatctcctctgtcctctgagagagagtagagtatacagggcttctatgtcttgctcacatacagatctcctctcagatagcacatgcataattcgatttgtccacaatgtataatctgagcctatgttattcataatagaattgcctaaaccttatacaccatagagatgcctcttaagaaataaaacagtaatgctactatattatagacatggttatttctaaataattaagaaagagacaatagcctatataatacatataaatcatggcatgcagcgaaaaccagtcactatatagtatgttaggaaagtcatattagtctacttatgtttaactcccaggccagagtttattaatgttgtttcctccatccacaatatccatcccattcatatcacacacacttgctcctgcccttgagtgaatttactcatttacttttccttcagattttactcagatttttgcttaatagaaatgtacttaacagatgaataaatgaatactacttgttatataactggatactatgataaaattatttgaaaagtatcaatagtgttataggtatccaaaagacacattagttagaaaagataacagaactatatcctactagaaaagggaaaaatggtcagattacataaaatataggtttacttttacaaagtatacttaagtagtattttgttaatcatttcagagttatagatttacttttatacaaataaatgtacttaaagtatgctgaaattttactgtgattatgttgcaatcaattattacagaaaagttgtgaatattcaagttggacttatttgtatcagctctttacaccaaagggctttttattgtatgcttttgttttatttcacatttaattaaagctaataatttgtttaaagtttgattagagaaaatattttccaaggtgagtgagaaacaacttctgaatattacttcctagatttttggacaatttggtaggatgaacttaagcctaaagcacctattaaacaagaaggaaaagaagaataatagtaaatctgaattttgttaagatttcatgaatagaaatgagcattacaaaaagatatttcaggatgtggaaatgctaccaatttgaatactgcataaattcatttttgtggtgatgtcactaactttgaattatccgtattagagtgggaacagccatttatattacaagcatattcaaaataaagtatatgtctctttgggatgtaatcagcattacaaatgtacactgctaacattctttattttcagtatttaatcctgtattaaagtgatgtttgatgagcactctgtggctactaatgggtaagggtaagaaataattttgaggctgggcgcagtggtttacgcctgtaatctcagcaatttgggaggcccaggtgggcggatcacctgaggtcaggagttcgagaccagcctggccaacatggcaaaacccggtatctactaaaaattaaaaaaacaaaattagctgggcatggtggtgtgtgcctttaattctaggcactcgggaagctgatgcaagagaatctcttgaacccaggaggtggaggttacagtgagccgagactgtgccactgcactccagcctgggcgacagagtgaaactccatcttaaaaaaaaaaaaaaggaaagaaataattttgagaccccatgcatgaatggcacactagataaatgtcttaccctatgtttgaacacagattcacaaaagaatgactatcaggtcatttttaccatgtttgtgacttttgatgaaggttaaaatttacaaagaatggaaatattttgatatcttatttctatgttatttctggtcacttctagaacaccaaaatatgcaatgtatttccatctcaaaaaaaattcaagtcctaacttgactacaactttcgttattatgtatatatgtatataatcctaatatacaagaaacattttacttatatttcttaattcctaattagatagtgaacaactgtttggacattaaatttcctgtattttgccctgacacaatataaagtgaatcaataaaaataaatactgattttcctggctttaaaagaaatcaggatgagctcaaaagcagccctaaaaaattgaaaattgaaaagatgataagttcattctcttttatatcactccttgttgtggttcattgttataactgttgtttaattaatatccaaacttgcataataactaaagtatgtgaatggtaaacagtagggtatcatcagccataattatcttatttgcctagtagtgggctgcatgttatataaccagtctgtaataatccttatttgatgatactcattaattcattcactccacaaatatgtattcaactgctactctatctgccagagctcgacagtaataagacaaagctacttttctcatgaagttttcattctagtggaaaatatgataagaacaaaataaataagtaatataatttcaagtaggtgatttaaaaatatacaacagggcaagggatgagggggtagagagtggctgtaagggtgtggtacactggggatgaattaccttggataaccttttgggaaagtcacagttaactccgtatattctataactacacaaattatccatttgcttttatagttgcctttaaattattttaatttcatgaacttaaattttgtctttgctcacagattttgagttgctcaaagttagagatcatgtattttttcatcatgcaatatcatccacagggacaatcataatattggtacatgaaagacacagtagatatctttgttgactgaatattaattcttgactaaatattcattacttagataaaactttttaaaaataaaacgcaactgcaaagcaaatgtaatgctgacatatttcatatgatcattgcctgtctacatgatccagttctatataacacagtaagaggaaactgagatacaggtgtgagaaagcttctaagagttaggataactcttagccaagtcactagctcacaccagcctcatgactcaaattttttgcaaacctatatattgaggatgggtgtggtggctcatgcctgtaattccagtgttttaggaggtcaagacaggaggatcgcttgaggccaggagttcagagccagcctacgtaacaaagacctcttctctacagaaaaagaggaaattaaaaagttagtcaggcgtggtggtgtgtgactgtagtcctagctacttgggaggatgcggcaggaggctcgcttgagcccaggagagttcgaggttacagtaagctatggctgtgcgactgtactacatcctggatgacagagcaagaccctgtctcaaacaaacaacccccctgccaaaattgtgtattggtatattttatacgagtccattcaccaatagttgaaactgcaaatgtttgcactcatgttcatatgggttatgggtaggtaatgagattttcttcacaaaggagaaaagcaaagaaggaggaaagaaagactaaagaagactagagctaataaattaaattattaataactcctctgaagtattataacatttagcttttgctacaaattatatgatgatgccatttgtgtagggcagcttaagaataaagaatagtgtttttgttgttgttcagacatggatacaggataatataaagaatgcttgtgattttattaagaaaataactttaaaattccacttggaagctatatatgttcaggtcaggatgaaaaattctgagaaatacagatctaatgggagtattaacgggatattctcatcactgttttatctattatccagaaacttttaccttagaagaaagaatgctttatttctctcgtattcaaggtttacatatccaggtcctatgaattccatctgagatgctattagttgatcattgttatcttctaattgtgtgcctaggaacactgagaattccgttggtatttctgagcctagatctactgtccagagtcatacacccttcttgtccagctctgcaagtggtaatctgaagtctgagctgcttctctacaatgaggcacacatcctgtctattcctgtagtctctgagctagttctgcttctgttttacaatttaactactttaaatgggccagattgtttttggaaaatttaaaagagctaaataaaaatgtacatgtataaaacagagttatttcaagtttctcacacatgcattcaatttttattaaacacacacgcatatatgtatttttagcaatataataaggatggtagtaatattaaagtagaactaggaatagcattactataggcaaattattgaactaggaattctgagtttgaaggcttgatgatttcgttgagttttgtgtcctagaagcatcttcatctgctccaagccaagtactctgtcttcatgcttgggcatgaatacaattcaagatagttaccaacaaaacgatagtggtgccttgtcatgtaatagaaaagatattgcacttttttgattcctgacatagtatgaatagtaatgtaaatcacaaactctggaaaaatgaacaaaatgcatagtcaagtaagtaaattctttattattgttgatggatacattgaaaaacacaaaagaggctgaaattaaataatctaaatctctgagagtcatagactaaacatttgctgtttcaactatttgtgaatggttgtaaagaacatattaatatgtaattctgtaagaaacttgaatcatgcagtgagggtatgtgaatgactcacatggctaagaatgagttgaactttcaagagcttttccagctagcccctacactgtagtctcaactctttttttaacttagtagtttaattttgtgaagttttatttaaaagacccccaaagaaagccaactgctaattcttttttttttttttttcagacagagtcttgctctgccaccaggctggagtgcagtgccatgatctgctcactgcaacctccgcctccctggttttcaagcgattaccctgtctcaggctcccaagtagctgggactataggcatgcaccaccatgcctggctaattttttgtattttaatatttggtatttctgggcctagatctactgtccagagtaatacacccttcttgcccagctctgcaagtggtggtctgtagtcagagctgcttctttataatgatgcacattcggtctattcctgtagtctctgagctagttctagagatggagtttcaccatgttggccaggatggtcttgatctcctgaccttgtgatccgcccttctcggcctcccaaagtgctgggattacaggtgtgagccaccatgcccggccccaattgctaagtcttaggatttttttttttttttttttttgagatggagtctcacactgtcgtacaggctggagtgcaatggcaagatctcagctcactgcaatctccgcctcccaggttcaagccattctcctgcctcagcctcccgagtagccgggattacaggtgcctgccaccacgcctggctaatttttttgtattttagtagagatggggtttcaccatgttagccaggatggtcttgatctcctgacctcgtgatccacccgcctcggcctcccaaagtgctgggattacaggcatgagccaccgcacccagctgaatttttaagtacagtttttgaaagttgatgggtcctagccaaaaaagagaagttctggataaatttgatggtgactcagacaaaaatgagcataccatatgctctatatggaaacaagaaaaagtgatatttgaaaatgttttagccagtgctcaattcagaatttacgttaatagcattataaacgactttagttctgtttctatagactcattaggggtctacagggatcatttaaatatttcagttacactttactgcattttatgaggaaaattatatattataatgatacttggggatttgagaaggtcttgggacatatccctcatgaatatctaagtctcagcactagtagatttacttttccccaataatttcttgttaatttttcagtaattgcaaaaatttggcttacttagcttattatggaactctacttttttgaagatgcagagttttcttgcaagttattttaaatttgacagtaaaatgcctaaaaacttaagacttaagatgctagaggaactgcaactgctccagatgtacaagtgctagcatggggtatggttgaagttataacccctgctcttgctaattcctgctgcatggtcattgttcaactcatctgtctacattaaaaaacaaacaaacaaaacaatagcagaattacgggatttgtaacatgcatattgcgtggtctgtgaccataagtcgctttcaggctaggagcaaagacaaagtccgagtaatcaaagtattaatagaaggtggtatagagtagggactgcaacttgcaaagcaatgaaaagaatgttggctttggatcaactaagcctctgctttcctggctctgttgaatagcagctgtatgactggtgctgaccacatagtaggagctcaataaattataattataagatcagtgtcacaaactacagtagaatttagagaagagaagtcattttggatatcagtgctcagcagaactatttaaatttgtccttggagaacaaatagacttgatgaggcagacattagaggggaatttgtgccgccacctaagaatgaacaaaggtgctgtagggaacaagagagcccggtgcatattgggaaaagcactgtgtgtaagtgtgttaccacggaggttctgtgtgtgttggggcagtggggaacagacccaaagagtaggtttttaaaaaacgacagaatgcctgtcactgtgacaaacttctagagaaaatatttcctgtgtttttcatcatgctttcctttgcagcctgcatagaaaactttgctgtcagcttttgtagaggctgcttcctaaatttaattagaagatgtttcctaacagggaagcagagcctcccctcttctttccatggctgcagtttatctaatcaaactaagctcatcaaattcctggcttagttgttcttcacgctggctatgcatcacaatcatttatggagttaagtacacacacacacacacacacacacacacacacacacacacacacacgatgcctgggatccagaattcctgaagaatctcaggaaaaaggcagtccatgtaactgtttaaaagagcttcacagattccaatattcagaaatgattgcaggagaactttgagctcatatcaccttccttagaaattttttaaaacagggtgtgaaggtggaatctatttagatatgataatgctgtgtttctccatgggaatcactatatatttttccttaaaacaactgaatacataatcatcaggcattatttgtaaagatgtcaaaactcaaagagttccatttaccacagctctctctaacttagttgggtccccatagccctctgcattaccttttccactcagccaattcaacagataggtatcaaaataactctaaatttcttgcattttaaaataacatatgggaaaagaaaatagtacagttgctgctttacttcaaagaagtccacctgccttttgaaagcaaagacaacagagtcaatttactctttcatattttttgtccttctgttcctccccctccatcccagtgtttcaaggctacccagacctccttctccctttgactctcatgggcattttcctttgcccagtgtttcgtatccttgtccttcgtgtctttctctatctcttcaagtctctctttgaggtgactggtttcatattttagtcatgaagttataaacagcttaatagtttttccttataaagaatattcatattttaaaagaaagctccaaaaaagcaacaatgtgacagtgtctccacctcacagaatgactcaataatagtgcataattcaaacaccatggcacaataatagaagagatacatttgagcaagtaagcctttatggagtgcctcttgaattacacctggtaggctattcaaagcctgacccagaacaggtaaatgcagtatcaatgagcccaaatcaattttgaaagttttacagcagtttttaaaacataactgcaaagatgatttaaagaactaagtctagtaaaaccaccaggcatcaaacctgaggtgtcgatacctactaggttctcaataagtgtttgtagaatgaatggatgtactaacatatttaaatcatatcaaggaaagaaggctgggtgtgatggctcatgcctgtggttccagcactttgggaggccgaggtgggcagatcacctgaggtcaggagtccaagaccagcctggccaacaaggcaaaactctgtctctactaaaaatacaaaaaattagcctggcacggtggcgtgtacctgtagtcccagctactcagaaggctgaggcaggagaattgcttgaacccaggaagcagaggttacagtgagctgagattgcaccactgtattccagcctgggtgacaagagcaaaactccatctcaaaacaaacaaacaaatcatatcaaggaaagagatgtgaatcaggagctaggaaagctgagttctacttctgacttaggaacaaggtgaaaatggaacagcagagggtagaaactgaagtggtcacagagatgggattgaatggaaaaatacaatgttaaagaggtttcaaggagaagttataaataaggtcaaattctgtgcagtacatgaaaagggagatgattgtgaaaacgtgactggtgacacttctgatagtgttttgagcagagtaggagaaagcacagacagaaagagtttggagagtggaagcaaagaattttctgaatgaccagaaaggaaggaatgatgaaaaatagacaagtgtattgagagggtggcagaatcaaagcaatttttatcatgcatgtaggagaatgggaatggaccatgaagaggcagaaatgaaaaatgtaaaagctgaacagagagtaagatttttaagaagttgatgaggctcagattaagcatatgagtagggaagtttgtctccgaaaggagaagttcttctatctgatactgagcttaaagtacaatgccgagcagaaacaaatattcccaggtgagtcagagctgggaggaagcagaattcctcaggactctatcaaatacctcgtgttatgcttcctgtccaaacgaaagctactaatttcccactctccatccttctgccctgaccaccacatgctggctcacctctgtagtgtaacacatctcattcacctaggcctcctaagacagccctctgatttccactgttctaagacagaacaccttcaaacgagatcttagctgatggctgacctcctaggccttttgctaagaaactaccagggctaagttgaaggctcatgacttaacacattttttttttttttttttggaattggtttccagttaggagattgtctcaaatgaaagcaatacagatctgagtggaatttttaaaaagctgtatttccagagacactttaagtctggcagaatggcatgggattgcttaacagttgagtaccatttaactatgttaacatttatgactgtgccaatactgggcaagggttattccccggcaagaggacctgaagctgtggcactcagtctggctacacaaagaacttgctttatttcatgggaagtgagttgccactaaatctcccaggcagaatgggctctgtacttagtaccattgacaacttacaccttgattctctccttctccttttctaaatgtagtggttcctccattcctgtttgctaaatgtgtctgttattatacagtctatttgttacagagttttatacatgaagtatcaagacattatggtgtcattattttcacctgccactttaaccccacagctatttttactgagacattgggaaaattagattcattagagataatctaagcaaaataaaggtgaaaataaaaaaaattgtatacggtaaaacctttacacttggtggcaatatttaaaactgtgaaaatggattctaggaagatgggaagatgccagggtaagtcaacacttaaataagccaagtagtaccactgaagccttgagtttcctggagaagagagcaagtgtgaggattcatttatcttggggaagggagaagaacagaggtcccaacaggtctgaagctaatatatagcagattccttggccactggagactgcccagccacatatgccggtggagcttcgatcatccaaagaagagcacgtctgccaaggtctcacacagtccttcaggaggttgcctcatgcggctggtaggcagtcctgggagggtaggggtgatgcaataggtaggacaaaatgctacaagtttttatattttagaaggaactttgtcccccttggacctagagagtcttaggtcctggtcttatacctgtcccagtgaagaggttctggtatgctagggtgtaatcactagctcaccagacaaaattgccattgcacccacaaacctccagtttaccagtgctcaagaaaacctcaaacctggcctgttcttgtgtggcaaaatctacattacaaggaagtcaaagaaaaattgctacctatttcatgtactcttaaacttgtgggagggaggtcaagcttgaacaggtagctactattaaggaagagctaatgaatgagacagaggagaatgttagtttcaatgtaatgagtattctcaaagagatacaattagaaaataaaaataataattacttgaactaacaataatgattttcacagttctaaaatcaaagagaggaggtaaaaaaaaaagagagtagctactgctgagacctgaattaactgtctggatgaccaaaataaagggacaaagaaggaaattagtgataaaataagtgatttagaggaagatctaggtgacataacatgcaaagagaagtagttccagatggggaaaacttcagcttctatcaaatagaagtcataatcatggaaataacagaataaaaattctgttgaagaaaggcttgtgccttttgactgaatgggctcactaagactcagacaggattaattttacaaaaagccacacacctagacataatcagggaaaatgtctgacctccaatgctaatgaaaaaaattctttcttctactcagaacaaaaaatagttttcttacaaaagaaagattatgcgactatgttattaaaagaaaatgactgtcgcccaagaatctttataccagccaatcaatataataatcaaatgttaagaaaaaaggcacaatggttttcaacaatcaagaattcagaaaatatgccacccatgtactgatatcttatctgaagaaaatactcaaggaagtactcccaatctcataaaatttctaccagaagcaaatctcttctttacaagaagagcaaagcacaatgcagtgttaatacagtgaataaacagtgttaacttgttttagtttatgtgatgataattctataactaagacagaatagaaattataagacagtgttcttaaaatttatgtttgtgtgtgtgtttaattaaaacccgtaacaaagagctttcagctactcagaaaaatccaaaaattgtggagaaaagaaggaagaggaagtaaggtagaaaggagtttaaaagtctctaaaaaggtacagggagtagagattcaggagtaaaatgggcaagtaggctgtcttagtgtgatcattgtcattactgaactggatatactaagcgagaaatattgtttcacatattattgtgaatagcagaagaatgcaatttccaaattaagagacttttaaaaaaggaaaaacacccaacaaagtaaataaacagtaaacacaaaatattataataataagtaaataggtcatttaccactatatatgttaatggaatgaattatgaaaatagagaaaagaaaaaaagaatgcaggaatggaaatattaatgttaagaaaacaatgaaaactcaggtcaaaagcactaataaagataattagtgatataatgattacaggaataattctcaaagctatatgcataaactatatatcaaacaagaaaagacatatagggaaaaagtgggaaatgatataaaaacacaacgatggccaggcatggtggctctgcactttgggaggccaaggtaggagggccactttagcccaggagttcaagaccagcctgggcaacatagggagactctgtctccacaaaaaaagtaagaataaattagctaggtgttgtgatgtgtgcctgtggtcccagctactttcgggaggctgaggtgggaggatcccttcagcccaggaagttgaggctgcagtgagctgtgagcacgccactgcactccagcttgagcaacagagtgagaccctatctcaaaaaataaaagaaaataaaaacacaacaatgggaaattttaataggtatctgttagattttgactgatcagtcagattgaaaacagtaaatacgtagataagttgagtgatacaattaacttgcttgatttaatagataattgtgaaattatgtagcaacatacatagcacatgtatttttctcatatactcatgtgaattacttgacatacagttggccacaagaataccttggcaatttcccccaaaatagctgttttatacattgggttctttgactagaatttaataaatctaaatctaaaccaacagatgacctacctcacccctttatcaactgcttatatttgcaggaaagtgacagtaaaggctagttaccaagagaaattgaaggaggagtaccatgacattaggtccttgtctctggtcttcccccatgtcaggagtactgccattcctatggtttggctctgagtcaacaatttctcttactgggcttaggctagtttgccttcctttctgtttcatagcaaaaggagctgattaacacagggttctctctttttctctccctctgtctctgtctctcactacatatacatgcggacatgtatattgaattcatacaaataccttcaattacatcaagttgaattgcaaagcccctaatttactgcagatatgcttagattgatatttctatgcacaagacttgacaagtaaaattttttctcatgaatccttctctctcctaaagtaatataatttaaggaacagatctcctgaacacaggatatacataggaacccatggaattttcatctctctaagttcttttactgaacagagaccacaccattaaagaggaacattttgagttctctaggttagcatattaaaaaggtgaaatttacattaaaaactttttagttttaccttaccaaattaaggatccttatttcctttatgtcaaagcagataatcacgaagacctggtaagaacagctgactttctggtcagccattttatcactctgtttttctccttaaggaagattagcacatccttttctactgttagtgttctagtcatgctaacagtagctgcagaatcaagtctttcctagagaaagcctaactgtttcagtgttgtcctggagtcgattccatgttgagtgacatcaggttggtagcttgaaattggctatagtgagagaattcataacacagaaaccagcaacaaatgctacaaataggagatttgttttcaggagaactgcttcactagcatagtagttgttttgttccaggtagctgatctgacgaagtttagaatctcatactctagtgagaagaaataaactggggaaaagaagtattaaaaattgattatgttcttcttgagtcaatgaatttatttcagagaagtataattttttagaaaaataatggagtccttaaactaataattttggaaaatgttaagtgtgaaaaattgtcatataaaattgtaagctgagaaaaaatagtacttttgcttaaggcgacttaaatacatgatcttgtctactttcttccttttaatctcctgtattcttgtagtattgaatctttctagtttctacttcgaagaacaactaatttaatttttcaaaggatggttggaatggtatttcagtgaataagaatatttcatattgtgccttaataaaacttggaaacctgttattattataaggataaaaattactaaggctttttctttctagaaaatcactgaaacattcttattacttcatacagcttcacagtgctaagcaaagtcgacttatgttcttagtggaattaatcaatgtacagccaattataactagtagtaggttcagagttgacaaatatgcgtatcaaagtcatgtatggaaacttgaactgaaaccccttaatttacattccccaaatgtccagaagaataagaaaattaaaaacaaagtcaaaactgagcactgaaagtttagcactgatgaatgttcagaagtctaaaagatacatttgtgttgggagttgaagtcgtggtaagggtgctgtcagtggcatgcagggatctggcttcaaggattttgaattgtttttatttagtggcctttgcaattactggccttgccagctcatgaaggagcttatcatcactccccctaccacttaccatcaccaccactttgagaagaacaattcaatttatttttatgatagagcacactttttgatctctggatgaagtcagttacatctcctgtatttgacttaaaatttcaggagaggaaaaaaaaacactcaaagaaacaaacaaacaaacaaataaacaaagccttttaaaaaatactgtgaatcagtacatttccttaatgttataaaagtcttttgagattcttgtatgtgtgtgtttaattgtcccagctatcttctatgaactgagaaaggccttcttttgtttgaatgtgacagatcagttagaactgtggcaactaccatttacagctattgatttcaatgtgacattaaaggccccaaattccaccattattctcttcaattgtcacaaacaaaggttaataatagttgagtttggactgaaggaatcaagtaaagattgccaactgaaattacatgttgtttatctgaggcacaagtcagtatgagggtctctggtccctaggttgcatgtgtattatcattattttaaaaatatgccttttgctaaaagtaatatttaaaatacagaaaatgaaagtgtagtataagaaatcatgctatttaaaataaataatttaaaaaatatacttgtccttaacacagagtaaaaacattttgttttgttgcttctatagcagcaaaataatgtttctcataactgtaaaaagtggtatgtagcatgattaaacaatatttcaactctttagttcatgcagaggttaccagctagagggtagaaaggtttgattaggtttatgtcttccatgagaattttttttaaaaagcatacaactcccttaatatatgagtgctaaagctacaaatggctttcttttgtggtcaggtatgaaagaacaaagtccctttactacaataaataggtagaaaatagctagtgagatattataaatcttcacaaaagcaatgccaagttaaaaaagtctgtaagtctttaaaattttaactcgtttatatttatatcatcacttactacctatttactccaatggtaaatggtaaatagtttcatgtgctgtttccatggtaaagcttcttaaacaagcatcttattttttaaaaaattacactaataattgcaattatattaatacataattattcaatatttacatagaactgcagaattacacttattagtggaaaatagctattttaaagtattttatgaaaaggaaccctagattaagtaaatgaattgaggataatttattattggtcattatttcttaaaaataaaaaaaagagagagagagagagagaatctcgccaaaagtacttgctagtaaccattctaaggaattctagaagtagggcagtatgattccaaataaatatggtttattttttgaatagacagaccaacattcacgcttgagttaatgctatgcagtaccatttcataactcagaagataacaataaaacacacaggtgttgagaattgttcatatatagacaattgtacaaagaaatgaaagttctcctttcccagtaccagaggttctaaacactagtagtgttggtgtctattcttttcattctttaaaccctatgtttatatatgtacatctttatataatacatgtattattgttattttaacattcaatttttttctctttacattatatataatctatatatgtcaccacacacacacacacacactacattgatatatgcgaaaattgctttactttttccctttcattaagacatagagatctatctcactgttttttatagtgacagagtatcccattgtgtacatgccataagttactcaacgttctttaaggatggacatttgtctccagttgtgttattaaaaatggtgctaacttgaactacatgaaacatgtttatgcatgtactataatttttataggagagatttttagaattggcctgctgggactaaaagtatatgccatgaaatttacttagatgctgcaaaatgctttcccaaagggtggtactgtttcactttccactagtaaaatatgaaagtgactgcttccccacactctctatagcactaatggtaatcactctttgccaaattagttgatgaaaaatataatatctgtgttggtttaattcgtatttccattctgaccagctgggttggatatcttttcacgtttaccggccattggtaattttgcttctttaaattgtctatccatttttaaaaatctgaattgtttgtcattttcttagtaactggctaaaaatattttttcctaatgtcccattttcccctgcttacatgaagagtgcattatcattttaaaaaatacatatggacaaaaagaagatgaaaactgtccataatatttttggtgtatattctgacattagtgttaaagatgagatggaatcatgcttcccattctatttgtcattgcttttcttcactcaacaaaatgggctctacatttttgtatacccttaaatgttcattcacaactatgctttttaaactttgtgatcaaaacaaaagtaagaaaacattgaaatcctttcaccaagcaaaatttcattttgaaaacacaaaaatggagtccaagtggaatggctcaatcacctttccctcataactcatatcctagactggataacggtgactgtcgggatgcgagaaaatgctttttaattgacaggtagaaaacagcaggaagaaaagtgatgggtacctcacttgcaattatgtgtgtaagaaggcttctagtcttgattacaactccatgagatgaatgctgttattaacccattttacagaagacaaaatgagtgcaaagtcacttgctttatatgataacatatagtatgcatagcatttgaattcagcaatccagttctgaaatatgtgctcttaatcactatgaaacctgcctaatagaagtacacaaacaatatttacacttgggtcatattattttaatgattttttttacaagactttcccaacatgttgcaagaactgtaaaaataggtttaaaattttgtttaatgcagtaaatgcaaaagaatatttataatacatatattaggtaaagtaagtttttatttctcattcctttgcttttaaaagttttaccatatacatttatatctccaaagaacatataatttagtattaaatgtttttatcttccatatacatgaaataatattcttccttattcttcagcaacttcctttgtcaatctgacattatatcacagagatttatttatgttttccatatagccatatatcattcatttttattgctacaaagtattccactgtataattacaagtctttttatctcttctaccataaatgggcatttggttgtttctagtttttaaattattactatatcttctcttaagtggttgctcgatcctttttttagtttttatattgagttgtcttccgcttctgaatttgaagaaatgcatatattctaaatatcactcttctgtctcttgtttgtagaacaagtgtttattcctaatttatatcttgtcttttcgttttcctcatggtattttttgattaagaaattttaacaaacttttatgatctctgtattttctgccttgtttaaagaatccttatagattataaggtccataaggcatttttctatactgtttttgaaacatttaccgtactgcctatcacataaaggtctatctacttaaacttgatttttatgtatagataatgattgtcttactagtatttagttaatagttcaaaattttctcactggtttgtaatgatagctcagacaaaaatcaagcttccatatctgtctgggtatctttacgagttctgtgttctgcgagtttgctcaatttatccaactgtgtgtcaaaacccctatcttaagagatatagctttataagaattgttgaaagtggttatgaccaagttaatatatgttaagtgcttagaacaatgtctagcataaatgctatataaaatattttattttattattattattgaatgccttggtgatttggggccttttaaacatccatataaatatataaatcagtggattcttttggatattttttatagattatcagaagatatgtgaataatgtcatttttcccaatcctgatattttcattttttatctctttattttaaattcatttttcaagccttactgtattggcattttatatctagtacaatgtagaatgaatatgctaacagcaggcacccttgttttatttctgattttaaagacatgcttaccacatttcactattaagtttgatgtttgcagcagatattttgcaaatatctttgatcactttaaggaagttccttcctattcacaattttctaagatgtttttaaaattatgaatgaatcttgacttctaccaaacatattttccgtatctagtgagatgatcatataatttttctgctttaacttgttaatatgatgacttacatgacatgatgttttctttcggttaagccaacctggatttactgagataagctccatgttgtcatgccatattcatctttttaatcttttaatatgttgctggattctgcatgttaacattttgtttcatatcttgcattgatgcttatgagtgagactgacctataatttcttttcttacactaatctttcaatatcaaggttgtaccgggctcataaattgagggagtattgtgtttttttattgactgattgttttttcaattgacagacaaaattgtaggtatttatcatgtacaacatgatgttctgaagtatatatacattgtggaatagctaaattgagctacttatatgcattatctcacacagtcttcattttttgtagtgagaccacaataaacattctcagtattctcaagaatacaatatatcattttttttgctatagtctgtaatagcttaaaacctttcctcctgcatttctgactttctaaagcctgtttggaaggccagctttctcttgtgtactgaaaaccaatctcactggaatgctggtcagccattctacagttaaaatggaaattaggaatctttttgactaattagatttcaaatagcttttgcttgtacagtatattcatggatgttaagaaggcattgtcacaattaaggtttttgagaaaatcctttccaagaggatgttttccatcaacaaacagaagaaaaattaaatgcccgattaacaaacataatgtcctctttaataattctcagcactctggtaattctgttaatattactgtgctatatctacagttctttccttttgtttcatgttctgaataattcaattaaaagtctgacaaagcaataacaagggattgaatgctgtcgaatcgtaatttgaaataaaaacataagctctttgggaacacttatttaaaattctgcaaaaccttttcaagtatctgagattgttgcattctacaaaagaaacagttaactacttagctaagttatcctgcttcctttcttgtaaccaatttccgtaaataaggaaaacacagttgtgtaaaacaatgaagttcttgcaaaacagaccactttgtctgcacctggcttacatggaaggaagaactattcctttttcctgaattttgaggaaaaacagtggcacagcttgagtactgaacagcagaattgcctggaaggctcatccacagggcctacaatttctgtccttttatctggaaaatattaatatacaaggtaatgtgagggaaatgaaaaagaatgtgataaagaccttgcccttagaaagtggccactctagtaacagagataagagctgtcatgtgtgacacaatctcatgcagttggcggacagaagggagccagaaggtatgaaggggaatattgatccagatgttaaagccataggcttcaacttcccctcccccaatatggacactattctgcttcagttctctgagctgtcatcagaattcatgataaggaaagacacagtgaggaaatcacttattctgacatcaagaagaaaagcaagtaatataacctggtgtcattttacagaaaagctacggagtagtgattaagtgtacagtcctgtagtacagaaacctgtggtcaatttctggctgtagaatttcagccaagttgctcaacttttctatcctgcagtttcctgatctagaaagtacgaataatagtacactagctcagagagttgtttgaggattaaataatataatctacttaaaatgttaaccatttcctggcataaaataagctctcaaaaatgagaaccatttaatattatcaatgtgagccaatcctacaagttcttactgaagaaagtagcaatgattcttttttttttttggagttatttctttttattaattttattattattatattttaagttttagggtacatgtgcacaacgtgcaggtttgttacatatgtatacatgtgccatgttggtgtgctgcacccattaactcgtcatttagcatttggtatatctcctaatgctatccctcgcccctgcccccaccccacaacaggccctggtgtgtgatgttccccttcctgtgtccatgtgttctcattgttcaattcccacctatgagtgagaaaatgcggtgtttggttttttgtccttgtgatagtttgctgagaatgatggcttccaggttcatccatgtccctgcaaaggacatgaactcatcaatttttatggctgcatagtattccatggtgtatatgtgccacattttcttaatccagtctatcgttgttggacatttgggttggttccaagtctttgctattgtgaatagtactgcaataaatatacgtgtgcatgtgtctttatagcagcatgatttataatcctttgggtatatacccagtaatgggatggctgtgtcaaatggtatttctagttctagatccctgaggaatcagaaagtggcaatgattctaaaagaatccaaaaaaaaaaaaaatgctgcagattcaaacaagagaaatgctatgtaagcaaaaagagaagaaatatgtaattaaagaaacagaaagacaaagttaatttttaagcaaaattcagtgagagaaaccagtctcagagctgaagaccactcctcttgtaggctgggaaacagatagaggtaggagtgacaaagaaggagaccaaagaaaaagaaaggaagccatgggaaaattgaaatctgctttttaactaaaaagaattaaactttattgtaatactggctgggatatagctggtaaggaggaacatattaaatactcaaaccataggcttttgtccaaaatgtcttatttaaacagttttctaatctgaagtttagtactaatctgaagcttagtactatatacaactgatacttaaaaataatttagtcattcaaatttacttacattctttctatgcttacaatttataatggaatgtgggttgctcataacatttttatatttactcctccatatataagactgaacttttgtaggcagccatcccatttgacaaatccaaggtgacctaaaagtttaggttacaggggtcagtgaaataaattaactgatatattaatagcttattattggagcagttgtgtttaaatatgacaggttttgtattaaaactggcactagttaagcacagccagaacagagtttcaattattaataatgctgtgagtcacaaaatcagaaaaaatttaaaaacatctgacatagttgttcagggttgttttacatactgactttaaaatgtaatcatttacccaagtgtttatgttataactggaatctggtcaatagaaatgcaatatgagattcaacagcaaccgatactgtgtgcttttaaaaatgagtgtgtcatgtcaaagacttgtaaaatgggagcagtgccttaccaaggctgagtcttttagtaatgaaatgaatgaaactctatatggtgaacttatagaaaagccactatgtttgatgcaattggctacaggaagtcgtggccttcaggaaagaatctgtgggaggtttgctgaactttgtatctcctattcagccactataaataatttccctgtgacatcctctaaggaagcaagtgtccccgttatcacatttgcttatttattttcagtttattatctctctttcaaaacttcatagctctttatatctgttcctccctcttctccaaaccgagaagagagtaattaaaaattagaagtttgaaatatgtaagatctaacatgaacattccactgcatctggaagctgacagggcaactgacttattcttgcaggtgcttaaaatgaactatatgacaagttggagagtttactctgaaagcccaattagtaaaaataaaatgagagaagatgttcccacggcgtttgcaaaatgatattaaaagaaccaatgtttcttttaaaaataagcctgatacaggaaaaaggtaaagggcagaatcaaagtggcaagaaaagaaaaaaataaatcatggaatgaaagaaacactgaactggaaatttagagatatgaggtcaaggggaaaggttaaaattataaaggacatgaatacagagatagaagaaatcatgtccgtggtagaagacagtacactaacttttttgagctactatccccaatcttatttaaaataataactacaacaaaaataaaaacagcattaatcttagaatacaataaggcaaaaaatggagaattagcaaacacgatagggagagaaacaaaatcaaacgtgtttcaggagaaacaggattagaaaagagaatgtttataaaagaggaaatcagtcaggcaaataaaagcaaatggagaaaaacatttaaaaggaacaaggaactcaataccgtaaaagaagaattgaattgcagattttgatgtaactcacttatatttcataactatacatctcaattcaatttaattcagctactgcaagtattacaaaaatttgtagccataccagaggtggagattactatttttatttcattttgagtgtgacacaaaaatggggttaaagaatctggcacattctttggtattcactgccaaggaggtttgaactttctaaaatgatgcagtgagattttcaagcagaaaaaagtccttctcaaataactctaaataaaaagaaggagctctagatccaaagggatcaaggaagtgaaagtggaggaggtcagacaacaagtgccaatgtggcgtgtccacacaaagaggaaagaaaaattgggaatgatggacataaccaactaaggaatataaaagattgaacaaaacctaaactgatggttcccagtgtctctaacatctgcatgaggcctgctacctaatagttgctcaattaataactaatgaattaaatgaatcagtgaattaactgaattccacttagtggaactatcttttcaggctgtactcatcagtgggaaacaatgaaagaatgagcagacagctggatttacaagaaatagtgtcaaaaatttgtcactttggaaaagacttgctcttggagaaaagaggaaaatattgaacaacctgaaatagtaaaaaaaaaaaaaaaatcttacagattctatgtgaactgatctacagggaagaaataggtctacactgttttcaaaaaaaactactctggttgtttgatttttttttccccttccctactttgtgggatgatgtttgattgttttttattgccatcagcattggcactcctccggacacgtgtttggggttcttggaaccaaaatgaatagtacatacagtaaagtgcacctttcgtgaagggaaaatgacaactacataacaccatgtaaaagaatgcaggcaaaaagagaatttgtttttctgtattatatgagacaataaggcggaaagagaaagaaaagtaaggcaaacgacgcatgacagaaaggagaacaaggctcagaacacacaagatcaagcaaggggggtgggggagcccatgaaggcagaaacaaggtaacaaaaaggacaaaaccagcagtagaaaagaactgtcagacacaaaaccctcaaaacaatagataggaaaaaaaggaacaagatgacaggaaaagagcagcatggaatctagtaagaaaaagaaacaaaaatttcaaataatggattttctaacacccccgctgttcctccagtgcattgtgtcacagtctcacagagcagtgcataatttattatggtcactcgctgccaggctgctataaagggcagtagctatatgaaaatactcctcactgcctggatggcttaatgatctaccatttgtagaggggcagggctgcggaatggcaggcaagggcaggaggagcacttgtggtgctggatggcgctctgcatatttagtgcttcccaccgtttgaagaaggggtgtattaactctcaagacacctcggtggggttttttcccccttttaaagcctttcctaaataataaacttctgtccagagcagtttcttaatctgaaactacatataccctcctttaaggcaggggtcatgtcaaagtaaacaaccaccaaaagatggattttaaacataaaatctgacttggacaattaacattaataactggaaaactgcattctgttttttttttttttttctatgctacagtttctctttagaaatgaattttgggtgcagaaaaacttaaaagtctcaaaaaaaatagagaccatacaaatcattttcagcaatcattttccagaaactggacttttcggtagtatttatatagaggaactttcataacttccacaaatagcactgtcttcaaactgaaatgcatcatcaagatatctatcaataatttctgtgattgataaagccagggattacttctttaaaattcttctttgagaggcagtcatgtctgagggacaggagcacaggctcttgagccagatggccgagatttgggtccagatgaggccactgacttgccgtgtgaccctgccatgttacttaccctttctgagttccttcatctgtaaaatgggaacaataatagtaaatatatcatagaattgctgtgagaattaaatgaattagcccttgggtgagagcctgctaaacaaaaagcacggcaggtgtcaggtgttgtacctgctctcaacaaagcatgatgggacattagggcatttgtaatccagaaccgttcgccatttggtcataggcatagagacagctgaaaagtgcatcccttaattccacaaaagaccaggctagacagtgcactttctctttctgtcctctcatccttggatacaacccttgcttatataggacaacagatgtgtaaaaggaagtcacagtcagctgttttgacatctttcatcctccaaactcctatagtaaaacgcaaaatgcaaaaaatgctcattcttaaacaaaatgatttttgagttccaaagataaaatattttgaaaaagatggtccagatcacagaaaattgttaataatatgcatatataagtagtatgtaattctggacaaggacaaacatatttaggttggagaaatcagacatgtgaagcttaaaatagtagaaggtggaaagatagcaaaaaatcagaacaagttatggagagtggtcacagaaggaagaaaattaatttgaaatgtaagttctcaatttaaaaaaatcagaactactttcctgggtcatactcaagaacaatccttctcaggatcttctcactgccaatgacacgaaaagacattttgtgtcaaaggtgaattcattcaattatccactcattcattcgttcattcattaatctatccccaaattatttactgaatacctgccatgtatcacattaatcacattaatccctggagaatcaatggggaacaagtcactctaccatcagtttctttatttttcatgtggagaatattctatcttccccctcaaagttgattgaggaatgaatgtgatcccatgtgtagaaataggcactttgcctagaatacaaagggaactgactgaataaaatcagtttctaatcaccataaaaatcatttatgaatttattattttgggatatatttacatcatgataactatacttttattgcaatcaccttaagacacacttatttactacctaaagggaaactatatttcactttatgtattctaaatctatcatctctataggaataataggtatatgtttaatattcaaaatctttcatttttgaaattttattttttaataattgaaaaattattgttgtatatatttgagttaccaagtgatgttacaatttatgaatacaatgtatacgttaaaattaaatcaagttaattaacatatccatcacctaaaatacttactttttgtggtgagaacatttgaaatttactctcttagcaattttgaaatgtacaataaatggttatttactatattcaccatgttttacaatatatctcatagtaaaaagaacccttattattcctgtctaattgagactttacatcctttcaccatctcctccctattctttgaccatcttctccctattctccccaccccgagcttctggtaatcaccattctactttctgtttctttagttttagattgtttcattgttttagagtccacatgtaagagaatatgcaatatttgtctctctaggcctgccttccttcacgtaacatgttctctagttccagtcatattgttccaagtgacacaatttctttcttttttaaggctgaatagtagtccattgtgtatatataccatattttctttatccattcatctgctgatagacacttaggttgattccataagttgcctattgtgaatagtactgcaaggaacatagataggcatgcagacatttctttgataagctgatttcaaatctattgcataaatacccagaagtaggattgttggatcatatggtaattctacttttggtttttcggggaacttttatgatgtttccataaaaagtatactaatttacatttccaccaacagcgtgccagggctcccttttctctgcatcttctccaacacttattatctgttgtctttttgataacagccattctgacaggtgtgagtgatatctcactgtggttttaatttgcatttacctagtgatcaccgatgttgagcattttttcatatgcctattggtcatttgtgttatttcttttaagaaatgtctattcagctcccttgctcattttttattcaaactatttcttttctttccaaagagttgtttagtctccttatatatatttgatattaaccccttatcagatttatggcccaaaaatattttcttcaaatccatgggttgcttcttcactctgttaattgtttcctttgctgtgcagaagctttttattttgatgtaatccaatttgtctatttttgcacttgttgcctgtgatcaggtagcaatatttgctgttctgcaatatttgctgttctgcagcctccgctggtgacacccaggcaaacagggtctggagtggagctccagcaattaaaaaattaaaaaatcattatctagaccaatattgtgcactttttctcctatattttcttctagtagttttacagtttaaggtcttacatttacctctttaatccacttgataatatttctgttaatgctgtgagataatgatctaatttcattcttctgcacatggatatacatttttcacaacaccctttaatgaaaagatgtcctttttccaatggttatacttggcacccttgcttaacatcaattgactatatatgaataggttcactgctgagttttccattctgctccactggtcaattagtctatttttatgccaacatcatgctgtttaactaacatcacttggtggtagagttcagaatcagttagtatgatgtccacagctttgttctttttgctcggactgacttggctattcagggtttttttgcagttccatacacattttagaattatattttctatgtctatgaaaaactatattaaattttcataggtattacactgattgtgtagattgctttgggagataatatgaacattttaacaaaccaattcttctaatccatgaacacaagatatatttgtttttgtatctttttcaattgctttcatcatgttttacagtttttagtatatgggtaagtttctcacctccttggttaaatggattccttttgatttctttttcatatagttcattgttaatgtacagaaacatcattgatttttgtttattgattttgtatgctgcaactgtgctgtgttaatttattagttctaacagtgttttttttttttggtggaatccttagtattttctacatataagatcatgttagtaaacagcaacaatttgacttctgcttttcctatttgcatgcatttaatttctttctcttgcttgattggtttggtaaggctcttgcttgattggtctggtaaggacttccagtactatctttttaaaacagacttacgggatacaaatgcagttttgttacatggatatattgcatactggtgaaatctgagttttctgtatagccttcacccaaatactgcatattgtacccattaagtagtttatcataccttaacccttttccacccttccacccttctgagtctccagtgactattattccattgtctttgtccatgtgtacaaattatttagctcctgcttatgagtgagaatatgtttccgtttctgagttatttcaattaagataatgacctctaggattccattctgagatggccgaataggaacagctccgatctgcagcttccagcatgatcaatgcagaagatgggtgatttctgcatttccagctgaggtacctggttcatctcattgggactggttggacagtgggtgcagcccactgaggatgagctgaagcagtgggggtgtcacctcacctgggaagcacaagtggttgggggatttccctttcctagccaagggatgccgtgagagatggcacctggaaaaccaggacactcccacccaaatactgtgcttttccaatggtcttagcaaatggcacaccaggagattatatcctgcgcctggctcagtggattccaagcccaaggagccttgcttatggctagcgcagcagtctgagatcaacctatgaggcagcagcctggcaggtggaggggcatctgccattgctgaggcttgaataggtaaacatagcagctggggaagctagaactcggtggagcccaccgcagctcagcaaggctggctgcctctgtggtctccacctctgggggcagggcatagctgaacaaaaggcagcagaaacttctgcagacttaaacatccctgtctgacagctctgaagagagcagtggttctcccagcatggtgtctgagctcagagaaaggacaggctgcatcctcaagtgggcccctgatgcccgtgtagcctaactgggagacacctctcagtaggggccgacagacaccacatataggcagctgcccctctgggacgaagcttccagaggaaggatcaggtcgcaatatttgctgttctgcagcctccgctggtgacacccaggcaaacagggtctggagtggagctccagcaaacttcaacagacctgtagctgagggacctgactattagaaggaaaactaacaaacagaaaggaatagcatcaacatcaacaaaaaggacatctacaccaaaaccctatctgtaggtcaccaacattaaagaccaaaggtagataaaaccacaaagatggggagaaaccagaagagaaaagctgaaaattctaaaaatcagagtgcctcttctcctacaaaggatcacagctcctcggcagcaacagaaaaaagctggatggagaatgattttgacaagttgacagaagtaggcttcagaaggttggtaataacaaacttctctgagctaaaggaggatgttcgaacccatcgcaaggaagcttaaaaccttgaaaaaagatgagatgaatggccacctagaataaacagtgtggagaaaaacttaaatgacctgatggagttgaaaaccatgacacgagaactacgtgacacatgcacaagcttcaatagccaatttgatcaagtggaagaaagggtatcagtgattgaagatcaaattaatgaaataaagcaagaagtttagaggaaaaaaaagtgaaaataaacgaacaaagcctccaagaaatatgggactctgtgaaaatatcaaatctacatttgattggtgtacctgaaagtgatggggagaatggaaccaagttggaaaacactcttcaggatattttccaggagaatttccccaacctagcaaggcaggccaacattcaaattcaggaaatagagagaacactacaaagatactccttgagaagagcaactccaagacacataattgtcagattcaccaaggttgaagtgaaggaaaaaatgttaagggcagtcagagagaaaggtcgggttaccaacaaagagaagtctatcagactaacagtggatctctcagcagaaactctacaagccagaagagagtgggggccaatatacaacattcttaaagaaaagaattttcaacccaaatttcatatccagccaaactaagcttcataagtgaaggagaaataaaatcctttacagacaagcaaatgctgagagattttgtcaccagcaggcctgccttacaagagctcctgaaggaagcactaaacatggaaaggaacaaccagtaccagccactgcaaaaatatgccaaattgtaaagaccatcaatgctaggaagaaactgcatcaagtaacaggcaaaataaccagctaacatcataatgacaggatcaaattcacacataacaatattaaccttaaatgtaaatgggctaaatgttccaattaaaagacatggactggcaaactggatattcaagacccatcagtgtgctgtattcaggagaaccatctcacatgcaaagacacacataggctcaaaataaagggatggaggaagatctaccaagcaaatggaaagcaaaaaaaaagcagaggttgcaataatagtacctgataaaatagactttaaaccaacaaagatcaaaagagaccattatgtgatggtaaagggatcaatttaacaagaagagctaactaacctaaataaatatgcacccaatacaggagcacccagattcataaagcaagtccttagagacctacaaagaaacttagactcccacacaataataatgggagattttaacaccccactgtccactgtcaatattagacagatcagtgagacagaaggttaacaaggatatccaggacttgaactcagctctgcaccaagcagacctaatagacatctacagaactctccaccccaaatcaacagaatatacattcttctcagcaccacatcacactaattccaaaattgaccacatagttggaagtaaagcactcctcagcaaatggaaaagaacagaaatcacaacaaactgtctctcagaccacagtgcaatcaaattagaactcaggattaagaaactcattcaaaattgcacaactacatggaaactgaacaacatgctcctgaacgactactgggtaaataacgaaattaaggcagaaataaagatgttctttgaaaccaatgagaacaaagacacaacataccagaatctctgggacacatttaaagcagtgtgtagagagaaatttatagcactaaatgcccacaagagaaagcaggaaagatccaaaactgacaccctaatatcacaattaaaagaactagagaagcaagagcaaacaaattcaaaagctatcagaaggcaagaaataactaagatcagagcagaactgaaggagatagagacacaaaatatccttaaaaaaatcaatgaatccaggatctggctttttgaaaagatcaacaaaattgatagaacgctagcaagactaataaagaagaagagagagaagaatcaaatagacacaataataaatgataaaggggatatcaccacggatcccacagaaatacaaaccaccatcagagaatactataaacgtctctaccaagtaaactagaaaatctagaagaaatggataaattcctggacacatacaccctctcaagactaaaccaggaagaagatgaatctctgaatagaccaataacaggctctgaaattgaggcaataattaatagcctaccaaccaaaaaaagtccaggaccagacagattcacagccgaattctaccagaggtacaaagaggagttgataccattccttctgaaactattccaatcaatagaaaatgagggaatcctccgtaactcatcttatgaggccagcattatcctgataccaaagcctggcagagacacaacaaaaaaagagaattttagaccaaaaaccctgatgaatatcgatgcaaaaatcctcagtaaaatactggcaaagcgaatccagcagcacatcaaaaagcttatccaccacgatcaagtcaacttcatccctggcatgccagcctggttcaacatacgcaaatcaataaatgtaatccatcacataaagagaatcaatgacaaaaaccatatgattatctcaatagatgcataaaaggccttcaataaaattgaacagccttcatgctaaaaactctcaataaattaggtattgatggaacatatctcaaaataataagagctatttatgacaaacccacagccaatatcatactgaatgggcaaaaactggaagcattccctttgaaaactggcacaagacagggatgccctctctcaccactcctattacacatagtgttggaagttctggccagggccatcaggcaagagaaagaaataaagggcattcaattaggaaaagaggaagtcaaattgtccttgtttgcagatgacatgattgtatatttagaaaaccccatagtctcagcccaaaatctctttaagctgataagcaacttcagcaaagtctcaggatacaaaatcaatgtgcaaaaatcacaagcattccaatacaccaataacggacaaacagagagccaaatcatgagcgaactcccattcacgattgctacagagaataaaatacctaggaatgcaacttacaagggatgtgaaggacctcttcaaggagaactacaaaccactgctcaatgaaataaaagaggacacaaacaaatggaagaacattccatgctcagggataggaagaatcaatatcgtgaaaatggccatactgcccaaggtaattcatagaatcaatgccatccccatcaagctatcaatgactttcttcacagaattggaaaaaactactttaaagttcatatggaatcaaaaaatagcccacataggtaagacaatcctaagcaaaaagaacaaagctggaggcatcacactacctgacttcaaactctattacaaggctacagtaaccaagacagcatgatactggtaccaaaagagctatatagaccaacggaacagaacagaggcctcagaaataacatcacacatctacaaccatctgatctttgacaaacctgacgaaaacaagaaatggggaaaggattccttatttaataaatggttctgggaaaactggctagccatatgtaggaagctgaaactggatcccttccttacaccttacacaaaaattaattcaagatggattaaagactcacatgttagacctaaaaccataaaaaccctagaagaaaacctaggcaataccaatcaggacacaggcatgggaaaggacttcatgtctaaaacaccaaaagcaatggcaacagaaggcaaaattgacaaatgggatctaattaaactaaagagcttctgcacagcaaaataaattaccatcagagtgaacggacaacctacagaataggagaaaatttctgcaatctacccatctgacaaagggctaataaccagaatctacaagaacttaaacaaatttacaagaaaaaaacatacaaccccatcaaaaggtgggcaaaggatatgaacagacatttctcaaaagaagacacttatgcagccacagacacatgaaaaaatgctcatcatcactggtcatcagagaaatgcaaatcaaaaccacaataacataccatctcatgccagttagaatgcccatcattaaaaagtcaggaaacaacagatgctggagaggatgtggaggaataggaatgcctttatactgttggtgagactgtaaactagttcaatcattgtggaagacagtgtggcgatttgtcaaggatctagaactagaaatatcatttgacccagtgatcccattactgggtatatacaaaaaggattataaatcatgctactataaagacacatgcacacatatgtttattgtagcactattcacaatagcaaaaacttggaagcagcccaaaggtccatcaatgataggctggattaagaaaatgtggcacatatacaccatggatattatgtagccataaaaaaaggatgagttcatgtcctttgcaggatcatggatacagctggaaaccatcattctgagcaaactagcacaaggacaaaaaaccaaacactgtgtgttctcactcataggtgggaatttaacaatgagaacacttggacacaggatggggaacatcacaccccagggcctgtcatggggtggggagcagggggagggacagcattagagaaatacctaatataaatgatgagatgatgggtgcagcaaaccaacatggcacatgtatacctacgtaacaaacctgcacgttgtgcacatgtaccctagaacttaaattatacgtataaaaaatgataatgacctctagttccatccatgttgctacaaaagacattatttcattctttttatggctgagtagtattccatgatatctatatctatatctatatctatacagatattagaagagaaaagatactgttatcccttcatatatcaatttcttccatgttacccaaaacacaattacaggaaaaacaggagtgccaagcctgccatgttgtttacagttttggtgtggtcaaggaaagaaaaaatgttggcaaaggaaaattgcaacaaagttttccattcacttaatagaaggttagacattttacaaataagagaagaaagctgcatgttcttttctgatgaatcatgaacacatactaaggttaatggaatttgcaacctatctatgaggactttcaaaactgaatagacccagtagcaacaaatagggagaaaggggcaaaaactcaagcaatcaatcctagaaaaaaataaataaataacatgaggaaagagtcaaagatgtttaagacatctcaaagacagtaaaattgtaattcatgctttaaattgatttttccttaaacaaaacttttttttggagagtacatatattcattaagcatactgatacttaaagtgcttttggtgagagaacaaaaacaaagttaggtataaaacaaaattttcaataagatctctgcaatataaacaatgtcaagagagacttcatgttggtataaaatctgtgattatcaataagcaccacctcgtgtttgtctggggggttgtaatagttctcagagaatatggcttccccaatgatcatgacaaaagagccttcagtcttcagccaatactcctaagttgtaaaatgccgtaattttaataactttatttttcttgacttaccttatctccttctctagtcaggcaaatccatacgcctccttcctgacagctcacctatcgcagttggaaaccttaaactgactgcaccataaaagactgactacctcagcaggaagcgtgtacaaatttctctttgcggtagaagtaccttaattttaaggtctttgtgaaggtggtgcctctgataccttcgtttaatttgtcttattccttatcttctctcttgccttatcttgaactctgttggctctactctcagccgctgagtacttactagttttctggtccaatattgctttttagcctgaaatgcagtctcctttactctcgagtcatttgtggcttctaatacatgactcagtcttgtccaccagttcttccaatattctaggccagtcagatcacgtaactagaccctcccttttcctgccaatattcatttcttagcaatcttggtgtcccaccttgtctctactctgccctgacaatctctattattcttctgtgacattacattacctgaactcttcatgaaatcatgaactaagaccatagcctctcctccatctcacctctgtctctgtctctctttatgacatttttatttcatccttatgctatagtcaacaaatacatagagaattctgctatatttctcaaactcactgtgatgtgaacaaatatttgagggtgatttttaaaaaacttaaaaaatacttttgttgcttatttctggaataaaacaaatgagaacaataaaaaccaagtaagttaaaaaaatccatagttagctgtttttcctgtaacattcaccaggctggagtgcagttgtgtgatctcagttcaccgcaacctccgtctctcaggctcaagtgatcctcccacctcagtaccccaagtagctggaaacacaggtgcacaccaccatatccagctaatttttgtgtgtgtgtttttagcagacacggggtttcgccatgttgcccaggctggtctcaaactccttagctcaagcaatcttcctgcctcagcctcccaaagtgctggcatacagtcatgagccaccatgcctggcctatatataatgttttttactgccacataatggttgggctacacaaaaacaacaatatttcctgacctagaactgataattcagttagatttaaacggtgttgctttcaactaaaaaaattacaacttttaaaagcagcaaaaatttttacatcattaccaacattaataactataattgaaaaactcatagagaaccagctgtaggcaaaatattggcagttacataaatgtctcttacagatttcctgtagtttatctacttatgtaagcacccatgtctatcaaatggctgagaattaaaatcaaataaaaagttgggcaacataatatagtataaagcagattttttttgattagagatagtttttctcataaacaagtggataatttattttaaagaacttcaaaaattataatgctatgaggaaaataaaataggatgaatccaatgaatatggctaacatcagattttagtcacttttgcagaagcttataccacacagtcatttctcatgtttcttcatggaactatgttatttcatagtgcaatgattttcaaacccataaaagtgatgcctcaggggatcatcccactgaggccaacctagtctatcccatacttatcaagtcaaatcatagacctggagttccaactctctagcccaaacctacatgtgtccatgctgattccggcataactaaacatcacattcaggataattctccacatacatagctcatagaggcttaagtcacaaggaatgagaagaatcaagaacctgcagaagatgtctcaggagcacatacctaatcagtatcaaaaagcgaacagaactcagcagtgatcctcaccttagattctccatgagatgccagggaggctactgtggcttaagtttgttgtattttacaagtgctggggctcccacattcttttctctaacctttgggatttcttatattcccaaactcctgagtttcaactctgggaaatatggaaaatactatgacttttcagctgttttggttttaaaaaagtgtcttcatattgtctcctccacagacatctatgggggtctgatccaagcagggctgtggtcattgctccctggacactgcattgcatatgagatagagggtctgctaagccagctgctgaaggaagactttatttcccaggggaaattctagcacatctggggcactgtggtcctcacacttggtttggattctcttcctgatgacggacgtctgctttctggcaagggtaagagtaataatctgtggttaatgtctaatgaaaaaatgctggcatgttgaaacagaaacaaagcctctctcttttttttaaaaaaaaaaacatacagttttatgcaaattaagtttgaacatagaacagatcgtgaaagaattatcaaagtattgctctgggtggtatttggagtaataatctttaaaaatcaattttaaggtttaccacttttaaaccttttattcttgcttagctaaatcgtcatgaaagcaggacttcatacatctccctgatgacaaaactaatgtttggactgtttgagttgaacattctaatatttaaaaattctatgcatagaattgaacaatatgattaaacgcaggaaggggactgtgaggtggcaagatataacagatgatagcggttgtactgccatctttgttcaggtccttatttgcctgtaaagctacggcagtcttctctctgattatactatcatttttgaactttctatccaaagaaatcattactaaatgagtgtatactaaatagttgttcactctttagcaatcatacctacaatgaaggcactcaaaccactgaacaattggaatccatcgagggctagggaaataacatctttgtagcctcttggaactgttaggtaaagaaatcaaattctttgacagtgattcaagctctaggtcactacagattcaaatgtgagtatgcactgggtttctatctttaaaccctttcacatatattcttcttccttcctcatggaaagtttgattgactgataatatacacccagctcatgaattagaatgtcatttgaaatagaattagagaggtgatttccatttggataattccagctgagaaggtataaattccaagcagaaggaataataattgtatgcaaaaaggtatagtagggagtagccagggcaatgcgttgacttttcctgcttgaccagaaactttgatacgccaaaataacacagttgggaatactagacagaacactagacaggggtcagtaacaaaggcactaaagctgtgggacttgctacttggttaccttaggctaaggcagattaagcacttttctggtccttaattcctatcctgtatataagggagatgaattggaaaatctttaaggttcttctcagtcacaaaattctgtgctttactatgccccgtcatcaactcaaggaaaagaagtaagcagctttaggttttctgatggcaggaaaaagaaaatcatcccaagagggttatatgactagcattgagaagtcctgtggagcatgctgcatcttgctcttctttattgccatatggaaggcaaggcctcttaccacatatctcactccatttatagctcctgggcaactatttttcttttgatagctgatggaaggtctaagaattaaaggtactgctggccaaagaaggcagcccaaagacaacaatgtcaggaactcagaggttcagtagaactcctggggaaggttggtcttgatattaaaaggtgaatcagaaagatatatactggtcaaattcatgtttgagaatgagcacatattcttagtcaaatgtttgctactattcacatgcaccagaaacagtgtcagaggagcctagttaaggtctaccttgttattgttgcatgacaatgcaggccagggaaggccatatcttgtcattattttaacagaaataataggatttttttgccacctattgttggcaataattttaaaaacacaacaaccacaacaatacaaaggcctactcgaggtctattcagtactagcctgaactgggtaagaaggttctgcaggatggaagtaaaatatgtaatataattttagtaggctaaaagagggttagtactcaatgtggtaagaacatgtagcatgtaggaaaaggggaaaacctcaaaaaggtgtcattttggctgaattttacagaattggttataaaacaattaaatctattaagtaatatgctgttacagaaaatggaattatataaattgcatgtagacaactttaaatttggatgctaatacaccagagaagcaccttgagtcgcaggagacagaacctaagtagtggattcaggtttgcttgtagtttcatatatttagagaaatgaaatagaattataaagacaactttagagcctatgtaatcctgcacttaattttcagttaacaatactgatacttaacattgatattgcaatacctacttattaggaactgttctagacaacttccctttattcaggctaatatcaaatcaaagtgcaggtctagaagccactgaccaaatctttgacctgggaaactcgagggcctctgccttgtgaaaaatggaacaaaaactcaaccggcttcagagggttgttgggagggaatggaagaagagtcatattttatttttcatgctgtaatacaactttgattctttggaatgaatgcaaccaaagccgaatgatattttcacctttgcttaagcatcagggttattgacaccgttaactaaaatggaagcgcagcctccagtataaaagaccaagggttctattctagccactttaagtacaagatgtccacttaaccaatcatagcctttttgagcaactgctgcctagattctcattcatcaaagtaaaatataccaaaaagcgagcagcattagttagggtaagcattagtaaaaacaagaatcactaagtaaaatactgccttaatgcaggctaaagaaatgttagtgtttttaaaaacagcaacatattttctttatccactgtatcattgatgggcatttgggttggttccaagtcttcgctatgtaaatagtgctgcaataaacatacgtgtgcatgtgtctttatagtaaaatgatttataatcctttgggtatatacccagtaataggattgctgggtcaaatggtatttctggttctagatccttgaggaatcaccacactgtcttccacaatatacaccatggaatactatgcagccataaaaaatcgagtttatgtgcttttcagggacatggatgaagctggaagccatcattctcagcaaactaacacaggaacagaaaacaaaacaccacattctcactcataaatgggagttgaacaacaagaacacatggacacagggagggaaacatcatcacacaccggggcctgttgggggttggggggtcagagggctgagagcattaggacaaatatctaatgcatgcagggcttaaaacctagatgatgggttgataggtgcagcaaaccaccatgggacatatatacctatgtaacaaacctgcacgttcagctcatgtatcccagaacttaaagcaaatttttttttaaaaagagcaacacaatatgcacttgtttatttctttgtttttgttttaacaatgctctttaaagttagtttaaaaataacagtagcctgctatttttaatgttaacattaacagaaaattaaagcttaaaggagatttaaagatcatttagttcaaatcccatattttagagatggacacttatccttcaggagagcaagtggcttgataaaggtgacacagatggctgatggaatgaatacatgagactacttttaaacacttagcaatgctgaggtgttttaagatttgatatgaagctttgttttgcaggaatacacaatgcaatttcccaaggtcagcttgagattctgtttccataaatttcataaataaatatggaacccataatgttgcagagtatggattacggccttccctcttcataaatttcatgatttttaatcacttattttatatagatgtgtatatataagcttatatatatgtatatatatcagtgttacatctatataatgttgattacacacaggcaaattacttaggtacaaaggcagcatttttcactcattaaatatttgtgagaaaatatttgagataaaggagaaaaaaatcaagtatttagagaggaatgtgtactgaacaagaaagtgtctctggcagataaatattttagccatggaaccgacagcatgtctaattcgtgaagcaaatattaatcaggctctgaccatgcatgcagctctgtgcttagcacatagtaagttttcaacagatgaaatgcaagatcacatagcaatggggaagagggactagaatgactcttcagtcccccaccactgagtataaattctgcaccccaccaattggcaagtgttcaagactttggaacttagagaggtaaagggagaagcaatgggaataggaggcagagaaggggtaaaaggaactagaggaaaaggcaaataagcccaagtgtgtttgtgctcacttcagaaagtcagagtcacagaaaagcattttttaaaatgcactaatattctgccttccctttatttaaaatatggaacattcatgtgtcctcaggcagagaaatcatttaaaatatgttggaacaaaaatgattaaattagctttattcttcaatcatataatttacaagagaatatcattcaaaagaaaatttctaaacttggctgatatgaagaattggtttcagttgtagagattataactaataagtgaaatggaaatgttcctaaatttttttcagccaagatatcatggtttttggaacatgtgttttccaagagtttttagaaagcttaatgatatctctgattgcaaagttttagcatttggcattctcattcagccaaaggctgtgcaaaactttatgtggctaaataactctccagaaaggatgcacctaagacacttaatggctgagtaaattcagatgtgctcatatagcaaaagcctactccaaaaaataaactcaggtgggactagggcaacattttcaaaataattgtcgtatttgtggtaagagagaaatattgaattgcattctcccctaacaaagcaatcaatagatttaaaacctccgtagttgtttctatccatgtagctaaaaaatacttcggttctgagattcacagactgtgaaacaagtggagggacaatcttgacttgagatgggaaaagaatactaactcagcccccattccaggtatcctttaaggaatccttctcattttaatcacattacttaaatgctactatctaatcatgtgactcataaaagtcacgattcaatgtcatgttttccctatactagatagttctgagtcttggttctgttatcatatatcatagttactgatcttctgggcaacctgttgtgagtggaacagagaatatatttgaagaatatttgactagaccctcctttcttgttgttacataaaaatggtttctccttaagtcacaaatctattctgcatgttaaatatttacaaagtactttaaaattcttcctgaatgctaatacaaagatagcaatctatgttcatttaaataagcagaaatgtttgccctcccaaattaagggcctctgagtttaattcaaatcaatttgatgacttgagagaaaaaaaaaaaggtggggacctactaagtacaagatcctgtgccagacatggagataaaataaactttccaggactagacaatccgtcagaaattactacatttcacattatttaattcacaccatttccttctgggcttaaaaggtaaattataagatgcaaaatactcacctttttagcattaagtttttacagtgctccttaacatccaacatttaactagttacataaagatgcagtgttttctatatattaacatattatttcacattttgttcattaggcttttgaaagtattttagtatgaaggttccatttattgtatccaaaaataaaaatagcatcaaagtctttttgcaactccccaaacacagttagtgaataatgatcgtatgctaaaaaatgtaaaatgcaatttgtgccgtgccccatttactacaaaatcactacgaacaatgcattttgtacagtatattgctccagggaaactggatcggcatcaggaatgaataaagaacactgcatttgaaatcagctaattctgcttcagcgcttttaaaaactatttgttatgatattacttcctgtcaagcacataatgtgatattttcctcaataaaactaaacagttgctataatttcagcttccctcattttccactttttaaacactaaatatttaaacaatgcagacctggaagtctctagccagtcatctgatccatgcatctccttgcctaaggtatagtaactatccatacgggggcctgttatgtcacactgacatacttagtggcagctgtcaaggtccttacctgcccacaggccaggcccattcctctttctcccatgccatgtggacatgataaatttaactccagggcatctgctccagaatcctttaaacaagaaaggaaaatgaaagaaaaggcaaagctttatttatataccaataggctttcaccgttgataacacaagtcacatttgtcaagtgttaactattctgttttctgcatcacagctatcttgtgaggtatagtctctctctctcaaattaaggtctatataacaaccaccaccacaacaacaatcacacaccaaatatttactcagtgctcataaggggccactcactgctctatatgttttatatttgttacctctaattctcataatctttgtattattatgctaccaagtttacaggcatgtgaactgaagcatagggaggttaaatgacaagcttagttattaggtgacacagtagagattgtaactcagatctgtttgacatcacatttattccttcctaaatagcttctatttttatggacacaaatcttactaattatggataactgatgctgggattaggcatacaaacaaaaatgtagtaggctagctagaatgaataagcaaaatgtaaaatgtttttaacagaaaatcaacattatcatacttaaaaacagtttgtctaagaaataggaagtattgatagttttgtcttaattacttaataggaatccttcttatttaaatcattaattccttgatatacaaatagatcttgtataaatgaacaacataattcattctaagtattcttggaatactttgagaatcttagaattcgtgggaagtcttctgtaaagaacatgaagaataaacaaaacacttttaaaagttattataggccgggcacagtggctcacgcctgtaatcccagcactttgggaggccaaggcaggcagatcatgaggtcaggagatcgagatcatcctggctaacacagtgaaactccgtctctactaaaaatacaaaaattagccgggcatggtggtgggcgcctgtagtcccagctactcaggaggctgaggcaggagaatggcgtgaacccaggaggcgcagcttgcagtaagctgagatcgcaccactgcactccagcctgggaaagagcaagactccgtctcagaaaaaaaaaaaaaaaaaaaaaaaaaaaaaaagttattatagtggccgggtgcagtggctcacaactgtaatcctagcacggtgggaggattgcctgagcttaggatttcaagaccagccaggcaacacagtgaaaccccatctctaccaaaatacaaaagattagctgggtgtggcggcctgtgcctgtaatcccagctacttgggaagctgaggcaggagaatcgcttgaacctgggaggcggaggtggcagtgagctgagaccatgccactgcactccagcctgggtgacacagcgagactccagttccaaaaaaaaaaaaaaaaaaagttattacagtaattttagagatggaggaataaactagctgattcaaattttatattcttttacctaacttctataatttttccagtgccgcggtttatttttcggtaaggccaactagaagcttgaattggttataagagtattttaacaggtttatcacatgcaaaggcttaaaaaatagttcactactttctaagtacaccagacctttctttagggcaacagttgtttcttctttctctttccttcctaattgtttaagattttagcctattttttcctgctttgtgaattttaagtaggacctcaacaaatttaagaactccagctagtcattaatcggttgatagtcttgcctatctttattcattagtgagtctgctttttcttctgcacatttgttaaagtccatttgatcattgagcctgtttttaacatggtttccttatggttttgctttcctaatccgattttaaaggtcttcatgttatttgagagttgctgaaaaccatgctgctctttccttgatggtttggtagtgagcatggatgagcacagcctgctgaaccctgagttctaatcttacgcctgtagctaaggaattggggatgatttggacaagtcagtcaatcttctttgtctccagctgctcaagtgtcaactgtggataatatgacctgtctcaaaaccatgtcatgcggtaattaccagcttagtgaaaagattgtatagtgcaagtatacacttataacatgtttcttattatttcctggttacttcaaatatttcctgtagacttctctatttaactgaaatgcagcaattaacagcaaatcaattcaacatcattttggattaaataaggctttgcataataattttatacatatttacattatgcatatttcatttcaaacttacacctagctaccatattacacaataatagcttacattaattgagcatttacaatatgccagatactttactatgtcctttgtatgttttatcttactttatcttcacagcaactctaagaggtaggatatatcatcatttctactttacaattgataaaactgagacataaagagttcaagtgatttatccaacatcccacagcttatagctgatagtagggtcttgaactcaagcattttgagtccaggacctgcatttatacccactattataatttactacaaatcacttattttatggctggagttgtcatagtgtgttacgaaaaacataacagctcaatatccttacagcttccaagcttgaagtaaaaattaaaatattttaaaatcacctgttcaatataaaattttttcactgactaattattataatttccccaacattatacacatatacaaatgcccactcaccaaacacacctggcaaggcctttgaaatgtgtatccaagcctcaaaaacagacaatgctgttcaaggtgacaccatgagaacaggaacattcatgtggcctctgcttgaaaattcctgtctcaggatgcacaccaccttaaaaggcagttaattccatttccaagcaactctaaccattcaaaaagccttaattgctgaattagcatgaaatgttaaattaactgaaattgggcatgcattctgattcttgttagtcacaagctttttagtttagtcacttacccagagtttattccacctcacctaaatggttataaaatgaaatatcctagtgatggcagtgacataggaaatacactgttactaatttcctacattatctatttatcatccatctatacacagtagaaagagagagtttgtgtgtgtgtgtgtgtgtgtgtatatatatatatatggtgtggactctgagccaaactataggtttgaatcccacttttactccatcctagctgtgtgaacttgaacacactctttcactacttttggccttagtttcctcaaaaaaagaaaaaaaaaaggaaaacatcaagtcagagaagctagaactccaaaaaatattaaaaattaaaaataaaaatatatttaaaaagtggaactaagtcacagagttgttgttgtaaggcataaataaatttgatatttgcacagaagagttctagggagatgtatttttaaatgtttccaaggctaacacaggaaatgaaaggtgccaaaaaagaaagtttattttttacagttttaagtaaacagaaaagaaaaataagagctttaacatatataagagtttaaagaggagtgataaaaaataaaagtaaatgacttctggaatgtagtaaatactataaaggtgtatactatctatctaaatactttatctatctacctatcaatcatctatctatctaaatacttatctatccatccaaatagacctctgacttgtccttcctctgccttgatatgaaaatgatttaagataactcacctggtcctacattgtctatacctcaggagggaaaggaaaactatcctgagaaattcttggaatatgacagtggtatagtttttaaaattctctgaaccactttataaaaacacccagagaaactaaggtggcaaaaccacaaactcttgtgcaacatatacaatgaaatcatgcacaaagcatttctcctctcttctccttctttccttacctcttcctttctttcccttaccttcctgatcaatacagctctaaagtcactggtcaggcagggcaagacaggtgagcacgagcatttgaggagccatgagggcccagtgtgggatgtcacagcctaagcggagcagagccagaaggatgtctacatggccagtggcatggtgtggtatatcacggtccaagtgggaagggaagacgtccgtgggtgataaggtctggcaaaggacatcagagctcaagtagggtgagaacagtgtactgtactggggcatgaaaggcacagttattggattccctcttaacttcttctgttaaatgaatacatggggtcagatgttgactttccaagtagcaatgctatcctctagtctcaactattcaaaactggagttaaagttctctgggatcttaaacctctctgagatagacctgggacaggtaaaacactcttggcttgggccccactggatgtaaagtcagttactatctctcatctccagctgcgtgtctatctcctgtgattccattctgtcctgttactgtccctgttcagagacttaacatccaactggtcctacatatctctgtaatgtgcctctgtttgatttttacctcaaactatttgggatttctaactctcacagctatttaattcatgacatattgctgtccagattcaggtaaagaaactgataggaaactggcttgttagtgttttagtgttttattttggccccgccaggaatagtgtggtcacttggttttaatgcctatgcctttctgctggaccttccttgtctcttcctaccaaaggtggtcagaaccttggcaatctctcatcaggtacctgacttaaaatcatcatcactggattttaaacacttcaagttcatgggtgccaaataaaataccattcttcccatttattctgtaatggcttcctttttgtttgtcacatggcaatactcgaactgtatacttcttttttacttcattcaacaaatatctgctggtaaagaaagccttgtgcttggaattgaggattaagcagtgaaccatgcaagggtctcgacccccacggaacttgctttctaacaagcaggacagaggaactattagtagtggccaatgacacaactgttaatcaccactttattatatgctacagaggaaaaacacagacagaggtagatccagattttggggagcctaatgcttaaataatttggaaaaccctctttaaggaaaaaacaataatcaaacattgtaaacacagagttaggtacagggacttgcaagtggcccatgcaagtaaatgccctgaagcttaagcttcattaactatctggtcaactggcctctgaagacagggtcttacagaataggacagggaggtttaaactacgtagccagaggctcaggactgaggaagagagaacattgcaggccaagggaacaggaaaagctctgagttgggaacgtgttggaggaggaaaagaaggcagcgggatctggaatgcagaaaacagacccacagtgacaatggggagaggcaggcagggcaggggccaagtagcacttaatggtcaagttaagggttctgaaattaggaaagatggaaagaatttggattggttgagagcaagaagattagtggagctattgtagttaaacttggtaatgatgcattttggaccacagccaattatacgcttcctcaaatttgatggccctacttgtcacccaggaattttgccactagttaaaggggagccccagtcccttttgctatcttcacatctcctatagtaactgtccgctctcacagactccctccagatgagagtgggttgtgtcacaacctccactgagcctgtcaaagtgagagctccaggagcaccagtgcccaggccccatcaggaggctctggccttcccctacaattctgggtttagaagaagcatcacaccccatgctagcaaatctagcttccctagcagctgccctgaaggggcaggacatgcaactcaaaagttcagaggaaaggagagccctacggagtgaaatggggccagtgagagacaggagactgaaggagccagtagactcattccttccacttcctttcctagaaagtgatgagagaatgggtgattctatcatcttgtgaaatgatgtgctattccctgtcccatatgactgagcaattggctccatttccttgtgaagttgtggccagctctggaatgcaccatattgcacttgttttcccttcttcccatctcatttttcttttctcctcagtctttctgctctgagattgtatacttcaataaagctttttcacattaacttttactcgggctctattttcaaggctgattacaaattacaaaagaaattgattcaagatcgactacactggattaaagatccatttacaagtgaatattgtgaaccttcagaaatggctcagtttggcatatatctgattgctccctattactcatctttgttttggctagccagggactttatacatagtaggtgtttcataaatcttcttttgcatagaattggagtagactaccaaggttccagaaaagcaagagagcctgtgatcaggtacctggatcaagaaaactaactagattctaacaatgctactaatttgacacaagcagtagaaacttctttgtggtgctcaaaaacatgacaaattcaaaccaggttgaagaatatagaacatgaaatgcatgtgcattctaaggctctactgctccatatgtgtcatttctgtttcagatgaagtagtaaaaagctgatagcaggtttcctcagctctccattgtgtaattcaagaattaatctgccataaagacagttttataaacttaaggtttagtatacatcatcatcacatcacagcattagctaaacttgaaacagttggcatgctagagtgttggtgtggtgtctctgatttcttacatccctatatcaccaccccaaaagaaatgtatatgttaggtagtacagtaattttgacttgaatatgtttttgttggtttgttttaacgtgggtttttccattgtaaggaaatctgttttaaccggttttgaagcatattcataaaaccaaaaccaaatactgattctacaaaacgttattgggtgcctaccatatgagctgtgatgaaatcatgctgcttaatgctaccctcctagaagctgtgaaggcctgcgggatacttccttcatatgatatctcctgggctagtccagacttaagattatagtgaatatttttattttttaattgacattatcataacctcttgttatgtagactgctctcctatggagagattttgcagactgttttgattgaacaaaaggcataccttttcctcccttctttcttttttttctttcttcctttctttttatttatgtttttgctacagagtaattagaaggtgatattaaataaaactgaaattaaagaaaaatatgaaatgtgaaaaatatctttaggttagctagtttgcttataattaaaggcttttgacttataaaaagtaatgttgtctatttaaaaattaatgtctaatattgaaaaaaataattttgaaaagtattttgttcttacagaaaggcagagaagcaagcggcatgataaagccattcatcatagtcagcttaaaattggcaaagctcatgccaagcatgggctctgtggaagatttcatggtcaattaggtaaatacatgtatcaaatgaacccagcatggaagatcacgaggccaattactgatcatgtttaatttcacccctctaagtcccagtagtaatttttcccttctcagttttaaaatatccaaataaaatgtataatcaacatttttgaacactacagacagctttgcaatattttataatgtagcgtcaattagttcattggtatagttagatttagtcttctacattactgagaggttttcaaggaaccccagctaagactctccagactattttccatgacagcatgatggacataagtgtataattttaagtatgtatttttctatttgaaatacaaatttaaggcacatggttacttgtttgcatttgtgcaggattcaatttatattatggaaaacctgctgactagtgttccattcaggagcattctgtcccgctcttttatgcatgtctgtattcaaactagaatagtattaaatgaaccttttatactttaaatattcaagagttttatattcaaaatttcttctcttactgtcaaactagtttgcctaaaggcaaggtaagatcaagttagactctcaaaggtagaattaaattttatcatggcatccatcataatatacagtttgcttaacatgcaaataaagagtgtatggattcagagaataaaggatttttaggtagtgtgtgaaatccaagggaccgcttttatagaataaattccttttaaatttacatttccatcattttaatgaaaacacagggtaaacaaattataatagaaatgttttaagttacattttcaattcagttttacttctactgtattatttctcatggcagctctttatttaaaactaataaaaataggagagaagaaataaaataaatatatactaaagtaaccattacctcagacttcttggcaagttccgtccagtcatttttattgtaactgcacataatgctagcaatcacaatctttaaaaagaaaaacaaaagaatataagttcaagtagttatccagttgtacacaaagatatattaatatttacataaatttataatggtaaactatattataaaattagttttcaaactgtgaaaaaataaatcattagaaaatagcagggtaagatagcaaaacactggatgacatttggggctttggaattacattaggagattttctcatttactatctgtgaacacttgggcaagttacttaacttttctgatcctcagcattctctttttcaaaatagagaggattttactggctttgccatcctctgaaagtagcaatgtaaatacatgcatgtacgtgaagggattgtctaattatacaatgccattaaaatgctgtttgtaattactggtacagtgaaaaggttttaagtgatggaaaagaaaaaaaatagtgtctctttcaaacataactcactatagtacacataataatatcttaaatattcatagtgcattatagttttaaattttattatgtattgattatttaactacattattacagaaatcccataatggagactgtatagagtagtaattaccaatgcctcctctgaaactaggatgtccaggttagaaccctgactctgtcacttacttgtggccctgagcaaagtatttagtttcctgattggtaaaatatgaataatcgtgccacttattaagaaaagtaataacagaaattggccaggcgtggtggctcacgcttgtaatcccaatactttgggaggcagaggcgggtggatcacttgaggtcaggagttcgagaccaacctggccaacattgtaaaaccccatctctactaaaaatacaaaaattagccaggtgtggtggcgtgtgcctgtaattccagctactcgggaggcagagacaggagaattgcttgaaccaggaggtggaagttgcagtgagccaagattgcaccactgcactccagcctgggcaacagagcgagactctgtctcaaaaaaaaaaaaagaaaaaaagaaaaaaagaaaagaaaagtaataaaagaaattgctaagacttacatagctcttacagtgtgcttggcactgtttcaatggtttttactttattaacttatttaatcattcccaatgttattctccccactttatagatgaagacgccaaggcaatgacacctgacagtcatatagctgataaggaacagcgccaggacccagagccaggcagtgtgactgagcaagagtctgtgcttttaacgactaggttttgctagcccaaagcacatacttgatacacgtaagtaattatttcctaccattatcatttaaagactatgagattgaggctgggtgcagtagctcacgcctgtaatcccagcactttgggaggccaaagcaggaagatcgcttgagcccagaaattcatgaccaacctgggaaacagagcaataccttgcctccacaaaaaaatagaaaaattagctgggtgtggtgccctgcccctgtagtcccagccactcaggaagctgagatgggaggatcacttgaatccaggtgttcaaggttacagggaggtatgattgcattactgcactccggcctgggcaacagagcgagattctatctccataaaataaaaaaataaagactaagagattgagacacaaagagtttgtgccaagcttaaagttgcagagtctagtggtaagagtcctctaaaagccactgtgctctcactacatagagcttttttatttactttgagaaaaaaaaaaaaaaagatatgctgtaaaagtcagataaacgttttcatcaggagaatagaaagttgtgaccatattggagagagttctaaaaaccagggaaagaagcatgtctttaaagttttttttttctttttctttctggatagactataaacaccatgaaagctggagctgctctgcattagtcatcatctatctacagtaactagcatggtatttggcacgtatcaaagactgaaagaataaatgaatgaggtcaccagaggtttaggagcaaggggttgcattatcagctaacccttttaagaagattaagtagaaatggataccataagttagagaagtgaaaaataaacaattgaaaactgctggcgattatatgagtaagagtgaagagtgattagggctgatgaaggtatctgtcttggtgatgaaaaaataatcagatattaaaatacacaggactagtcaactagagaagcaattaaaaagaaggaagcaaaagatctgagactctgaatcaaagccactgagaaattcgcagaccattagtcacaaaaaggttgaacaacgttccgaaatatggaagccagaagaaacagcaattttgaatagattccttagagagaggaacaaagagaagaaagtaaaagtagatgatggatagagaaggaaaattaagcatgccaaattattgttcattgagtttaggattcaatttttttcgtctagtgaaactacagcttttcagaattggggagaaaaatgtaagaatgcttgttccatggccttttccctaggggctaaaaaagtgagaagtcatactccaagcttcatttgcaagtataaaaggggcaccatgtaattacacagcttcagttagagatgctttccgccctttccaagtgatctaagagctcagggatgctatgccctattctccagttagaaaaaagatcagggagaactatcaaagagggcaccagatcttccaggactagacctaatacctcttggtgtaggcattccttgcaaaaaaaaaaaaaaaaaaaaaaaaaaaaaaaaaaaaaagagagagagagattaaggaccttatttgaaaggaaaaatcaactggggaatgggcagagccctgaggcttattgctagaacttcaagggcagagacagatacagagatacagactgaagaagaagaaaaaattagctattagatactagttaccctgtggcgaaactgataagcaatatgcatagatttttagaaaatttttttcttaaaaaaaaaaaaacaaaataaaacaataacaacaacaaccacaaaacccccacctcctaacataacaaaataatcccccaattcacattctcatgcaactatgaagtggctgctcaatcagcacagtcacagcatgtgcacctccctctccagctcccctctcagggttccacagaggacaagaaaaacctttctcgtgggctgaatctagccaggcagatgggttgaccacagaaatccacagcagggaagcaaggtttagcagccttgacagtaggataagatatatcctctcaagtagggactaacactgtttctctcttttacatggcaattttaattttaacagagctatttttgcttcaaatttatattgactgtgccaggttggttaattgttcaccctgtaggttgctgagaagcatgaggcactacaattggacttgatgaagggaaataaatatcatacagagagttgttcaggacattgcgagaatcatgccactgaatgctggtggggcagcctctgactggggaggggtgaccacagatgggagagatacattatggtaagcagtggtttccattgtatgctctgagcagccaagcactaccctgttctcctttccctatccattgaaagcagactctatcttcttgcccagaaagatgagaaagtatccccacctgcactgatcataggaattaggtactctgcttctatcaaaatccctcagtggaactgggaaagttaaaacttttttttttttctccttggtcactaaactggaatgaagtttattcagagctgctgttgatcactgattcctcatttaaccactttccaatcccaaagcttactacactgggaaaaaataaaacagagacaggagaaagtagacaaacacacaggatggagagagatcccctttgcagccacttttaaggctgggtgcctcactaacatatctgcatatttaaactaataaataccacactttggcttaaggaaattctatttttacattcttgtttctatgatttaacagtcttgacaattactacatgcaaaactaaagttgtcatgttttgaagaaattttcaaagcaattttttaaatcaattaaatttcaggaaaaatgactttatatttattttaaaaatgtgaaatggtctaaggattctaaatatccttatctaaagccagaggatggtttgtgaaaatatgtggtagcattctatttctgagaaataaagatgaccaaaaaataattttactttttattaaaagagaaagcaatttttaaaagagtcaggctaaaagacattaacagtaaaaggacactggacataatttaatatttatttgataattaggaagcccttcagtattttgctgtactccgtttttaatcaagcaggagggaacagattttttttcctaagaaaaaaaaccagaatgatggatattttatatcgtgaaacatcatgcaatgttattagaaataaatacccaatgaaatatatttttaaataaaagcaacatttttctatatcaatatttcacttaatttatgccatttctagtgctcaatttttatggctcatattttaaaacattattgaatgaagagatagtgaaacccagatgctacacagtatttgaactttgtcttcccccatcctacagtttatgttacacagtctggtgggagattcaatgtcacctaattgattaataagcaaattgagcatctaatataagaggaattaaatggcacacaaaaaggagcttgagacattgacttagcattttcgtgtattcaacttctaaccaatatttcttgagctccactatatgccaacagctgttctaactcagaagtgatgaacaagacagaaaaagtccctgccctcctgaagcttacattttagggaggaaaatgtcataatgagttaaaaaaagatactttaattggaccatttccagttccaattgttagacctatttataatattatttttaggaaggtagtaatagaggaggagagcatgacagagaatcaccagaatacataaatgcatgtcagacacatggtcagtaaaaagctccctgagttgaaaactgagagatgagatggcacctcacattaaataaaatgtggaagtgagtaaaagcagccaggtatgtagaagtaactgcaggtgcaaagactgaggtgggaatgagcatggtatgttcaaggggaaaaaagaaggcttttgtggttgtagattcatgagaggacaggaatagtatgaaagaaaatgagagaagcaggcaatagccagatctctgggagctctgaaccctgtgggagattgggttttattgttggtgtaatgggaggccgcagaaaggtttaaaggagggtgataaaataatctgatgtacattttcaaaagatgcttgtgactatagggaataggataagtgggttaagggtgaaagcaaggagtctgattatgttgaaataatgtggctttcataatatccacggagatacagagaagtggatagttctgaggttctagttggtgaatgcttagattcagagagacatagagaaaagtagaaattaagaatgatcctagatatttggcttgaactactgaactgtggaatgtagacaatttactgagatagaataaagcctaatgaagaaagtattgaagaggtccaattttaatattttatatttagtatgtctagtaagcatagcattagtgaagacatcaattgtgccactggatatatgagtggagaattcactaaagaggtcaaggataaaggtgcaagttttagagacttcaaaataaaatggtatttgaagtcaccaggctagatgacttcacaaaaggaagaaaataatatagagaaaaagaaaggccctaggactgacctgggggcacaagagagtgtgatgtcgtgccaagagaaggaagtgttccaaaaagtaaggaacaatcaaccgtgatgaatgcttctgaaagtctgtgtcaaagagtagaaacgtgtccactggatttgaagagacaaaaaccattcgtaacctttaaaacaggggtttcagggaagtgacaggacaaaagtcaggctagaatgaattgagtgaatagaatatgaagaagtagaggcaatacatgaatctctctaaaggttttcttgggctagctaaaagacaaatgaaggcagcctgtacaagatcacgggaggactaatgatgttttcttaatggactatatttgagtatgtttttacactagtgaaaatgatttgggaaagagaaagaagctcttgagaagggaagaggggatgatgaatcgagagtacaagtggagaaagtgggctttaagagaggcagaggcattgtttgtatctaacaggatagaagacgagtagagagagaaacaaataagtatggatgcatttaggtttctaaattcgatgtggaaaaagtaaaatcattcttcttggtgtctacattttctttatgaactagggtgtaaggtctcttactgagagtaaagagaactagttatgggtttgtgactatgaggaagagataaaatgtgaaatagtctctaaaaatgggccaagcatggtggctcatatgcctgtaatcccagctactcaggaggctgaggcaggagaatggcttgagcccaggagttttgaggcttcagtgagccatgattgtacctctgcactacagcctgggcgacagaatgagattttgtctttgaaaaaaaaaaaaaacgaagaaagaaaagaaagggaaagcaaatttactagaacatggtatgattatgaggtcaaaaaggcagatatttaatcagtgttgataatatttatgaaaaatatgattagtaaaaatcaaaggacaagttgatttacaaagttggaacacagattacagtcccctttatattactgaaaacatgaaattgggttttatagattgtcttagagttgagacccatcttatcaagatgctttttagtgcttaagtcattaaaatttgatatgctcctgaaaagccattcttttagtgaattctgcttcgtagaaaatacttttaaattggagtatttaatagttttgactttcattttgactaattaatacaacttaagaaaatgtatacactttttgtaaacatctaatttctatgagacattaacattttgaagcatataaaatgcaaagtatgataatttactaatcaaattttgcatatttctttctctctaaaaggtatctcaaaggtgaaaaacaatgtgcagatgcttatttggcaaaaaaaaaaaaagtagtgctatatggcttccattgtcatcctttgaaattttaaataaaagaatcaaatttaatggtcaactttttttgttttgacaattccatttccttagggaataaataaaattattttattaagtagcttttaaaaactgaatttcattaaagtttacacattaaaaattaaggtgaagaacaacataaaacttgcaatggcttacaataacatgcaggctgtcttgtcaaattcccattgacttcaggtctatgctttttaaaacacattgacaatgctattttggtattctgtaaccatactgtgaactacataggaaatccagtcaacaattcagcttcaagacaatctaaattttttagtagggaaaaactgcaaagtgacgggggtgaacaactataaattacaagcagccaagttaggttttgtcaaacaattcaacaaaatcattcctaagactactgggattacattgatgaggaaaaacagcatgagacatttgattttcaaagacatttaaacaaagaaaataagtttattaaatgttaattaaccatacaacattcaaattttagatgtcctttatgccttagttcaaatttagtgaaagtgagattggtgcaatattcctgaaatatatacattgactataagacatttaaggtgaaataataagcttttctaattttatttgttcattgcttacttaatggtcataaatgagactagtatgcttacaagttgtcttttaaaattatttaaaaattcatcattttttggtttattttggggctgacaaatgtcttatttacacaactatttcaaatatagaaaagtaacatttaaacaatatacaagagtttctataaaaaatcagagatgttttccaacacaacaggaaacaaccactgtaccactctaggagctacagtaacttgctttttcctccccttttgatcactccataatatatttttatttagtttctgtccccaatatgcttaggaactgatctccccaaggttaacagtgacctcaccaaatatattatatacttttcagcccagatctgtactaaactctcttcagcatttaagactactaaccacctccagtttcttgaacccctcttctaactgagctttggagataccacttacttttcctctttttttttttttttttggtgttctttttctacctctgtcaatttctcacatgttgatgctcccagagtccactcacagtcctcttttagtctcatttcacatgcattcactagacatcatattcgcaatgactgtaaataatatctattaatacatgcagaaaatctcgaaagtgtatacctctaaactgcatctttttcctaagtgcaagaattgcatatacgactacccgttagcacttaatttccatttgtccaaaaccaaacttaaatttctccactctaaatttgcttatttatccacactatatatgcttttgtttcactcttttgtcccagatcagaaaactaggaatacctatctttgtcgcccacatccagtgattaaccaagtacttggctgagcattgaaattacctagagagttaaaaaataataataattccaaggattctgtgttaccttgtatggagtgaggtgcaggcatcagagtttttcaagtctctctaggtggtcctaaagtacagggaagtttgagaagtactgctctagtttattttccaaatatctccaggttcctcattgtgactacattaagatcctcaccatttcttccctggattactgcagaagattccttattagttgccccatatctgatttcagccaatactatctgccaaagtattctaaagagacaaacctcctcatatcacactttggcttcaaatccaatttcaggataaaataataggctatacaagaccatagtgcaacttttgctttgaccacactgaattgctttgctttctgagtgtaatttgcatgctgaattctcttgatcatatgtctgtttcttttgtctaaatgtataaggaatggtcaaagcacatggcataataaaggaaacatgaaaattgatacaaaaaaaataatactaactaagataaaatgagagcaaaagaaagggtaatcatttgtaactgtgtgaatcagggaaggcaccatacaacaggaacacttggccaattatgaaatcacccatggacatttagaggtatacctcgaagatattgcaggtttgattccagatgacagcactaaaactaatatcacaataaagcaagtcacacaaatattttggtttcccagtgcataaaagttatgttttcactacaatcaactgagcctttggtgaatcataatctttttgctaaaggaatgtcttgtcttgatggtgatagctgctgattgatcaggctggttattactgaaagctgtagcattttctttctcactcttttttttccttcttttttttttctagatagggtcttgctccgtcacctatgctggagggcagtggtgggattatagcttaccgtggcatcgaattcctgggtgctgtagcaatttcttaaaataagacaataaagtttgctagattgattgactcctcctttcacaagagatttctctgtagcatgtgatgctgtttcatagcattttatccacagtagaacttctttcaatcctcttaaatctctaaaactcagttactgctttatcaaataggtttatggaatattctaaatcttttgtttttatttcaacaacgttcacagcatcttcaccaggagtagatttcatctcaagcaaccactttctttgctcattcataagaagtaactcctcatctcttcaagttttatcatgagattgcaggaattcagtcacatccttaggctccacttctcattattgttctcttgctatttctctaatctgtagtgacttcctccactgaagtcttgaatccctcacaaggcttgcaatcaatttcttccaaactcctgttaatgcagacatctgacttcctctcatgattcacaaatgttcttaagggcatctagaatggtttgatattctatccagaccactaaaatgttatccagaccactaaaatgttctccataccagcaataaggctgttttctttcttatcatttgtgtgttcactggagtaacatttctaatttccttcaaaaactcttcctttgcattcacactttagctaactatttggaacaagaggtctagtttttgccctatctcagctttcaacatgtctttctcactaatcttaatcatttctagctttggattaaagtgagagacatgcaactcttcctttcacttgaacacttagaggccattgttgagttgttaaatagcctattttcttttttttttaaattattatactttaagttctagggtacatgttcacaacgttcaggtttgttacatatgtatacatgtgccatgttggtgtgctgcacccattaactcgtcatttacattaggtatatctcctaatgctatccctccccactccccccaccccacaacaggccccggtgtgtgatgttccctaccttgtgtccaagtgttctcattgttcagttcccacctatgagtgagaacatgcggtgtttggttttctgtccttgggatagtttgctcagaatgatggtttccagcttcatccatgtccctacaaaggacatggactcatccttttttatggctgcatagtattccatggtgtatatgttccacattttcttaatccagtctatcattgatggacatttgggttggttccaagtctgctattgtgaatagtgccacaataaacatatgtgtgtatgtgtctttatagcagcatgatttataatcctttgggtatatactcagtaatgggatcactgggtcaaatggtatttctagttctagatccttgaggaactgccacactgtcttccacaatggttgaattagtttacagtcccaccaacagtgtaaaagtgttcctatttctccatatcctctccagcacctgttgtttcctgactttttaatgatggccattctaactggtgtgagatggtatctcattgtggttttgatttgcatttctctgatggctggtgacgatgagcatcttttcatgtgtcttttggctgcataaatgtcttcttttgagaagtgtctgttcatatccttcacccactttttgatggggttgtttgattttttcttgtaaatttgtttaagttctttgtagattctggatattagccctttgtcagatgagcagattgtaaaaattttctcccattctgtaggttgcctgttcactctgacggtagtttcttttgctgtgcagaagctctttagtttaattagatcccgtttgtcaattttggtttttgttgccattgcttttcgtgttttagtcatgaagtactttaaatagcctaatttcaatattgtcgcatctcagggaacagggaggcctgaagagactgacggaatgagggatttgcccatgagtgtagcagtcagaacacacacagtatttatcaattaagttttccatattcaacgggtgttcgtggcacctgaaagcacttaacaataatatcaaagatcactaatcacagatcaccataacaggtgtagcaataatgaagaagtttgaaatattgcaagaattaccaaaatatgaacacagaaacatgaagtgagtgtatgctgtttgaaaagtggcaccaatagacttgttagaagcaggattgccacaaaccttcaatttgtaaaaaaagcaatattgcaataaaatgaggtatgtctgtattggaaattgatttcaaaatccaaggaggtagagtactccaggtagagtgagcagcaagatcaaaagcaaaggatggtgtatttaaggaatatgctgtgtttaagaaatctcaggtagttcaatttggctgactttgaaacaaatggttacgtttcataaaaaatgaagcaagatatctaagtaggaatctggtttatgcaggtaagggacaaaacaatggtttctaatcagctaagcatttggatttgaattttcgatcattttctctagtaaattcgtgcttctcatgtagacattgccttctgggatgcctctcctgtgccctattgctcctctgacttcctttggcacccctcttctgagattcctcagtatcctttgcatttttctgctatgacatgtatttgtttatatattttatatatttttaaattatatattttaatatatattgtgcctttctacattctagagacagaataaggacacatagatggtaaaggtaaggggttctagatccttttataatttataaagtacattttatatcaaaaataatttttcattatatttgtttctgtatttacagtttagtacagattttcacatacattatctcatttatcccccacaacaatcttgaatttggagaatcttatactgataataatgaggcatggataatttaaattactttaccagggtcaagttaatcaatagcaaaggcagggattaagctcaggtcttttgattccaagttcctctctactacatcaagactataccatattgatttcctatcctttcaatttacattagagattctagttgattttatgtcttcaaccctctcgtggtagattgtttgaaaaaattgttccctcctggtttccatgccacttcggaaggactcccatcaagtgggggcatttatctacccaacctttgggtgtgcgctgattttgtgacttgttttaatcagtagaacatggtagaggtgatgatgtaccagagttaaaccaaggcttgaaggggcctggtgcttttctgcttactctcttgaaatcctaccaagacgacaagccagcataggttcctgaaggatgacagaccacatgacacacagacaagccatccagctgaggctgacctagattagccagtccctagcccacctggaacttgaccacagatggcataagaccaagtgaggccagaagaaccatgcagcatagcccagttaagcaaattgctaacatcctgaatcaagaactaaattaataattgtttcaatcccaaatttgaggtattttgttatataggaaaagctaactgatgccacttttactaagtaccacaataagaactattacatgctgtgtacttgcatatgctgagtactatgtttagaatttcacatgacttatctctaatccttagaacatcatagcatagaagttattagccccactttacagacaggaaaaaaaaaacttcaagaagttaaataactactcacagttgcatggctaataagagtagatacaaagcttgatctgtttgactataatatttatactttgaatgatttttttgtgctccttatacaacctttatagaaaatgtgttggtttacttttatagatggttaattttattcaatgtgtgtcagttttttattatattcattctcagaggctaaccttatttatatgatcttcgccagtgagttatttcactacagctctgcataccatctaagctagaccagcagatggaactgcctaagaaataataaaattagaggaaagaatgagtgagcaggaaccaatgggatgattcacagcttcctgaccattactgcatgttaagggctgatgatagggtagtattggccctttataatctggctccaaatcaccttgctgctccttatcttgacatatcaaactgaacctcttatatatactgcctaccgcatgccacatgtacttttagatgtccattcttttcctcatattggtccttcttgtagtgccatcctagacgtctgactgtacagctcctacctacttctcaaggtctaactcagagctaacctcaactgtatcatcctcaatgatctcagagacagaatcactgctttctcttaatattcaagtgtgctacaccaaccactactcagttcctgttggactgtgtcagatagatgtttatttatatacttctcttctcttgtcccacttctcttacctcactcaatgtgagaacatgctaattattatccacctttagtttcttatcatttggtgcaggattgcctagcacctaatgtaatttagtaaatgttggtggaaagaaagatggcttattattaataaattttttaaaccttccgtttcatccctatgaagattgtaatacttgctacaagcaaaagtgcatgcaggaaactaccatgactaatatatacgcatgtataaaagatcatgactactactgtgtagactgtagtagttatgtagtcatgtagtagtagtagcagctgtcacatatgtatgacagatatatatatggtatgtcttatatgtatatgaacctatattgacacagcatcatcatacaaatccacagtttacatcagagttcactcttgctgttacacattctatgggtttggacaatgtataatgacacgtatccattgttttagtatcatacagagtattttcactttcctaaaaattttctgtgctccacctattcattcttcctcaccccacccaaccctcctgcctatcactgatttctttactgtcaccatagttttgtcttttccagaatgtcatataattggaatcacacagtatatagctttttcattatggcttctttcagttagtaacatgcattcaagcttcctccatgttttcatggcttgatatttataccattttagcactaaataatatatcactgtctgtatgtaccaaagtttataattcacctactgaaggatattttggttacttcccagtttgggcaattatgaataaagctgctgtaaacatccatgtgcaggtttttgtggaaatataagttttcaactcctttgggttaataccaaggagtagagttgttggatcctatggtaagagtatttgtagttttacaagaaactgccacatgctgtctttttttttttaaattatactttaagttttaggatacatgtgcacaatgtgcaggtttgttacatatgtatacatgtgtccatgttggtgtgttgcacccattaaatcatcatttacattaggtatatctcctaatgctattcctccccactcccccaaccccacaacaggccccggtgtgtgatgttccacaccctgtgtccaagtgttctcattgttcaattcccacctatgagtgagaacatgcggtgtttggatttctgtccttgcgatagtgtgctgagaatgatggtttccagcttcatccatgtccctaaaaatgacaggaactcattattttttatggctgcatagtattgcatggtgtatatgttccatattttcttaatccagtctatcattgttggacatttgggttggttccaagtctttgctattgtgaatagtgccacattaaacatatgtgtgcatgtgtctttatagcagcatgatttatagtcctttgggtatatactcagtaatgggatcactaggtcaaatggtatttctagttctagatccctgaggaatcaccacactgacttcacaatggttgaactagtttacagtcccaccaacagtgtaatagtgttcctgtttctccacatcctctccagcacctgttgtttcctgactttttaatgatggccattctaactggtgtgagatggtatctcattgtggttttgatttgcatttctctgatggccagtgatgatgagcattttttcatttgtctgatggctgcataaatgtcttcttttgagaagtgtctattcatttgctgtgccctctttttgatggggttgtttgtatttttcttgtgaatttgtttgagttctttgtagattctggatattagccctttgtcagatgagtagattgcaaaacttttctcccattctgtaggttgcctgttcactctgatggtagtttcttttgctgtgcagaagctctttagtttaattagatcccatttgtcaattttgtcttttgttgccattgcttttggtgttttagacatgaagtccttgtccatgcctatgtcctgaatggtattgcctaggtttttgtctagggtttttatggttttaggtctaacatgtaagtctttaatcggtcttgaattaatttttgtataaggtgtaaggaaggggtccagtttcagctttctacatatggctagccagttttcccagcaccatgtattaaatagggaatcctttccccattgcttgtttttgtcaggtttgtcaaagatcagatagttgtagatgtgtggcattatttctgagggctctgttctgttccattggtctatatctcttttgtggtaccagtaccatgttgttttggttactgtagcctagtagtatagtttgaagtcaggtagcatgatgcctccagcttcgttcttttggcttaggattgacttggcaatgtgggctcttttttggttccatatgaactttaaagtagtttttttccaattctgtgaagaaagtcattggtagcttgatggggatggcattgaatctataaattaccttgggcagtatggccattttcacgatatttattcttcctgtccatgagcatggaatgttcttccatttgtttgtatcctcttttattatgttgagcagtggtttgtagttctccttgaagaggtccttcacatcccttgtaagttggattcctaggtattttattctctttgaagcaattgtgaatgggagttcactcatgatttggctctctgtttgtctgttattggtgtttaagaatgcttgtgatttttgtacattgattttgtatcctgagactttgttgaagttgcttatcagcttaaggagattttgggctgagatgatggcattttctagatacacgatcatgtcatctgcaaacaaggacaatttgacttactcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttttcataagtagctcttattattttgagatatatcccatcaatacctaatttattgagagtttttagcatgaagggctgttgaattttgtcaaaggccttttctgcatctattgagataatcatgtggtttttgtcattggttctgtttatatgctggattacgtttattcatttgcgtatgttgaaccagccttgcatcccagggatgaagctcacttgatcatggtggataagctttttgatgtgttgctggattcagtttgccagtattttattgaggatttttgcatcgatgttcatcacggatattggtctaaaattatctttttctgttgtgtctctgccagactttggtatcaggatgatgctggcctcattaaatgagttagggaggattccctttttttctgttgattggaatagtttcagaaggaatagtaccagctccttcttgcacctctggtagaattcagctgcgaatccgtctggtcctggactttttttggttggtaagctattaattattgcctcaatttcagagcctgttaatggtctattcagagattcaacttcttcctggtttagtcttgggagggtgtatgtgatgaggaatttatccatttcttctagattttctagtttatttgtgtagaggtgtttatagtattctctgatggtagtttgtatttctgtgggatgggtggtgatacccctttatcattttgtattgtgtctatttgattcttctctcttttcttctttattagtcttgctagtgctctatcaattttgttgagatcacatgctgtcttctaacgtgatcaaatcattttgcattcccaccagcaacgaatgagagctcctttgctccagatcctcatcagaatttggtgttgtcagtgttatgaattttggctattctaatagatgtgtagtggtacctcattgttgttttaatttgcatttccctcctgacatgatgtagagtaccttttcatatgcttatctgctatctgtttatcttctttgatgaggtgtccgttaaagtctttagctcattttttaaaatctggttcgttgttttcttattgttgagttttaagtgttctttgtgtattttggataaccgtactttctccaatgcatcttttacaaatattttctcccagtcggtggcttgtcttctcattctcttgacattatctttcactgagcggaagtttttttttgtttgtttgtttgtttgagacggagtcttgctctgtctcccaggatggagtgcagtggcacaatctctgctcactgcaacctccgcctcccagattcaagcgattctcctgtctcagcctcctgagtagctgggattccaggaggctaccatcatgtccagctaatttttgtatttttagtagagatggggttttgccatgttggccaggctggtttcaaactcctgacctcaggtgatctatctgccttggcctcccaaattgctgggattacaggtgtgagccactgcgcccagccagagttttttattttaatgaaacccagcgtatcaataatttctttcatgaatattgcctttggagttgtatttaaaaacacatgtgtcatcaacatattcaagatcatctaggttttcttctgtgttatcttgtaggaattttatatttttgtgctttacatttagatgtatgatccatttagagttaattttggtgaagggtgtgtctagattaattttttgttgcatgtgaacatgcagttgttccagcaccatttggtaaattactatgtattctccactgaagtgtcttactgctttgtcaaaaatcagttgatttaattatgtgggtctatttctgggatgtcttttttgttcaattgatctatttgtctattctttaaccaatattacactgtcagattactgtagctttatagtaagtcttgaggttaggtagtgtcagtcctctaactttgttcttctccttcaatattgtgttagctattctgggtcttctagcatgcctttaaactttagaatcagtttgttaatgcccacaacacaacttgcggggatttctactgtgattacattgcatctatagatcaagctgggaagaactcacatcttgacagtactgtcttcctatacatgaacatggaatatctctccatttatttagttcttgtttgattttgtccatcagagttttgtagctctcctcacacagatcttgtcatattttgatagacttacacctaagtatttcatttgttttgattctaatgtaaataatattatgtttcttttaacttctactttttcattgttggtacagaagaaatcaaatgacttttgtatattaacctttaatcttgccacattgctataatcacttgttagttacaggatattttttggtcaattctttctgattttctatgtacacaataatgtcatctgcaaaaacagtttagtttttccttgataacttgtataccctgttcccacctttattttgtcttattagctagaagttccagtataattatgaaaagaaatggtgaaaggggaaatccttgccttgttcttgatcttagtgtgaaaacttctaatttctcaccattaaatgtgatattagctgaaggtattttatagatattctttatcaaactcaggaagtttctctgtattgttagtttactgagagatttgatcatgaatgggtgttgaattttgtcaaatgctttatctgcatctgttgataaaatcatgtgatttttcttttttagtctgttgatgtgatgaattacattacctgattttttgaatgttgaaccagccttgaatgtctgagataaatcccacttcactgtggtgtataattctttttatacattgttgcgttgaatttgctaatattttgttgagcatttttgcatcttaagagatactggtctatagtttctagcatgtctttgtctggtttgctgtcagtgcaattattaggtattagggcctcatataatcagttaaaaagtacagaggctccttgacttacgatggggttaagtcctgataaggctgtaataaactgaaaatattgttaagtcaaaagtgtgtgcttcaacttctgagattttcaacttacaatgagtggagttatctagacatatcccattgtaagtcgaggagtgtagtgaatgtatgttgcttttgcatcatcttgaagttgaaaaattctaagtttgagactatcggtattccctctgttcctgaaagatattgagagaattggtaggaatttttcttaaatgctcagtagaattaaatagtgaacccatctgggtcttttgctttgttttggaaggttgttaattattgatttgatttctttaatagatataagctgattaagattgtctatttttcctgtgtgagttttggcagtttcaaggaattggttcatttaatccaggtcatcaaatctgtgggcatggagttgttcatagcactctttattttccttttagtgtccctgggacccgtagtgatgtccaccctttcatttctgatattattaacttatgtcctctctttttattcattagcctggctagaggcttatcaattttgttgacttttttcaaataatcagattttgttgattttctatattgattttttttatttcattgatttttgctaattcttattattcattttgttctgcttattttagactaaatttgcttttcattttctgtttcctaaggtagaaacttaggtcattaattttaaatctttcttcttttttaatatatgcactcaatgatataaattgccctttaagtactacttttgtagcacctcacaaattttgataagttttcttttaattttcatttagttcaaaatatttttaatgctttttgacatttcgtttttggcccatgtgttatttagaggtgtgttgtttaatctctgtatattttgggattttccagatatattttgttagcggtgtctaatttaattccattgtgttctcagatcagagactttatgatttctgtccttttaaaatttaaggtatgttttatggtccagaatgtggtctatcttggtgaatgctccatgtaaacttgagaaaaatgtgtattctgttattgaatgttgttgtctatagatgtcaaattatatccagttgactaatagtgttgttgagtttaactatgtgcttactgattttctacctgctggatctgtccatttctgacagagaagtgttgtagtctccaactatgctaatagatgcactacttgtctttgctgttctattggtttttccttggcatagtttgatgctctgttattagatggatacacgttaaagattcttatgtcttcctggataattgatcattttatcattatgtaatacccttcttttgtccctgataactttccttgctttgaagtctgctttgcctgaaattaatatggctactcctgctatctttagattagtgttagcatgatacattttcttcatccatttacttataatctatgtgtttttgtattgaaagtgactttcttatacgcaatacataggtgggtttttaaatccacttaaacaatctttgtcttttaattggcgtatttagatcattgatattcaaaataagtattgatatacctggattaatatctactatattgattaatgttttctatttttttctctgttcctattttgtcttctatactgtttccgtcttttgtggttgtatttcattattttatgtgattcaatttttttctacttctttttagcatatcacttgtactttttttttttttttactttttgtagtggttgccctagagtttacaatatacatctatagctaatccaagtccatcagataaccccgtaccacttcacagatgatatgagcatcttataataaaaaaatcatatcctccctcctgtccattgtgtcactgctgtcattcattggacttatatataggtatacataagcacatatattatacgtaagtatacacaatcaaatatattgttactatgattattttgaacaaattgttattagatcaattaggagtaagaaaaataaacatttttattttaccttaaattattccttctttgatgttcttcctttctttatgtaggtccaagtttctggcctatatagttttccttctcttgaaaaacttccattaacatttcttgcaaggaggtttattctgaatacattctttcaatgtttgtttgtctgagaaagtgtttatttctccttcacttttgaagaataattttgcagagtatataattctacattggtgagtttttttctctgaatactttatttatttatttatttattcttttgtttgtttttttgagacagagtctcactctgttacctaggctggagtgcagttctgtgatcttggctcatggcaacctctgcctcccaggttcaaacaattctcctgcctcagcctcccaagtagctgggattacaggcatgcaccaccatgcccagctaatttttgtatttttagtagagacagggtttcaccatttggccaggctggtctcttaaactcttgacctcaagtgatccacccatcttggcctcccaaagctttgggattacaggcgtgagccactgtgcctggccctcttaatacttcaaatatttaactccagtctattcttgctctttaggtcttgttaagaaaaacagaatgctctgccatattatgaaatggttcttcttctcttccccctgccagaagcagcgggggaattttctctaatactcactttgagaagtttgtcaagcttctctagataaatctcacaatatccttggtgtcccctatgcctgggccctcctggagtttttaactctcagacttgtctgcactgatcctccagaaattcatcaattatagttcaggttttcctacgctggtcctggatcctgatgtggtttccgctagtgagtctctgcttcagtaagccatagttccctatatttgcctgtctatctctctaaccttggcgtagcagttttgccctaagtcctcccatctcttacaatctaagaagagctgttggtttttagtctctttagctttttttttttttaaaattattaatttattttttatttttaagtatatcttatttattttattatagaataaaacctattttaaaatattctttttcttcagacatcaggaatttttatttatttatttatttatttttattatactttaagttctggggtatatgtgcagaatgtgcaggtttgttacataggtatacacatgccatggtggtttactgcacccatcaatccttcatctacattaggtatttctcctaatgctatccctcccctagccccccaccccccgacaggccccagtgtgtgatgttcccctccctgtgtccatgagttctcaataggaacgcttttacactgttggtggggtgtaaattagctctttagcgttttacttgttaagatggagtggcaacttccaagtaccttacatgtgtaaccggaaacaagctatcatatatttttatgcctataagtcattcactgttttcatagcatgtctggtattgatattaatctacaatatccatttgagttgttctatcacttttgagctctcattgaggctgtagtaagtcaactaaagtcataagatttgaatgcactatacacaaacaaaaaggtgtgttttccacataaaatctgtgcatgatattttctttgcttttatttaaaaggtcatgatatagtacctgcaaggttatggttcatttaggaatagagcttttcaatggcacataaagagcttgatttaaaatgtgttattatgcatttatattccaattataaacttcctttcagaggctttaacaaatattcatttaataaactacctttctaaattaaaaaggttaataattaatgtagtattaaaatgtaacataggaataaaaaagaggttaataataaaataatgaaaactcttaaaataattacatggaatgatgcacaacatcaaatagtctgggtacattttccaaaaccatacatttaagcacatgggtgttgtaaagattattaaaacattttctttaaagattttacattcccaaaataaaattctatgtcaatacttattttaataattttatgagatttagctctttgctctcattaactatgattgcatgtttaatgcatgttcaattagataatcctggcgtgtacattagtggtactgtgtcttaggcaacggatggcaaactcctagaggacatgggctatgtcttctagctcatcatgtccctgtggccagaaactcatcagcctgaagcagctggattaatagaatggtggaatggccttttgaagtcacaattataatgccaactaggtgacaaagctttacagggctggggcaaagttctccagaaggctgtgtatgctctgaatcagcatccaatacacggtactcttcctcccatagtcaagatacatgggtccaggaatcaaggggtgtaagtagaagtgacaccactcaccatcacccttagtgacccactagcaaaagttttccttcctgttcccacaacattatgttcagctggtctagaggccttacttccagaggaaataatgctgcaaccaggagacacaacaacgattccattaaactgcaagttaagattgccacctggccattttgggctacctctcagtcaacagtctaagaaaggagttatagtgttggctggggtgattgacccagcctatcaagatgaaatcagtctactactccacaacggagataaggaagattatgcatggaatacaggagatcccttagggcatctcttactattaccatgccctatgattaacgtcaatgggaaactacaacaacccaatccaggctggactataaatggcccagactctttaggaatgaagatttgggtcactcaaccaggcaaaaaaccatgacctgctgaggtgcttgctgaaggcaaagggaataaagaatgggtagtagaagaaggcagtcatcaataccacctacgaccacgtgaccagctacagaaatgaggactgtaattgtcatgagtatttccttcttattttgttaagaacatgtttgtgcatgtatacacttttactaggaaaatatcttcattttatttccttttttcctttatcatgtgatgtaagatttattgacttcatataagaatttaagtgttaactttatgtaatagcaattagggtaaggattaatgcacttctggttgtgcaaagaatagctgtgtaattatgaccttattattgtctttatttggagattatgtatgatttcaggagatgtgtatgggttcatgttgacaaggggtggacttgtgatagttaaaattgagtgtcaactggattggattgcaacgtattgttcctaattgtgtctgtgaggatgttgccaaaggagattaacatttgattcagtggactggtagaggcagagccaccctcaatctgggtaggcaccatctgatcagcttccagcatgactagaataaagcaggcagaagaaggtggaaagagcagacttgctgagtcttccggccttcagtctcatgctggacacttcctgccctccaacatcagactccaaattcttcagcttttggactcttggacttacactattcatttgtcaggggctcttgggccttcatccacagactgaaggctgcactgtcagcttccctacttttgaggttttgggacttggactggttcccttgcttctcagcttgcagacggcctatcatgggacttcaccttatgatcatgtgagtcaataatcctttataaattccccttcatatttacatcagatatacatctatcctattagttctgtcctctagagaacgctgactaatacaatacatataagcacatgggttttgtaaagattattaaacattttccgtaaagattttaaattccccaaatatgattttatgtaaataatattattataattattttatgagacgtagctctttgctctcattaactatgattgaaagtttaatgcatgttcaattagataatcctggtgggtacaagagtggtactgtgtcttaggcaatgtatggtaagctcctagagaacatgggctatgtcttctatctcatcatgtccctgtgggtggtaatttgctggtcctttttatcaaggtacctgatacatagtaggaactgagataatatttgttgaatcaagaacaaatgaaagaatcattgagatgtaattaatgcttgttaaatgcaatgctttaaaaagtcaaggacttgtaaaaacacacaacttactcttttccaactatgtctatcctattacctcacagaaattctaagtgaaagcttagattcattcactgtgaaacatgttgcataccctcccacttgagagactctaccttggctgcctgctcaaccttatatattcttccccagacatacacatggtgttcttccacatcttctttaagcctctgctcaaatgtcactgtctcagtggcactctttaaaactacagggccaggcacaatggctcacacctttttgctgaggcaagcggatcacctgaagtcaggagtttgagaccagcctggccaaaatggtgaaaccctatctctactaaaaatacaaaaattagctgggtatggtggtgctcacctgtaatcccagctaaggcagaagaattgcttgaaccggggaggtgaaggttgcagtgagctgagatggctccactgcactccagcctgggtggtagagcaacaatctgtctcaaaaaagaaaaagaaagaagaagaagaagaaaaaaaaaaactacaaacgacctcctcccagctctattttattttccatagaactttctattatatcattttcttatttaatatatttattgtctttctctctgcagctgaaatgtaagctccaataaagtgagaatctttgttttggatacagaatactgctgacatagagtagatgccctgtaaatacttgtggaatgaataattagacactaacatatcatttgaaagtctttttgcatcagctacccgatatataaaatgaaaataatttggttgccatacttatttcataggactgttcttagaattatattgtatatttgacattaaatagttttcaataaattcaacgattattttgataactgaaagaataatgtcatattcagatttgccttttttctacaatttagctagagtgcaaacaatgacattttgaaatagcagaatactttggttttaaacatccggagataagactttaaaaaatatgccatcggaaagggtaaaaagcatcatctttatatgctcctttgatctttctgtagtgtcacattgtgagcatattatatttgtgaattaatgcagtttaaaaaagaagtagagctatagaaccaaagtttatagatagatttatattttataaatattttaaaattatttttagatttaaccaaaatgctagaaaattcaccaatatgtaacatcactttttagcaaattatgtttcctagtttacattgcttgagcagaattgatattaaaaatttttgtcctacttacacagaaaaagttcctagaactgtgagccccagacatgtgtgcctctctgatttgaaggacccatagagggccactattgcaaacagatactacgtcaaagatagaatagtgagctgggaatggctacaatgttgggtgaggaaagaatggacggtggggtcaaaactaggaatcatgttctttacctgaatggtctaaagggcatgcattctgatcacgcagctggatgattcttttccaatccaggctctacatgagacataaagattttcattgcacttatctgtctcctatgcacttcaataatactcatcctctttttccccgtgagatcatctccttcagtactgcatcttcaatgcccatctctgagctggcacaataatgaagctcagtgtaaatagtgaatgaataagctaatgatcctgtgtactattcctgcacaaatcaagtcaacttcactttttttctgctctccttcctcccactttatcatattccatcctcactacaatttccctcatctctataagatctttctgtacaagaaggtatttccacgtttgaattcacgagcttccacctccattttgagctgtcaatcctgctaacaatgagcaccccagtaaacaacaatagaaaaaaaaaagtaaaaacaacctctaacatgtctcactacttaggataatgattaatgatactaaaataataaaatattcatttatcattgaatactcataaatcattcctttgccttaatatgcagttgatgcttagggatcaaccaaaaatgtttcccacatttttaaaacatcatagggtttaatcttcattacaaatttcagttcaaaatgtttcttctcagaagcatgacaaagtgatttagagtagaagtagtgaaaggacctttttcaaagtgattggaacctttctggtatagacgttaaacagcataatgaatgtgttggcatttgtttcttatttgcatactataaaaataaaacagagtgtacaacaagttcctgttaaattcatattacctgtttaaataaggatattcaaaaggcaatgtgatctaattaaaatcaagaaatggtattcaagccatatttatatacttctatgataatacacatgcactaatatttacaatgcatgcaaagggtatacacctcattaagcataccgggaggaaaattccccaatttcttcaattcaactagtcatttcataatttttttctaatgtgaatgttagctatttcaagtgctgaactaaagtcacatttaactataatcaatgcatttgcagttgtagtccaaagcaaactctgaaggacgttctcatagtctaaaacttgacgcattttgaagataatacactgaaggcttgaaaacaaactatttactcccttaaatgtgcctttttctcattgttcatactttccagcttgctcacaaatgcccaaatgttgatatcaatgctgtttctaagaaactacaataaggggtttgttttgcaatcttttttctcccttctcccacacataatcacatgatctttgaaacttacaaaacgaataggagaaacgtatcctttcaaaatgaagtaactttatggggttatagtcctctaagagcagattatgcattttttataccataaaaatttgtcaatttggaagtctgtttaaaatataaatgtataagcatacctttgtcttagaaattattatatgaaagtatggacaattaagttttaggaaaaaagtgtacgactacagttttgggtcattaaatgcatcctgttttgagagttgctatgtattttcaaagagcattataaaatctatagcactgattgttttcattaattagaataaagcaagaacagcctctagaatcacttgatttaaaagacaaattctggttcagaaccttctgaattatttacaaccaactccacttggtctatcatttaatgaaagaacagaaaggtgtccttcccccacaccaccctaaacgagtcatcatagtagaatgccataaaagcctgtgatgaggattttagtctcagatgcagcctatgtccccacatgtctcataaattcttctaatgcattttcacatccatgatcatgaatgcctattcaatgaaagggtttatcatatgctacacttttcaactaccaagaacaaagagtaaatggtccctggccccatatttggaacaaaaagtatgaaagcaaaacaaaaacctcttacatttttactaaataaaagaatgaatgcagactgtaaaggctgagtggaaacttcttttggcaccatgatgttctttcttgagaccatgctgcgttttctctgctcagtgagggacagatagaaaaaaatggagatacaaatgtagtcaacctcatgtgtcacccaatccatcttctccctactaaagaactattcactacattatagcattaaatgtttccatcagtatgctttaagagtaatgcggatttttgctatctatttaggaggaattcacaatatagtagaggtagctactgtcaagagtttttcgttgtttttttgtttgtttgtttgtggactggttctggctctgtcacccaggctggagtgcagtggcttgatctcggctcactgcaacttctgcctccctggctcaagggatcctcccacttcagcctcccaagtagctgggactacggacactacaggcccatgccaccacacctgcctaattttttgtgttgtttttgtagagacagggtttcaccacgttgcccaggctggtcttgaactcgagctcaaacaatcctcccacctcagcctcccaaagtgctgggattacaagctagtttttgtctttcaatttctccctcaagctactcgtaattatacccctagatcaggctaagcaatttcctatcctctttttttttcaacatattttcatgacttggagtattatttctcattaggtaactatcagccaagccagagagatttatgcatttcttaagtgcacaacatactcacaccaaattatatataaataatacatacatatgtatacatagaagttatatgtagattataatatatacaagtacatatgcacttttccttcaaccaactgccccagtgacttcactcagaaatagccacctatgagacaaaactactcaacaaaaagaaataaaacaaaacaaaaaaactaaaagaacagtaaaaaaacaaaaaacacacacacacatattaaaaattctacaacttggaaggagacataccaatatacacatttgatggcaaatttttgtctagtctaggaaaatgccttcttttcaaattataatttattacaattagtctatcagttggttatcagccttggttgagtagacaatttccattcaaggactcactgtatcaaaatactatttaaggcaaatatacagtagatgctgtgaagctcagtaatatgggatattatccctatcttatggtcttgaagaaatctcataaaaataattcaaaattaattagtggctacatttcatgtattataggacttgtacagtttcggtcaagcagtggtttcatggtgccatttttctgatgtgcatcagagggggctcagaatagaaaattcatttgggtttttaactataaatgtaggaagctcaccttctaaatacactcttgccttaacagtgtttattcttatatagaattactctgtcccacttcatttcttactggactcttatttatttgtagaagagattgtattcttcactgaatatgctgtagctagaaaatgtcttagttaagtctttctaggtgcgaaatagggtcacagcctatatcttactaggcgtcctagcagtaagcagtactgaagcaataatattgcctggcattgtgtttggcttttagtttggctggcagggccagcttcttccatctattcatcctaaataacattgtcagcaaatcttttttttaggcaactgcaaataatcttcattagactatctcattctttttttaaaaaactcattaacttatttcacttttagctaatattttctttatcaaatgagtttctgtgtaagtagcatggctgtttttacttcctatgaagctacccttcctaaagctataaaagaagaaggagaaaactttcattacgggaaaaacaaacaaacaaaaccagaacaaaagcaaacaaaactctacaaaaccagaataaaggcaaacaaaactctaggacattggtagaatgaaaagctgggaaaattactatcaacacacatagttttcagactttcttaatttaagcaactgttgtagcacagtcattgatcctatctaaatgaatcaggatctttttcacaatctccagcctcaatgaaataacacttcatctacaattatattattattattagagactcacactgtcacccaggctggagtgcagtggtgcagtctcggctcactgcagcctccgccaccagggctcaagcgattttcctgcctctgcctcccgagtagctgggattacaggccaccgtgcccagctagtttttgtatttttgggtagaggtggggtttcacatgttggccaggttggtctcaaactcctgaccccaagtgatctgctcaccttggtctcccaaagtgctgggactacaggcgtgagccaccatgcctggccttcatttacaattattaaaaaatactatgcttcctgagttgtccatatttgaatgagatacttatgaggaatgtggcattttccatgctttattactgataaattttttggacatttctgctgcatcatccattctctgtgataaagattgtggtacactaacaggtatgtttactcctatagcatgtgcagcttgtacagggtatggcttttaggaagtaatatcattttaaaattaattgttaatttctatgtgtttgtcctgtcttcccaagaagtttatactcctttgatggtggggtctctttcttataagttttattttctcgtatataatgtcttatacatttatgagtcgtactcctgattagtagataaggtaactattcaataatacctgtcttacaataaaaaagatgaaggagatgacatatctagcaagagaaatccaataatattaatgcttaagaaccattgatgtttcagttctcatttgtcagaatttgatattaaattgctttttgtcaagaatctggaaaaaacatgtcataatatagaatcctttataaaaagggcaatctaattccttatagctcggaaaggacttcaaactgtgtcattccatttgccaacaaggaataaattcacataaattaatctctcattcatgtaatgtagtacagaaatttatagtcttgtcaatagttcatgtggagctataatttgggataggtaaaggaaatgtatccagtgactgtgtatggtgctatatccttccagaatcaatgactgagaaaatgttttactctctgattttctttatccattagatatcaaatgtttggacttctctcatttttaactttgaaaatgctattctgttttagttccaaggtatacagtgacatgcttccatcagaaatggatcctagaatactttgaagccactgatatatcacttctcttgaagtatttctgtggtagtcagcagttggcattgcctgtggtagaaagcttcacattattcttggtgaaacagaaaagaattctgtctggaaatcattagggatccatgacctataaagctctttgcaaacacaacacaattttaaacaaatgcaaaagtcttgctccactcatcactggaatggcaggattaattaatatcctcctgagatatccttaacccagaggtgctcatcgaacccccttttaggtagaccttcgcttcatgtgcagccttaaggattagttgtcagcatttaccctcaaataaaatatagccacacaaatattaattaaacaatttcaattttcaaaagagtgtctggaaagatctggagccagatatagtgaagtctgactactatttcccctgcttgctagctggagaaatatgttcctttttaaaattattactaattaaggcacattattaattatttaaaaatgaacatatttccctaaaccctacaagagaggccatataatctagtaaaagagcatgggctttcacatttactagctgtggatcttgggtaagcttcataatgtcttggataagttaagtaacctctgtgaccctcagtctcttcagctgtaacatgaggttaataagagttgtcttagtgaattgttgagttggtttttaaagcatttctatttgtttatttgtctatttatatctctgtctctattgctatctctatctccattgcttcttttatatctgtattttaaagtgaaaacttaaaagcactcaaccaatattagctacttcctctgcccctgtaattatctaaaattattatatatgtcttgcattcaaataatcaaccaaatatgtaaatttcaatttcaacaaataacatactctaatatatgctttttactgtttagtaaaattgagctgaaagattgaaggaaatgttcatttcttttcaacaaagctacacatagtaagcaaaaattctttaaatagccatattgtgttgcctgatatatttgattttgaatttattttacgatgttgttttcactttaatttttttcaatattgaaatacaaatgagcttcttattaaaaactacctagaacattgagtcccatacaataagagtgttaaccattgtaaaccctgtcatgtctctgggaagcagaggaattatcttgttatcagtttaataatggaacattgaagtaaatgatgccatccactgacaccagtaacactgtctctctggggaaattcatgtctgtgagaactgtcaatctagatggatacagacatattaaacatactcccttcaatccataaatccaccctttctgggttgccttaataaaaagatcccttattttgataaagacaagctatgcagaatatcttgacattactgatctataatccctttattttaaaaaagtattttgtggaaggatttagtaaataagttaacaaattttcatctacttcctttttgtgctttagcataacttacatgtaaacatgttcctgaggttttaaattaataaagtattaataactacatagagatgtgggaaatacatataatgtatttatttccactacttgctttggcaagctttcttcaaaacacagcttacttttgttgttttgcattaaaattgcctctagttctaattgagatagatataagatgattttttttttttttttgagatggagtctctgtcacccaggctggagtgcaatggtgcgaccttggctcactgcaacctctacctctcaggttcaagtgattctcctgcgtcagcctcccgagtaactaggattacaggtgcctgccaccacacccagctaatttttgtattttagtagagacggggtttcaccatgttagtcagactggtttcgaactcctgacctcaggtgatccaccctcctcagactcccaaactgctgggattaaaggcgtgagtcactgcacccagcctaagatgatttcttatattaaaagtatcacacgttttcccatgagaaaatatgacaagaaaaagtaaaaattatcaacataaatatatcaatgaaatatacaacagtagaacataatgaaaaccttctcagtgcaaaaatacactgtattacagaacaagcaagaaccaagaaacaagttgaattgcattgttagttaccaaaatgtgttggtatatcttagtttgccagagtagactaaattgcattaatggacacaggtttcagccaaagcctagaagcaatgacacttaccctaaagactgaaaaaggaaaaataagtatactgaaaaaaggaaaagaaatccaaggtggcagcagggattctaagaaaaggctcttataacctctaactgattttgaattcttactcccagacaatgatgtttcagggtagagagggcctacttgccatgagatcatttgactttttcttatctaagtgcttcctagacaacccaatggatatcccacaggcaccagaaactccattatgcaaaaccaaattcttcatctcccttcccaaatctctacctcctggtgcattttacctttagtgaatggagccatccaacatacagttgcttaagtgataactgaaaatcactgtataatactttcttcttcatatgcaatatatgccctactcttgctacttgaataatcaccatctctggtaattccaactcctataccactcaaaaactcatcacctcttccacttccattagtctgctgtagttccggttatccccacttattaccaggtcctctagacctggtacgtaatcactattataatacattatgatttttgttattcacaacaacgctgtaaaataggcaccgatattccaattttaatgacatctttgaaaattaaaaacaatttttgttaaaagttaattgaaacagtttagaagaattgaatacgatgagacaaaatctacctataaccccaccctctgcctccaggccttttccacatatgtgaacactattaatgttgtgtatctttataaaaatatattttttataccaaaaagataatattaagcatacagttctgcaacttggactacattaaaaaataccacagtaaacatgggtttatacctatgttggcaattttatccactgagtgaaattttaattgagaaatttctaggtcaaagagtgcatgtattcaaaaattttattgctatgttcaaattgttctgtagaaagaatgtacaaatttataatcctactaacagattctgacaatgcctattttcctttattctcgcatagtcttcagaatcctagcaggaaatagaaaggacagtcaattgtggataaaatgaataaatgttatgtaaccacttacaaagatatagccttgtgcaggaaaaccacaagggacagtagaggacactgggagtggcagtaaggacccaggaccatcttaagaccagagcctggcaaaaagggccaccagacatgagctgagatttcagtggcatccacaggtacttcacagtgaccctgcaggaggcctccccctcctcagtctctctgatctgtcctgactgagtccagctggaacctagagggcaaggtggccaactgaagtaggtccgtcttccagatgcagatactgcgtcgaagggaggcgagtggatctgagcagcaaattgaagacatggagaacacttcgtaattttctggggttgaagatgaaagagtctgtgtttaatgtgaaaacttgtagatttttttaccttgccatgttcatttctgaactcttattttttccttggctaactggttttgttgtctctatccttgctttcccttccatcaagtttctgcagagccactcaaggatctttccaaaatgcaagcaggatcatataatttctctgcataaaatctctcactagttctccacctctccagggtaaagctgaaactcctaggcaagcataaacggcctttcgtaactgggctcctgcggtctagggatctctttccaaccatcatgtctgctattctcccatctgtattcagcactcaggcagtacagagccatttgtagttcccggttgtgaaatattttctcaaacttcaaaggtactgcatcactctgctggtaatgccagtgccttctctgcccacacgctgaacttctagtcattcttcaagatgccaatcaagagtcactttctctggaaggtcctaatcaacttgctcttgtggtagagttaggtaattaatactctgaactactatgtgacattgtgtgtttctcatctgcacatagttttctgaaactatttagttgctgccttcccccttgagattgtgagcactgtgacagcaggggtttgttccttgttcactttattcatttctctcttcagtatttagcacagactctgatgtcttacggcctatatattatcttagtatcttcactaacttgccatgtgtacttggtaaagccccttaatttctccaagtttcctagctataaaatggatgcaatattagtgctaagggtctggcaaatattaactcttttaactctcacaacaaccttaagagttaattttagttaagctcttggcagtatgtctggcacacaagtggtcaagaaatgttaaatcttcatgtattgtatcaaatcaccaaggatcttacttccagagattaactatttgcatgaaaaaccattagatttcccaagagaaacgtgaaaagttttggggcctcacactaagactcgtgaggttatcaagcttaaaatttctgagcaaaaaacaaaacaaaacaacaacaacaacaacaaaagtgattgcctagaaactttgggtgtttgagaaacgtaaggatgggtttttggtcagtttttatttattgcctaatccagagaatacaagagtgcctatcccataacaggtgacaataaatatttgttggaagaatgtattgtatgtgctttagtttgggacacagctgcttatcaatatggatcagtactgtggcccaaggtgagacacaggcaccctgtctccatgtcagggggatattactgcaactcctcagggaggtggaaacacaccattcaaagagtaaagcaacactctgagcatcttaaagactattatctctggtggaaaattctcagcttcaaagactccatggcaagagcattaggaagaatgtttccaaaaactgatatggggggattttctggcagaggtgagtttctgaaatggtacgagtgaaatagtcaggcatataaagcgctagcccctgaggatgggagcacagaaatacagaataggggcagtggggattggagttctgtattacaatacccctgaaattgttgtttattcctacaccttgtgttttacctcaggaaagcaagagatatggaattgttctcaccaatagttgaaagtgatattaggaattaacttttttaaaaaagcaaagacctaacaatcttttagttatcagcattggttttgggaagtatttttaacattattatattaaaatattaatataggtagcaatatttgaatatggaattatttacgttttagaaaatgtgcatttcaaataaaataatgcacttattagcgagagttttacaattaaagggaagacagcttgcacaatttaattgtttagtctttaacaagggaccatggaaatgactggagaagccttcagaggacaaatgactttgaattagaaagctaaggtcacatttacagacttactctgataacatgtttgctgctaactagagattgtagtagactgacctaggagaagaccaagaatgtaccaaacaaaggagaggtaaagtagagtaaccttttttagaatgtatttttctggtctggatttcagatgtctcatttcctacctccacgggctactgggtcactagtattacttcacattgtacaggtcacaacaaggaccctgagcacatgacagggtggtggattctgggagttcattccctgagcacctactatggaccaggaattggactagattctgagaatacagtattcaagaaaacatatatgacacttgcatacttcaagcttgtgatccagtggagaagagaaacattcaaggaacattaacacaatggtatacattacaaaatgtggtaagtgctacaaacaagatgctatccaaaataaatgaatgagtaaataaataagtggcctgtaatacagttcaccctttcaggcaatgtctccatgtagaagtgacatgaaaatggaaatttcacagatgagctggaatctgttttgggtgaacaatgactcaattcaagtaaggggaatatcatacatcaaggtccacatgcaccgagaactaggcatgtttaaacacacagaaaaagccagtattgctggatgttaatgactgagcagggaatggagtgaaatgctgtcatggaagcagacagtagccacataaaaatgttggtcctagcaagagaaatcatattgtaatgattttactagggatgaggtagaaaatgctccagctctcctatgctgcccatatgcccattttctttgacttgaagatggagctgaacagcactgaattcttgattttattcaagtctttgagtaaccacacaacctctaagctcattttctgtctggttcatagtctggccaagtggaaagaggggtgtgattatggctaagtggggtaggtggaaggaaagcagcaacttcctttgttccttccctttcagacctgatattatcctaaagaagagagtacaaaatgacattgcttccctcctgctggggagagtgcagaattggtcatgggcaattgtgagcactgagctgacatagtaccctggtgacccgaatgagttaatgcattgtcctaaagctctaatttacaaccaggaagaatttggggcattgagaggcagattgaataggtccatttttacccattgtgatttcagtgacaggaccagtttgctctcgtctaaactggcccaccaaatcatgcattcagacaattgaatcaccaaccccctgacatactgcagaatctctgcaatgtaacacagcactgtcacttcaggttccagcttaatgtaccctttactttctagtcctcttctctctttggacattttgcactgaaaagcttctctgacactgattacaaaataagaaattaatattgtcattcatctttccactagcctgtgagtgcaaaatctttccaataaacccactataaaaccaaatatgcagccaaaaatagacctagtcctcctgattctcagatttgcacctctttaacacaccgacactatgacacatctgtttgtctttttatgtagaactttcttagtatataatggtatttatttttatctactaatgataacaagagacaattccaataacatctaaagccagacaattaaacaaactacattaaaagctgttcataagtttaataaaaatgattatcttgaaagctcttaatattcttcagatcaaaggatatgtggaaaggatatgtgaaaacccattacacctatagtaatgggtgtttcgtggttacatggtgaggctctagaacttttgataggatagtttatgcagaaataaccataatgctgcaggatggaaacagggtagaaatttctctttcacctcctgaatagaaaagacaactgagagtggtggtcagaatactactgggaaaggaaacatagacacactgttcaggcaagacacagaagcacagtgtgaaaacaagacctgctagaatatgaaagaagcatcctttactcccataggttaaagaatgtcaccagaatcacagtaaggagaaaatgaacactgattatagttgctatgtgtctttatcatttcttatgcaaatattcatagtgaatttctctataacactcattatatagtttgggctcactaattcttataggataccttttgtcaccttcgtaagatcgatgtttctccagaaaccgatactagcatctgagctagtatgaaccctttaaatattatattttggattcttctgcccacagtgaactgaaaaaaatccttttctgaatgctgtcttattgaaggttaattttttctcagagttttccacaacatataaacccaagcaattaaaagttcttaaactgaccattgtcagcttctcacattacctttattttagtatgttctgaattagttaagcacagacttaatcaattcagtttttcagatctgaaaatttttttgtgttaaaaatatatgaagttataacaataatatcacatcaatttcatataaatttcacagactctgccctagaaaacctagggtatatgatgactatgcttagggtatcgcattataaaatactgataaactttttttagaaaggattaattaatttgaaatctccagatgataaatatgtgtgcttctgcatcaatactattttttaagcctataagaaaatcagcagtataaatagatgttaccacatttcaactaaagaaaaacaaataaaaaatatctgccataggtctccctcttacaacaatataatataacagattatgaaagtgatctccaatgatttgcctatttagaatctttcggtagaaaacaattaagcaaatcgagatatttcagcataacattataaaggcaaaaaccatcaaagtagaccaaacaattattatcctattaaatattaaccaagaatattgttactaaaactgtaaaaatgaagaaagaagggaaacttagagatttcggctttcctgttatgactataacttttcaaaatgttagtctcctttactgacccagcacttcattactccagagggaaatttagaaaaggtcttttatagaaacagatgtctacgaaggcatctataatgattcatatatggttgggatcctacatctatagttgaacttcaatagccagaaaagtacatctgacattttgcaaacagactttgtccaatcatgctatggcttcacctaaatcccccaactctggtcaattcccctgcataggattgtaaacaagttcacatttgaaccctgacagcattcttttcattaatgcctttttcagaaatttcacttgtttgcattttagctgtacaatttcatacatattatacatttcagcttcagtttaccaaaaaaaaagtctgcatcttaactctttaaaactataatcaaagaagaaagtaaagcaaacattaaaaaaaaaaaacaacatttgtcagttctgagtggttctatgcaaaggtgttattacattattattctatgaaaataatttcattatttttcattttttcaaaattaaaagaaaggcattagttgacattagtgttcattaaatataggctggaaaaggagggtagcagaatcagaaattggcttagaattagagcagaaaggaggtacgaggcaagaggtcatgaaattgttaaaagtacacgtggtgggagatatagagataaggacttcggttcagatgacaggaacacagctttcaaaactgcagaggtggcaaaattctttgggaaaagaagggcaggagctgtctatggaagaaagtcagtgacatgatggcaaaagtaactagaggatgatacgtggtagcaaagaccataaatgctgacagcagacaaagattaaaagtaatataccaaaggtctcatgaatatttgggggtaaggaggaagaagagaaagaaatgcagagcaaggacccatgaggctgaaggatagaaagagtgtggcttagtctaatagaatatggtttggtgacatagaatgctgactcaacctctctccaaatggcactgcgaagcaggaagagtactggatgcaactattggcttaaaaatagaggagtggctctatagtggggtgggatgaagggtaggcagagacaatggaaactagtgacttctatttgagagatttttaaggaatactcctctttttcagggttaatagatattttagtaaaggcaaagaggtagatactaggatctagaaaaaaatttaggttatcaagagatgttaagaggatatgtttcaaagagcagagtcaaaagggaggtgctctagaaaagaggagagttaattcttgttgggtggtaactgattagagaatattaaccttaagcaatgatgcatgatttttataatgtctttaactttttaggccaaactagaatttcattttatctgatgtctctgcaaatttctatggcataagagatttaagattcagagttggtagaagaaggactttatttttatgcagtatataatatgtgaattaagttgttatgaacctatagtatttcttagttaatcttcaaataagtcctttaagaaaattcatatctacaactactacctcgggatactatgacccaaaaggagggctatatatccaaagatttatcttttattgtttgtttttgagattaattatctgtttatgaagttaaatatttgttggtactatccatcaaaaggtaagttttctgatattggaagtcttaaagatcagacaaaaatgaccttcacttttttttttctgattgttatctcaagagccaacataaacctactcttatttctgcctggccaaatgactgacatttgtgtttacctaaagatctataccttcagcacatacaggcgataatataaaactcctgtgtgtctgttgtaggaaattactaagaaaacataaccccaatccttcactctatactaggtaccaaaataatttcacaggtgatttaaaactcttaccctaatcttcatgccccaagtgcaatgtgacctgtctagccaggaaactaacagagcattctctcccttcctctttcggtcttgtgttccccagctcccagcagtggtctgttcccatagttaacctcacagaacaagataaagctttcttgcccaatgaagcaagaaaaaaaaaaaaatctctccctgaaaatgcacctccgtctcaaacattttttccagaaatagatattaatcctgcccctttgcccactcagccaacagtcaaagaacctcagaatataaaaattctcagtaattttctatgttgctcccatcaaaccatttcattacatatgactaaaatggagtagggaatagaaaatagtatgtattcacctctggaatgatctcatatattttccaagcatgagatcccactggtttctcttatgtgcaattcaaagatgcctaaaaaatggctaagtatttatggttcagttaaaatataaaagctttttcttctactattcaatacacactgtaacaatacaataaaagttatacattacgaaagtgatttctgagcctcagtgagaggtccatttaatcaaatcattgtcagaagtgtagtatctctaggagagtgaccttgcccaacctctttgtttatagatgagctatgacttgcccaagttcatatagttggtgacacagccatgaaaggctctagttcttcaagatcatggtacagtatttaaccatttattttaatgtgctccatgattttcccccataacatcaacaatcccacaaattacagatttcctaatacataagtcagttttttaaatctatttttggaaagaaaggcagttcttcaaattctgaacatgaaaaagaattttttaaaaatttagtgcccagtgagtacttatgtaaatgaatacaatgaatcagatactataggacaaattagtaagatggaagcaatagaggcaggaaagcagtaggttttgttcctggaagtttcagagtttgagctcattatttagaagtaaccgggagatcctatgctagtaggcagctaagactaagaaattcaatcagccagccaagaaacaacaaccactaaaagcaaaataacaacaacaaaatctacttcagatttttaaaaattaaacttcataacatctcttacagacacaagtgattcagataaattgaaaatgaacatgttgtccaaaattcagcaagtccttaagttttcttttttttttgagcatgtgtaggtgtttttatgtttgctcatgtgagtgacagtaagaaagatttcaaaatgtgaatatgattatgattaaactgtagtgttaatttagcctgagaaagtgggctttttgttaatagattattaggtaaatagggtattaaattttttaaatcatttaaaaagttttataaggattcaaataaaatcaaaatatcagttcaggaaaatttaagagcttaagtagtaaaatagtgtgggcatttttagaaatgaacattagacatgaatttgtatttggggagtattataaattacaacacaaattattatgtagtcttaataatcatacagagataatgttaaacattcatctcaaactattaaccagggtaacctgatatacatcttggtaaatctgagttaatgaagaattatcatttgttttactaaataggataatataattgtaccatatgtaggagtagaaatattggtatgctttctaagttgttttattttgcaaaatttgattttctattttacctaaaaaagtggtatgcttcttaaatttaaatcaatagtgtatctgtaaataaatttttacttaagaaataacttcagcatacattcatctgccttaatcataaacagaaagaagtatcttattttctctttattctttttttggaggtcaggaaatatgattaggtatatggtacatttaaccgttgtgtatataggagagattgaaaactctgaggttcaattcctgggtttgccactttctagtctttttatcttgagtaagatacttcttattttttatgattagtttccacatttgtaaagtaaggataatgatacctcctgtctaaaattgtgctgagaattagtgataaagtatgtctactactcagtctagtaactggcacaaaaacaagtagcttctactaacgaatttagtcatcattaattatgataccctgactaatcaatattggcaacacataattctaaaagatgtgcatctgaaatttaatgctatactcttgtgttttctctggatttaagaggaatagggatgtggagaagagggttgtggagaagggggggtaatcaataatcaaaatcatatttaagaaaagaagtatgatatgcttaataaatgtggacaaactgaacactagtttgcacaagtttggaaccaatctctttaacccttagtttttcccttggtaaacaaacagactaagtcatataatgcttgataattaattattcaaagtttctctggcattcagtgtctctatgattaataattcagttacgtttattgagaatgctaaataatggcaactcacatttttcctactatcattaagactgtcctgttccagtgatggctgggagtaaatctgaacataaatcagaaaatcgcaggagatgtgtagtagttccttagttacaactatgagaatgaagtcgtacccttggagaattctagtgtgtgacttgaaatatacttagtaatccagtcactgaaagactgacagatttgctcattggtttctcagattccgcctaacaaggcctacgggacatggattctaaatgagaagaataatttctaaaaagtattttgacagttgcctttaaaaaaacagaaacattttatggcatatgtcctttatttataagactgatttttatagattatttagcatgcttgaacccaggaggtggaggtggcagtgagctgaaatcgcgtcactgcactccagcctgggcagcagagtgaaactcagtcttgggaaaaaaaaaaatgtcctctttcacgtgaattttaataaaatactatgatgcacataaaagagaagcagttgaactgtgctaagcatggggcttggccctaggaacactgcgagactgctgtctggttagtaagcagagtcttatatgcacataattacaagatgcatggattcatgcattaatagaagtatgattatccttccccaacatctgattcctcttactgaaatacaattttacatctatatactttttatatctatctatatcaatttgtaaacattgcctatatgtgaaccaatcctactgagaatttagtagaagtggagcctgagttcagaaggaaaaaaaaaataacagatagcagaacaggcttagcagttttttccagacaatcctggaggaggaaattaaaaaatagggttttagaattgacctgcaggacaattaattaatttattttttcttaagaaatatttattgcgctccccttatgcaccagccattcttcaaggaggtacagattcaggggtaaatgagaaaacaaagaaaaaagattcttacacatagagaaaaaatgttttgtgagaaaacagactccatctgtcttgttcaatactaggttctaaaataatgtctggcatttagcatacattcaataaatattggtagaataaaaagaaaaaaaatgaacaatttatacagaaatgaatattattgaggcactaaaacctagcaatgtgattgagaatgactggagtctggcataggggcctgcttttaaaatgatggccaaggaaggccactgggagatggtaccaagcgagttgatgatttctgctccaatctctatcttatctctttataacattcaattatatgaatgttagaacttctgatattgttccacaggtattggacactgtggcatattttttctctttgatttgtcagtttggggaatttctttcaataatttttatggttatataataattgtacatttttatggagtacctatgatattttgatacaagcatacaatgtgtaatgatcaaatcagggtaattaggatatccatcacctcaaacatttatcatttctttgtattagaaacattccaattccactcctcagttattttgaaatatgcaattaattattgttaactatattagccctattatattactgaacactagttcttattccttctatctaactatatttttgtaaccattaaccaatctctctttacccttccccttcccctcccactacacttcccagcctctggtaatcgccattctacactctatctccatgagatcagttttttatctctcatatgtaagtgagaacatgaaatgtttgtctttctgtgcctagcttatttcacttgacacaatgttctccggttccatctatgttgttgcaaatgatagaatttcattctttctacggctgaaaaatattccattgtgtatctataccactttttttagtccattcatccattgatggacacttaggttgaatccatatattggctattgtgaatagtgctgcaaaaaacatgagggtgcagatatctctttgatatagtgatttcttttggatatattcccagcagcaggactgctgggtcatacggtagttctatttttagcttttttagagccctctcccacacccatactgctttccatagtgcctatgctaatttactatgtcttcaacttcactgattccttcctccatcttgtctagtctcccttaagcctggtcaatgaattcttcatttctcataatgtattcttcacttcttttatttctctttggatctgttaaaatatttattttacaactctctaataaaattccacatcttttcatgactgtttttccacctctcccactagattttttttttccacatttatcatggttattttacgtctctatctgataattccaattctatgtgtgggtctgcttctatggaccactctcaagaatattctgttgatcttgggccacactttttttccctcatgtcttataattttttattgagtgccagatggtttctgtaaaagagcagtagaaatttacagaaataatagtcatccccagaaaagggcacaccacttctcttattaggctgctaattaggagactgagtggattaagtctacagttaagcagagtctgggttgtgccgctgctttagttagattcggttcttcattgccttcaaatgtgtcgagagcagaaccttctcttcagcaggacttgggacttgagtcccagaaagactctagaatctctttacttattgttaatccagtaaccaactttctgaaccaagggatatctcttgctgctttacaggccagctcctaggtttttaggttgctcgggagttctctctgctctctagtttcaccatggttttttgtgcttcaggatatctttctactgatcttcccttcctctagtcttccaaagagccactgcagtacaactagtgaaggcctagaatgcactggggggatttctctcaaggctttttccctgccttagccttcagcagacctcttttaactggaggaggccctgcttgccttaggggggatatctctcagcttggctgccttggctttacatttggttgacaattcagtgaagtcccatgagacggttggttgatgagtgcagagatggtccgtgcctgggcttcttggggttctcacacatcacacaactctaaaaacattcattaaaagttctttacaattttaactggtgtctctacagtgacatcttcctttcaccatttctccagggagcaaagcagtcatgagtttctgctctccttgtcactttctgaaatttagttcatttaagtttatttgcattttcagattttaggtaagttttttaaaagtctaattttgtggcttatatcttttgttatggttattagggtaggagtaataatctcttatagctttctacatccttactagaagcagaagtcctgcctgaatttcaaagtcataagctaaccatatggtatctattatcctagcagtctgagtttgaattggaaaggccttggaaggttttaagcagagattaggcaacaactgtgagtcataaaacatttcatacaactctgcagttgaatagtatgtatgaaaatatatgaaatgtaaagcatttgaggaataattatagtcgaggtaacaataataattactgttatatggtgttatatgtcatttctcatattgattgctacacagtttccagtaattcatttaaaaacttattgtacacgtagccattccagcctttaattgtgttcatttcctatattaagacatctccccacccatactttgtaacccaagagccataactaaatttacaatttaaactaaatcaggcacaaaacagtcactgatcattttaatattgaaggttttaaaggacacattatgaaaaaattaaaatgcaaaaagcagcacaaagttaaattaaattatttattatggaaagattagtcaatctggttacttccctaaattttgcatgactaaaatattacagaaaatttccttttggctgatcagtatatagatcagaaactccccaaagaagatgtattaataaagttaactcattccttattaatgctctaggcattttaacaaatgcaaagtgaaatatctacctcaaaaatgactttaatgataagttatttctttgcttcatgtacacaatggataattagttcaggaaaagaatctcagagggagaaaaaatagccaactgtgaaattcacaaatactttccttggattgggtacaaatgctattcaggctaataccagggatgcataaattctttctatcctatttacaatccagtcttgattagttaggagctcattttccagtttgtgaattatctaggtctttgattcttctcttccctctggctgattacctttcccatttctctgctcattagcacctccaccaaaggaaatgaaaatccaggtgaaaaggaaaagtaaatcattcatagataattctaaataatctgatgtttggctttaaaaaacaatctttttattgtgcgtaagtatatatgcatagttttatttaagaaaatacagtttcttagcagaacagtggggactgtgtggtcagatgttctgtgttcaatttgaaattctatcacttactatttaaaaactatccataggaaagtccttaccttcatccagatatcagtcttatcatgcaatcaggatgatattcatatcttttttgtgaggttattgtgaaatcgattcagagaaatacacatctgtatcctataaatggctatacaaaactaagaaactgttatgttttcaatttgtaaaacccctttgtcaattcttgtttcttctactttccttaagaatcagtttgttttggggaaaaggctcattgccaaagtatatctctttttttcttcttccttgctcctttttaaaaaattgtaccttttctctctaacatggttatgaaatacactggtagaaaggttgaagaaactggtagaaatatggttacatctttaccaacaaatttcattgactgattcttccctgcctcctattaaaatggataactactagttacctgtattagtatatattcttaccaaaatggccctcattctaatttgtacttttataaattttggttattaaaatgaagacatatcccacatagtaaaattttcagtaaattaaagaattcattatacacatttaactgttatatcaaagtatacttcatttgtcttattttaaggatgtctggtttgcctggtgattaagctagtagtcctgtgtctctcatgaacagtctctttttaattgatttacaattaattggatcatatttgtggatcacagatatagtttaaactgaatcaattatctaatcaaaaataacaattaaaaaagaaaagcagtcattaaaatacagtatataaacccttaaaaaataatgtgttaagtattgttttttataagctattttaaacaataaagaggatgctttcaagtaaatatcttagaagacctcagggggaaaatgtgaaattagttctttgtgaaaaataaatatctaaagagtattccctgtagggtacaatgtaaaagaataaactagctactggcaaaaaaggaagctgggggagaaaaaaaatatatagttatcaataagcccaaaaaagagtaaaatgaaatgaatagtttgtaacagagctaatgaaacacatatacttgtagcatattctgctaaataaaaactttatattgcctcctacatttaagcctctcataaaacagttgtgcatttttctaaaattgcttacaaattagcagattaaatgggccctttgcacattttaaaggcttgaggggataagtaggaggaaaacaattgttacagttttcacattatcctttctttctccttctttccccagccctttaagagaagattgcattagagttgagttctcaacactgattgttatgaaatagtaccaaattgatactaagtaagattacattggagttgagatcgcaacacgaattgttatgaaatattactaaattgatattatgtaagcgagcctactgaacaaagcttttcagctctttgaatatgaattttattttcattttttgacatgaactgggtatgtgacaaacataagcaatttataaattgtttccattgcctctctcatgagctagtttataccatgaaagactccacattcactgcatcattgccatccccagggtctctttcacatggttcagtgtgttagatgctatacttccaatgtggaaagacaatattctcaccccaaaggcagcctgacaaattacaaaatgaaggggtatttgagaaagagtatgttgtagccagtaatgcttgtaaaatgactcttttaaaaggtttgatggattttctcaagattcttcttttactgaatgacatgaaccaccagcattttaatcttcagcaaagccaaagcttaacaatccaaccaatatttctttcatttcttaatactatctaaggtcatttttaacttcatgttaattcccatgactcagtatcaaagtgagaatgatcaaaatgctagagggtgttaattgactggtaacttgaagagttgggtagggactgaagagctaggtagccgggtgttagcgattcaactcaacctaaaagtaattcccaagatgcattccaggaaaagggctataataattttaagttaaaccaattttttaaacagatttatggaagtatacttctatatatgttatataaagaataaaataataatttattaaagtatacaataaattatacatacttaaagtatacaattttataaattttgacatatgtaatactttaagaccattatcacaatcaagataatgaacatatctattttgccaaaaagtttccatgtgactctttataactcctctctcccactcataacccctctgtccataagacaaccattgatttactttgtgtcactacagatcagttcacattttctagttttaggatgacataataatatatgtacttttgtgaggtgtttttttttttgaatctggattccttcacttgaaataattattttgagattaatccattttgttgtgtgtataatagttcattctttttattgctaagtgatatttcatagtatgaatataccacaatttgtttatcttttcagttgttgatgaaaatatgagttagtcccaggttttttgttgttgttgttgttacaaataaaacttctatgaacattcccgtacaagtctttgtatagatatatgttttgttttctcttgggtagatatctaaaagtaaaatatctgggtcatatgatgggtatatgtttaaatttctaaaataaacccaccaaagtactgtatcagatatatgatttgcaactattttctttcagtctgtcatctgtattttcatatttctttataaacgagtttgaagaggaaatgtttttaatttgtatcaaatcacatatatcctttttctctctttcaaaggcagtaattttggtaggtatctgacaaatatttacctaacaaaggtcaaaagttttcttcaaaaagttttatagttttaggtttctcatttaggtctatgagtattttaagttaacttctatatatcatgtgagatctgaatcaaggcttactttcttgttgcataagaacacccaatttttccagcatatttgctgaaagactatattttgtccactgaattgcctttttgcatctttgtcaaaaatcagttgttcatataaataatttgtgggttgtttgtaggacttactattctgccacattaatctatttgcctatctttatgccaacaccagactatctcattactgtaattttaacatagctcggtatcagaaagttttagacttccaactttgttctttatcaattgttttgtaagtcctttgcacttccatatgaatttcaagatcagcttgtcaaactccacaaaaaaggtttgctaatattttgattgggattgcactttatccatagataaaaatgggaagacttggcatcttaacaatagtggctcctctgatctatgaatacagtatattcttccatttattaggttgtctttaatttctctcagaaatggattgttgttttcagtgttcttatctttcacatcttttgtcagatttatctgtatttcatgatttgctgctactgtaaatgatatatttattttaatttccagttgtttattgcttgcatataaaaatacaattaatttttacaagccaatcttatatccttcaaccttgtcaaactcactgattacctaaagtattctgacagggccaaatctaggataggcaagttaggtatttatctcagctgcaaaaattaagggaatggcaaaagtctcagtaatgaagagaaggtgttttactgtaattaaaaaaaaaatacaatctaaaaacaacagcctgtgggctatctgactgttcctgtaaattaagtgatttttttggttggttgtttctttggtatattccatggattttctacacagataatcaaattgtatataaagacagttttacttcttcctttgcagtcttttatttttttcttctaattggacagggcagaatctctagcataatgtggaatggaagttggtgaaagcagatatccttatttcacttaggaggaaagcatacagtctttcactatttagtatgatattagttgtaggctttgttgtacatacccttcatcaagttaaggaattttcctactattaatttgctgagatttttcccattttaactagaaatagatttttaatttcttcaaatttttttttctattgggtttattgagataatatattttgtgtgattatcactatttagtttataacatatgaactatgctactttcaaatattaaccctatctggagttcctatctggagttccttgtactctttctctaattgtggtatcagggtgttggccccatagaatgtgttgagaagtattccctctattttacatttctgaaaggtatgtatagaactggcactattcttttctaagtagtttagcgaatctacttgtgaagcaatctgggcctgaagttttattttctctaatgttatctattgtctcttgaataagcttttatagtttgtgtccttcaaggaaattgtccagttcacttaagttgattaattcatttacataatgttgttcataatatgatgtcattttccttttaatatctgtagaatctgcagtgatgttatctctctccttttctatattggtaatctgtgtttcttctttttgtttcctgatcagtctggctaaagtttggtcaatttttttcgtctccgcaaggaaccagctttaccttcattgatgttctctattttttttctttttccaatttcatttcttttccactctgatctttattatatcatttattttatttactttgggttcaatctgctctttttttagtttttaaaggtaaaaatgtaggtcattaacttgagactttttttcattttgatacatgcatttggtactataaatttccccatgaataatgttttatggcacaccacaaatattgacattctgtattttcatttccattcagttcaaggtactttctaatttctttatgattttttctttgatccaagggttatttagaagtctattttcggccgggcgcggtggctcacgcctgtaatcccagcactttgggaggccgaggcggggggatcacctgaggtcgggagttcgagaccagcctgaccaacatggagaaaccctgtctatactaaaactacaaaattagccaggcatggtgacgcatgcctgtaatcccaactactcgggaggctgaggccttgaaccgggaggcaaaagttgtggtgagccaatatcacaccattgcactccagtctgggcaacaaaagcaaaactccctctcaaaaaaaaaaaaaaaaatccaatgtgaaaatctctgccctttaattgcggtgcttagaccatttacatttttcatgagattatttaatggttaggtttaactcttatcatctatatactatatggattctatttgtctcatctcttttttactcctctttcttcttctttcttttggattaagtactttttattattccattatatattgattgttggttttttggctataactctttgaggctttattttagtgattgttttagagtatctttaaggtactcttagagcatctttgaattataaaagcctacctccaagtaatagaaaaatttacaaaaggtgttagaaccctagagcagtatacttccatctctttcctcccaactttcgtactatagttgtacatttagctttatgtatgctataacccccatattatcttattttttgtttaaacaacctattttcttctaaaatgagttaattaatgggaaaacatcatatatttacccatgtagttacaattctggtggtctttattccattgtgtagaaccacagtttgacctggcatcatattccatctgcctaaaacagtttaacattacgcagtgtagacctccttttattgtgcttgaaaaattatttatttcacttatatttttaaaaggtatgtggctggattttgaaatctaggttaatattcgtccttttctttcagtacttttaagatgttgcccctctgtctcatagcttagattgtttctgacaattaatcacactagtaactgttacatgtgtttttctgtacagaacatgtctttattctctggctgcttttaagatttttctctttatcactggtttgattaatctgattacattactgcctggtatagttttcttaatgtttcttatgcttggagttgatgaagtttcttgggggtttttttggggaggggtgttttgggaggtttgtagttttaggcaaaactggaagctttgcactattatttcttgaaatttttttctgtatttccacaacttccttcagggactctaattacacatatattaggccacttattgtcaccagctccctgatggtatgtttacttctctctctttctctgtttgcgtgtgtgtgtgcgtttcattttggatagcttttattgttatatttttaaggttactaatcatttcttatgcaatgcctaaagtgctgttcatagcttccagttacctttcatcttattcattgtagttttaatttctggaagttttatttagctcttttatctatcttccatgtcttagctttttgaacataaggaatataattataacagctttattgtacttgtctgctaatgctaatcttgtcacttctaggatggttttaatctataaattttcctcctataatggcttatgtttttctacttatttacataacaggtaattttttattgaatgctggatattgtgaatcctaccttttttggtgctaggtatttttgtattcctataaatattcttcagctttgatctgggttgcagttaagttatatggaaacacgttgatcctttcagatctcacctttaacatttgctgggcatgaccaaagcagtgctcagcctggggctaattatttcccaatacttaattaagagtcttatttatattctattcaatgcttgtggtcatagagttttccagtttggctggcaagaacagtcactattcccagatatatgtaagaaccaaggagtagtccatgtcattcctccttttttccagtctctttgtttactcacatgcatgagctgatctgtactcagtgctgcatactcaagagaacacctgcaggtctctggaattctctttatgtagctctctgctttctgtactttatcttgtgaattctagcctcctcaactcagggcctggggcaagtcctttgttttctatctctcagtgaccactctcctttattgcctgatgttccaggtcttaaaagctgttgtttcatgtatattctaagatttttgttgttgtttccattgggaggttaaatccagtctccatttccatctaggatgcactaacattttattttaaagaactacgaatgtcctatgtcaagaaaatacttggctacatggagccgtaaactaatcacagaactgtgagccatattacatattctgattcattttttgctacccttgttttgtgaaattaaatatattttatttttttctttgcttctatgctgataccaagaaaagaactcactatttaagtgttttaatgagaagctgtgaagtaaaatgaatgaatgatattaaagcaggggagtataataaataaaacattaaacaaggagtccaaaaacttacatgatataggacatataatgaactcaaattgaaggaatcactgaaaaacatatttagtgagttagtgtttaatttttaaattggtaactatttctgaaatgaagtattttgtataaaaccactagttcaccaagttttgaaaatcaattgggcaatatactttaaaagctatacacatgctgttacctttgacttgccaaatctccctttcacaacatacaaaaatattattttaaaagtagggataaaaaccaaatgcataaatattctatgcaatctaatttatggtagtgaataattaccgtgtgtcaaaatgttatatgtaatctttcaaaatgtttaaactatctctgagggtcacacagatgaggaattgaggctgagagtgtcataaaaagcaagtcagaggagatgttgagattcaaatctgttctgactctaagccctctgcctttagctcctagactacaactctagaaaaacagaattttgttaggataagtgggcatggatgtttttactcttaaccactcatattttaaatttccactactattatgatatattctctttttttgtaaattagaagaatatttttaaatgtccacaaaataatgtcactagataatctgagttaaaatttgtcccgaattttggcaaagaaaggaggatgggatgtaagtatatattgactctagaattcatgaatatcagaaaatcactacgtaagctctagcacaaaaaaactgaacggtttcctggggatacactagtcttcccttcaatagttgcttcagcagtttcctaatttatttaaaataaatcagcatgggactgtgtagaaatcaacagaaacaaggacttgacaagctcaaaaaatttcagagggaacaaaggagaagtcccttcagtacagagacttacatttctctttgtgaatatcctctttggggtacaaggcaaaagaactaaggtgatgttcatgctctcgacgttctttgataagtaacaaaagtaattatcttgcactagccattgctggcctgacaacagatatagtttcacctgttacaaaattttatttttttaaacgagttgtctgagtgacaaaaatccccctatttctaataagtgaaacttaattataaaaacttcaaagaaatagaagcctacttttgcagaggtagtcttcgtggagatggcaagaagactgtacaagggctctggactaacgtacgcccatcaagtaagcaataagcatcctcctcgcttgcaggacacctaaatttgactcagttccctgattccgccattttggaatacagaatttcagatgaggccaggtaacagctcaaatccaagtccaaatggagtcccactgacactattttcaatagacagctacatccttgcaaagcattaagagctgggcataaaatatccttagctgggattaacagcaaaacaatgcttggctgataacatatcttctttccttgtcagatcatttgttttcttttttgaaaatttatatttaagattgcccacttaagagagttggaataacacatattcttaatttctcaggctacttagggccaaatgaaatatttcttcaaggtgtaatggaaagccttcctggcctagtgctttcactcactagctgtgttacccaagacagtcaatgcaatatctctaaatgtcagtttcatcatatgttaaaatgggaaaaaaaatctctgcttcacagatacataaagcccttagcacagtgcctgaaacatatgaaatgctcttaataaactgttctgatataggagttttaaaaatatttaataatataggtcaagagccataaataacactggctgtgtatgtagtagaatcaattgatgaactttacaaaaaatacacacacatatgtatatacacatatacatatatatacatatatacacacacaaacatacatatatattcattgtatccacaggagatttctgaaatgattgaacagaatagggcctaaccataagtatcttttttaaagcttcttataaggagattccaatatccaaacagaatagagagctactggacataggttcttaaccggcggtccagaaactctttatagaatacagaaatccataaacttgggtgagaaaacatttagacttttatttttaccaatcttccaaactttggcatttttcaatcatgaatgtataaattaaaaataagggcccttggtccccaggtgagacagaatggactctttgtgttcaataagataccaaattataaaggagacctaacggcatgccaggcaaaggtaaaaacaagcacctctgcacttgaataaactgttctcagtgccacaaggatccttttttctttttctctggcagttaaacaagcactggcctcaagataagcaatataaaaacaattatagctcactgatcaccagatgctgaccgacttcccctcttccacagtcataactacagatttgattggacaagagatggattttagcaactttctcctaataagggactacaaaccatcgactggttctgcccagtttacagaggctgtgcactgagtgccttcatgtctctgcttcaccttttgatgtacacagcccaactgtaatacattcaaatgttaagtctccactgcaaagtgaacattgcatgtatataacatgcatgtttgttcagcacacatgcattaagaccccttcatgcatattcatagcttctcctataacctaatatgtaacttaaatgttaaggccccttcatgaatattcatagcttctcccataacctaatatgtaacttagatgttaaggtcccttcatgaatattcatagcttctcctataacctagtatgtatacttagccaaccccttcaccataaattcctgtctcacctttcttcccttgaagtttctgtctctggttttggccagaaacctgcttcctagcccacaggtagtaatattttctaagtattactcctttctaaatgtataaattgtctgattttttttttttttttggagattgagtttcactcctgtggcccaggctggagtgcagtggcataatctcggctcactgcaacctctgcctcctgggttcaagcagttctcctgcctcagcctcttgagtagctgggattacaggcacctgccaccatgcctgactaattttttgtatttttagtagagacggggtttcaccatgttggtcaggctggtcacaaactcctgacctcaagtgatctgcctgctttggcctcccaaagtgctgggattacaggcatgagccaccacacccagccaattgtctgatgtttttaagatgacaaatgcaataaaccatagtggcactattgatatctgtcactttggaccaaaagaaatcacagaaaatcacagtagagttgctgcagaaatctgaagtacttatactcaccacgacatcaaaatttgagtagttattagacccatcactagattgttacttagtgccttaataaaaaaaatacattactatatcgtatattttaagtgagatagtgagaatcctttgtaaccctatgaattttgttttatgccttcaaaaatattctggaaagaggctcccaagcttcgccagagtgcctaaggagtccctggtacacataaaatgttaagaactcaatatttagaggctatttgtcagtaaagcaccttcaggagtgctgatgtagatcaacttctttggaatcactttgaacccaatgtgtacaatgctgatctctcagtaattaaccgaggaagtgttttttacagaaatgaggtgtattgtaatagatgtatatttacatatcaattgttcttccttattaatttctctaacaaagccatcatttccttttctatcttcactacctgattcactgctgaagccctaccttctgcttcctactttaactgccacaaatgataaaaaatttcagtctttgcttcctaattcagtgcattcaaagtgcagcatgtattttttgttaaaaaaaattttccccggcccaaaatacatgattcataaggcgtttgcattgagaataaaaggattcactttaaactgacttctgcaagccctagttattctgcacatttaataataagcattacaaaatctcagcttaggaacaaaaagctcttagtcagtaataaattgtcactacaatgatcaatgtgccaaatttaattcacagataaataaaaggaaaccttgaaagccaagcagaagtctagtgtgaatgtaggctttggtataactgtgacaattcagagatgagccctcacaatatatttcagaggtctctctgcctttacattcaagaagttcatcagccatctcctctggttcatggtcaactggtgctcaccctctctggaaacagagacattagctactgatattagctgacctatgtccacacccagcacaattctttttatcagaaaagttagcttttgcttagaagctgccacagtgggttgaattgtccagtccctgtcattaaaggtggcagccatgcactcgagaatgatgtgaaaaaactccagcaagagtgataattaaacttggaaaatgaagggtcaccttctttcattcagctcattgggcaaacccatcagaataattccaaaacagcgggggactgtctactctcagcatggcaatatcgaggtgcacacacattatttctatgggttcaaatgggaatgccattttaatggtatttaaaacgttatcttcgatatgaggagtaaaaatgttagaaattagttctaggaatacagaaaaagaatgatgtgtataatctaaatagggaaagaatcagaaacaagaaaagtatgcatttttttctcaagaaaaagcattctaagagaagaaaattatctccagggaaactgaaaagaatattaactatgtctcttctttctactcaactgtagaatcacaaggcaagggtttcatctcagctttcttgtccacttactgtcatttcttggtggtcattattacaacaacttactcctacccaaaaaagagaaaaagtgtcacatgaagttaagacaatccattggtaggagttattttccaggaaaattttttttttcagacacattagcttatctagatactattgaatcagtatttgggaatttatatttcataccattctcatgttgcattaaaatgtaatactagaacagtggcttacacctgtaatcccagcactttgggaggctgaggtaggaggactgcttgagttcaggagttcaagaccagcctgggcaacatagcgagacatcatctctacaaaaaattaaacaattagccgggcatggtggcatgcacctgtaggccttaggaggcttaggcaggaggatcacttgaacctagaagctggaggctgcagcgagccatgatggcgccaatgtactctggcctgggcggggggacccatctctagttaaaaaaaaatgtaatactgaatatttaaggacaacataggcaaatgcactggatcagaacagaagcatggatggtaaaagcaaatttcaagttcaaattctagcttcaccatatattaggtgtgtaacgattgatatggtatttaatcgctgtgtgcctcagtttcctcatcagttaaatagagaaaataatactacctatcttataaagttgttcaaaaagatcaaatgagcttaaaataaataaaacttttgtaactgtgcctagcacagagtgagtgttatatcagtgctcataatatattataaccattattattatgttgcatgttcagtacctggcagagtatttaatactgtagatcaggtttacaaacatattatttctttttatagttgatcttttttttttttttagtccttatcattctgagaaaggcttcccaaaagatgtgggtcctttaataaacaaatagctcagcataattctcatatagagttaattatataatatgaaaacagggataattttcacatcaagctcaggaagagaaaaatttctaataagcagaaactatagattttagacgggtcacgatagttcccttcacatccaaacgactatcttgaggaagataaattatatttgtcctatgtgcatgtattttatttcaagttagtattttattttatttcacgtattttatttcaaatgcatgtattttatgtcaagttctatgtgcatgtattttatttcaagtttattttatttctatgtgcatgtattttatttcaaaattatcaagagataattttgaaataattagagctgtctaaaacagaaaaaaaacttgatgggcaaggcaatcatgtgatttctatattcctttgtaagaatttgcaatttatcagtttgtagacaaacatccaccaatttcaatagatttaaaaatatttatcattagtatatttaagtgttgtcttttgtctttgaaagacatatgtaggtaaaaaaatattttcgatgacataaacccacacattgcctcaaacctcaacctccattcactaacaattcattgaaagaaagaatgaaagaaagagaaataagttgtgtatatttgaaagagacagagaattgaggaggagggaggggaaaagagaggaaggatgagagagagaaagaggaagaaggagtaggaaaaaaataggaagtgggagagggaggtgggagggatagggacaataaatgaatgacattaaggatcaccctaatcagactattgaagagaaaatattatctattatattcaagcctgattttactgcaatatttaggcatggttctttaagagaaaaaaaagattttataaaagatagttgactaatttagtataggagtgttaaaattatttaataaattatttcccactgaaaaaatatagacttcataggaagatatgctgcttctgcctcaggtttatatttaaaatgatttatagtttacaatttcttcctaaggtcatcaccttcataaataccagccacatacagtgaaaaccaactcaataaaatgagtatttcatttctcttccttctgcttatgtagatacttcttccatcttacatggcacccatttataacaaagcttcacattgtgtgggtttttatgagttcttgagcttttctttcttttttatctttctatgcatcagcaaagcaactggcagattctttaataaaatatacacattaatatttataagcctatgaattggatgtttaaataaacattcaccaacttatgccaattctcttgttttagatgttaaatcacacttacgttgtctggaaagtcagcctttagttcagtgacactttgacaccaatatgcagccgttttctcactgatgagctcaatattcagaaaggagctttgtccagggccatacatggggccagaggtggttccccggatgattctgggggaaacatttgtcacaatgtcctgatgaaagagtaaagatattgagtctccttttgacaaagaaaagctataatctttattatctgctcatttccatatgacaatattttatgaggtcccttctcacatttttgcagaggaatttttaatatacattaaattagaattgaacataaactacttgcaaataaaaaggtaaaataaagtatttgttagctttagctaaattacttcttgtaattctaggtttagaatagcgcaaaaataaaaatatttatattcattaacactcatttagggcatactcattttaatttgtttgcaattaaataataaaaatatgataggtaaaatgcaaaagtttatcatttctgtctatttaatctaggtatctccaatcatagtttaactccaataagaattaatgttagtaaaaagtttatattttttttttctgaaaaaagtaactccgatgtaaatcagtgaaggaataatattagtattactggctcatcaaccattaacacacattctaataaactggttatgtgaaattacttataggattataactatatattcactttaaatgagaagaaagtcactttctccaagactgaaatgagtatatcaataacttcctgatacctataaacagtaaacagtaaaattaacttgcttgttaagtgtaattaacaatccacaactgcttctaaagctgtattaacgaagaagaataacattcttccattacttaaaactaaaaagaaacaaagaaggaaaatgtttcttttgccaacttccaattaaaattaattttgaggaaaggtcatttagttaaggatttatcagaattagtcatttaagtacccctcctcaccatcttgtcacttttagtaagataacatgaacccccattagtatatagcaattaaggtcaatttacatattttaattaagaaccaccccatataaaacaattagcgtaataggcatactaactggatttcataacatttggacgtttttccaactagatagacaggaaaccttaattagcattaattagtgctgatctgcatatgtttgataaggcatacccttgccacaaaagattatttattcctgaatctgccaaatgctacagttgcagaggataaaaggacttttcttcacattgcatgttaatttctggtaatttacattcacttttacatgcgaattagtatattataaaataaatggtataaatgttacaataagcctccttaaatatgtacattttaacttataggaatcatgccagttaattttttactaattaagccattccatttctattgtaattgtgtgcaacatcaccagccttgctttgatttgctattgtgaaaccatgtttcacaatcctaatgggtaaaatgacaaatagagttactccacgaagctcaagccttgtgggtcaatttccatcttggcaaacgcttaaatgtatgttctacgtccctacaggtggctctgtgaagctcatccagtgggtactccggtgttttcatggtctgagaaggcaattcttgaaatatttcactcagatgaggctggttttcttctgtgttccaattttcaagagccataccctttaaaccttgagatcctcctttcctctgctttactccctactctaaatgctcttcacctaagtaagtccaacctaggccacaagttgttctctacacaggatttcttagccaaggaggagtgaagtctgtatttagttcaccaagtcaagtgccctggtactgtgttggtgagcaaataatggggcatctggttttgatgaccattttttaattcattggtctggaaacaggtgcttcctgcttattcaacaaaactgattcacgttagcagcatccctactcccgcccattctccatatcttcacttagacttcagttcctttgagaagtttttcttttctctccaactccattgagtcttagtaacatgctctgactcatgccaccataacaatatataccttcctcaattggcattcttactaccatttattgtggttgtctatattcctgactgtaccttccactacagcataagacttgtaaagaaagaaactatattttgtttactattacatgcccagcttccagcctggcctttagtggtgctaaaataaagtactgtatcttcaatgagtctagactaaaaccataggcactagaataagtcttgtcctgaggtatgagaaccaaagacatttattgctggctgcattctgctgctgaacagaccagtggtttgggctttgatatagtttggatgtataccccacccaaatctcatgttgaaatgtaatcctctgtgttggaggtggggcctggtggaaatgattgattgcatcatgggggagaatttctcataaatggtttagtatcatcctcttggtactgtcctcatgataatgagtgagttcttgtaagatgtggccctttaaaagtgtgtagcatctctcccctctttctcttgctcctgatttgtcatatgatgtgactgctcccccttccccttctgccttgattggaagctttctgaggcctccacattagcagatgctgctatgcttcctatagagcctgcagaaccataagccaattaaacttatttttcttcataaatttcccaggctcaggtatgtctttatagcaaaaacgggcctttattcaaagttcaggatttattactatgcttagatcttttcctgctagtccatttgtctagaattgggttcttgcttgcttcttctgatccttcagggacccctttttctagaactcagtacaccccctcccttggatagatccctgaaccaaatgctgtgatacaaagcacccactgctataggccttctcacgcagcctactgtgatgactccctgacagaaagcatgcttgaacttcatctcactgcagcttctaagaccttcctggttgctagttcttaactgctgggtatcgctgatctctaggatttaaatagaatgcccccattcagatacaatacaactaccagtcttttttggttcatgtggatgtgtattcttaacctgatccatgaccacctagggtatttcctagctaatgagcctgtccaactacagttgtcttttatgtttgtcctgtatgctaagaacacatcttaacagtatacataggaatttttaaaatatcatagaatataaaagacacagaatggaaatttcacctataactaataaggaaaaaaatcttcatggttcaggaattctaagctatatgctatatgctatttacagtaacctactaataaccacaaagccaacatctcacattagccaaaaggatcaataagctgacaatatttaattggaagactgtcaagaaaatgcttctttcttaagcatttccctcatcagtaatacctcaaagcctacaattctacctttaagaattttttctttgtgtattatgagttaagtttcttgttaatgttggagctggtttatttttctcttctacgatgtggtgttaaactgtaaatatagcataggaaagttatgaatgatctccttaatcaagataatgaacaggaagtacaaaccaaatcaaaggaaaatttatttgctttatgatagagaatgcttattcctttgtgttgatttataatagagaatgtttatttaaacaggtcaattttctcattccttaattcaaccaaagataaaaggtcctttataacttctcaaattacagatgcctactgttgtagaatgggttaactatctgaaaggaatttgttagcatcatagaaattcaacattttccaaattcaactaaagtgcaaaattccaatgtattcatccagtaataaatcggtaataaaaattttattctagattttctttcccaaattgtcatgtttgctattgttttgccaaaaacattctccactgaattgagacttttagaatttttaaattaagtgaaagatgaatgaaaacacatatataaccaattatctttggttatataactagagttagagtttaaataattggacaataacttactaaagcttttgacctgggaagactagaatttgagcatgatttcataagagaatattttgctttaatatttaatggctaagtcttattagcattgcttaaaggagttaatataacaaaataaacatattcaagaatagttagagtagagaagagttcattctctataataaaaaagacaaactgccatagctctcatcttcagtgcattaacgatattcagatattttaaaaacagatgtttatagaaaaggaagtgttaggtaatatctttgctttatgtaatattataactaccattataacatcaagtattagtgaccttttaacatttgaagtgatgataatgattttttctctatcagaaaagagatttaaatggtaagcggactgattatatttgtttaggttcatttacttgacctctcttattataaaaacttatgatgtttctatggttactactgaattaaaacagtcacaatggccacaatgaacacaaaaagaaaactttgcagaaatgtctgagtaagaggctagaaaaagaatggggtcaaacaaagttggatgaaaacaagaaataaaatttgcaaagtgaatcatggctacatataccatagtggatgaattttataaacatcttgttgaatgaaaagggcaagttctagaaaaatatatagaatatgacacacaacacaaagcaatatattatttagtgaaacatactgacaggataaaactataaatataagtaaggtaacaactaaaaataattcaagatagaagttacctcttggagtaggtagatgctggaggagaaattggaaatggtagagcaaggagggctttctgaaagtactagtgatatataattataaagaagctttactcttgaactgcagaaatgtggcagaatgagaaatctgttcaatgagttatgcagtagtatagtgtatatcgctatgagttgttgataaggttttatcagtttacttgaaaacctgtaactgaaatcgaagaaacatttgttttgttttcttaacttccaagattctgctgtaaatattttgtcaaaaatgttttaattatttggttttacaaactaggagttcaaaaattaaatgtacttcatgaccaactgtttcctaaaatatatcactttcctaataaaatcctactgagataagtacaacataaccatacattatttcacaaaagaggaaaatcactctacaaacaagtctaacaacaaatatcttgttacagagtcagattccatcattataaatctaacatactgataccctgtgaatagctaaaagtgaaataaaattcaagagtggcccagtttctagaacaattgcgctactatgaaagaactcactaacattttattttcttcatgaactaagtatattaatatttgattcctccacaaaataaactttataatggtcagaatactctctacttggttttcttggaggtgcaaagtgggcaagataagtatttgttcccaataaatcatatttttctcttgtagtagcttatataacgacagtactcaatatctgaattagtgacagaatttgcccttttgtcatcaggaacttcagacctatctacatggaaaacacaataagcaaaaatagcactattatcctagaaataaaagataaattatcagagaagttgtagcactgacattgtagaaataataatattttagatatgtatagcacaaatctgtcacatatatcagtcttttcaaattatcatgacctatatccatggttgcatatctagtaagcattcgagatgagactagaactcaggtgtgcttatgtgatatggataataataatgttgttagtgacctcttaacatttaatatatgtaataataattagaactcatttcagttgcaagaaaaacaaatcaacttgaataagttaaatttttaaaaaatggggtgttgtctatttattttaaggaaaaggagtatttcacataacacacacaaatatgcaactatacctcagctaggaatcattctgtgtctcctctctgcttctgttggcttatctcttcatttttctttctgtctctccacagagggctttctctgtctcagttcatatgatagaatatagctctctgacaagtcccaagtctacaagttgtagggaaagacactcctccaaacttgtaatctcttaggccagattttaacccctggtgacagaggccctaacgggcttaagctgcattagttagtcatcccttgtttaatgaactatgtctggcaggataaaattaattaggattcacacagatgctcaggtaaacaatgatggcgtaattgagagctgggcaactagtattataggaatctgtgacaccaggaccagtagatttaaattcaccttagaaactttagaagaaaatatacaggcatgataaaggataattatctaggaaaatggggtaagacaggcaaaataattatcatttagtgaaataaaaactctccatagtcttgaatcaaacatgatggtccatttcctattcctgtggcccaaaaccttgcaagatcaaaattctaagaatgctttgacattctccagtgttttagactacactgggactctctcattatcatgtgttagtgtgttgaagactgtcaacacaacatggcacggtgtgtacttaatctcagtcttggcctaggctgaactgatggaatggatagatactctacgtaagcagggaagacagtggaagaagtaggtaaggaagaacaaagaagagcacattgttctaaaatgaataagaaaaaatgtacgacctgattaggcttaaaagacgggaataataaatgaaaactgaccagactgaatgtctgctatatgccaaggaaggagttttactcacatattctccagtgctcacccaacaccaaatgttcctcacctcttggatagtgtgtcacatatataaagcatgtggtgtcttataccacagaaatatggagattaattttctgaattttatttatgtctgactgataaaaatactggctcacataatcatgtagccttttgtttttcctcttgccctttttcaaagagcttatgattttgtaaactagacactaaaagtggtttgttttgttttttgaccttctcatctgccgatccggataaccatcactctgtcacagagaagttgtaggatagtaaatgaagcaatacagcacatgactggcatgtggtatttgataaataaatgtttattcattcaccaactcactaggcttcagaaacagtcaaaacaaaagttgtgggagttcaggtgactggctttaactagttcacggctaaagctgggaaataaaccggaaatgaggatgggaggattaaatagagttgggtcagattgcagagtcctgaatgactgttttaaggagttcaaactttttctgcaggctttgagaatccattgtgttctgtctcctattcaagttattaataccaatagctcacagcagctgtgcattcacggagataagttttacaagaaacagatgaagggcttttttagtgctgatatcagatggattagaacgtgattaatcaacagacagactgattaaattattgggttcactgttcagataagaggttttggatacactctgccaaacggtaattaacttagaaatttctgctggcctgcttataagatgatcatgtgatatgctttgaagaaatcttttaaggcccagaatagcagctgtgaaggtgtaagcatgagtcagttttaacaattattaattatcttcaagtattagagcagaattttcattggaagtgataaatattttttaaaatctttacttttaagaaaacttgtgtaaatctctggctctactctacagtcgactgcaaatgaaatgactactatttaaaggagtatctaaaagagtcaagagaggagttttccatttctacaacatggttaacaagatattgaaaggaatcccttgcaatataacacatataaacctactggacaggatatgattttttctaaaagatgcatagctgtactggtatcaaaataaggaaatttctgagagatcagaaataagcacgaagcagagattcacaagggcaaactaactattgggtggtgtttaccctcaaggttttcgcccatccctggtggcctataaactgagttacaaacatctgagacagcagacaaagtctgggactgagcacgttgttaggtagagtagaaatcgccacataaatataggaccaagaaagagtgatgctctcactagaaaataactagagagcaatggcgggtcatgcgtcagtttcagctttagcaatcaaggaggtaagtctcttctaagaatcttaacctgtgtgagccccaaaatttaaactgcgaggttaaaaatttggtttaaaagtggttcctagtcatggtgtccttagataactagtaaaagcaatctcagaccctctctgaaagaatttactttacctcaaatatttataaattcccataaatacattttcaaggaatgtgagcccacaagagaagaaaatcactaatgacatgagaaaaaagatatcataggtgggagccagtgcaaagaaaaagctacaaaatcagatctaccaaaaaatgtatataatgggattatcagatgtaaaatataaaaaaattaatatgcttaaaaatacgagagacttgaatgtataaataatgagaaactcaaagtttatcatgaagatataacatatgagcaaatagaatttctagaaataaaaaaaataatatggaaaattaaaacctaatggtttggggatgatatgatgatatatctgggcaagttacctgaaagcaaacaaatgtgatgcaaaacatgatctagaggttaagagacatggagaatagcttaacaaggtaaaggaaaaatcaaattgcagttcacaagaagcaaatggagagaactaggagaggcaccatttccaaagatattgtcaggggtttaatagaattgatgaaggacaccaattcttagattccagacaacaacaaactgaggaaaatacgttttttaaagaattgatatctagatacattgtagtatacaagaaagggaagaattaaaaaataaccagaggaaaaaaagactactcacaaaaataaaaagcagattgagagctcacttcttggcagtaccaatgaaagccagaagagattagaatattttatatgaataagaaatgttaactgagaattgcataccttgtagacttataactcaaggataaagaaaaaatgaagacatttccaacaaaaggaattgtgagcaaatagtatatggtagagaaaattaatgaactaatgctaattctgcaactaggattgatgtgaaaaaacaaaatattgaacaataacaagaaaaaagcaagctgtgtaaaaatataaaggtgtgattatgtttatatgaggcaaaaaaataaacaaaactaaatagtacactgtttagaaatacattatgtgaaaaacatacgcaaaagcaagaaaatgattatcataaaatctaaaatagtcacctttcgagggaggagaaaggaatataattgaggaggcacaaacagaatcaaaggtacaggaatatcttatgttctcttcttctgtgaaatgagaaaaaggtattcatttttactatatcttaaactatataatttttgtagtatgcaatttttatagtaaaaaatgaaaacaaacttattaagcagaaaaaaagcaggtgcaaatctgaagataacagtgtttgataactctaagattgtatgttttgcctcagtattactgcctctgttgtcatatggttctgaatgatgttttagaaagaatattgattctagtcattccactaacaaaatgatgagcttgagcttgtattacatgatcctttgggattacagatcccttggtggatccctaatctaccactgatgaggatttcagtcatttatctatacaactacaaaacatacaacatgggaacatttcagattggagatactgctatctgaaacccttggcacaaatttatgatttagaggcattggggctcaaaaaaacgacaccctgaagtatggtgcgttgatatgctgagtactttgaactaaaggaatagcctcagaaccaaggtctctctggccttctcccagcccccatctcttgttctttctttcctgaagtgcagggagaggccttctcagaagtttcttttatctgactaaaggaaattcttcctgaagaaatgtcattgtcctgaactccttccctggaatctacattaaccagtcaagattaactccttgcaaaagaagagacacggccaggcacggtggctcatgcctgtaatcccagcactttgggagaccaaggtgggcggatcacccgaggtcgggagttcaagaccagcctgaccaacagggagaaaccctgtctctactaaagtacaaaatcagccaggcatggtggcaggcccctgtaatcccagctactcgggaggctgaggcaggagaatcacttgaacccggggggtggaggttgcagtgagctaagatcgcgccattgcactctagcctgggcaacaaaagtgaaactccatctgaaaaaaaaaaaaaaagaaagaagcgatcacacttacacttttcacctattcttaaggctactacctgggacactttatctgcatataaggcaacctttgttttcagttcagttccttctttcacccttctattgcttgtgctgccacctcccctcagaagccccaatcccctacttcattctgtagctcaaaatattatttatgcttccacaatttggcactccttagagtctcatattttgtgggacttccgtatatatgaagttgataaatttgtatgccctttctcctgttaaatctgtctactttcaactttattctagagattccaatcataaaaactttggaaaacagagggaaagcataaaacttccctatagaggtaatttcaaactcatattaaagtcatttcgggcaacacacacctctgttttggctaccttagggaaccttcctcaccaatatcctactgactaaaatggaaagaaaaaaatgaggaggataaaaagtttgtttctgccaagaatctatgaaactattcagctaatgaaaaatcatttatttgagcatacatacaaagtcaaactaccctaaatataagataagcagctatgcgatataataattaaaataataaaatttgaagtctgttttctcatcattctactcaatagcattctttcatatattaggccataaagatgcttgtattataattacaaaacaccattaaaaaatgtattatgtcctacagcacttagccttaacaaacaattactggatctcacattcaactgaatacaaaaagcaatctttatcacaaggttaaaattagccttggaacaataaatgctttcaaagctattctaaactccaaactgctttgcaccagtctgttttgaggaactgaaaacaagtaaactgaaggacatttgaaaaacttcctgtctgtgtcctctcaattttttttttgtttgtttcataggagacaatcatgttatacctgaaaggtgatccatatggccctcacagggtaaggtttcagaagttaaaatcaaaaccaaacaaaaataattaaccaagtaaacaaagaaaccctgagaattctagatttcacaatgtgttattcataatagcactctaattatcagcactacttttcagccattactacagaaaaaaatgaataaatttgattcacggaggagggacctgaaagcaaatggatttgttagttagttcaaacccagaattctgagataatacacttctcagttcatccttcagaagacaatatgatatgtagaatttcatcatttaaattacttaacaaattaatcagagtagcttctccttctgtaaaaggtgttgtaaactaaaaataaaattctaagccccccaatcatatgaataggccccctcctctcagtcaagggcattgcaaagttaacctgaaaaactagttcagaccatgatgggaaggtggggctggacatgcctcattctaccctcctccttttgaaattcaggcataactgtaggtattaacattaaaacagagatcttaagactgatgaaacaaactttttgtgcaataagacaccaaattccagcctcactctagtacagcatcacataacaggctctgaaaggaattgaagtattttaccctaaactatatttctttaacatattttgaaatggtcctgcaaagttgtctcttgtggggaaaatctactttctgtagagaatccccttccttttccaggtcttttccctgatctaggagagaattaactaagagtctggcatatttttaagtctgacaaggaacatttacaatctattctctctgtagcctgctacctggaggcttcatctgcataataagaatcttggtctccataatcccttatcttaacccagaaactcccttctattgattccaagtcttcagataaactctttcaaccaacttccaattggaaaatctctgaatctatgacttggaaccctcccctgcttcaagttgtcctgcctttctggaccaaaccaatgtatatcttgcatgtaatgattgatgtcttatgtctccctaaaatgtgttgatataatttggctgtgtcttcacccaaatctcatcttgaattctcgaatgttgagggagggacccggtgggagataacagaatcatggggcaagtctttcctgtgatgttctcatgatagtgaataagtctcaagagatctgatggttttataaagaggagtttccctgcactctctctttgcctgctgccatccatgtaagatgtgactttgtcctccttgccttctgccatgattgtgaggcctctctagccatgtgaaactgtaagtacattaaacctcattattttgtaaattgcccagtcttgggtgtgtatttattagcagcatgtaatggactaatacagtaaattggtaccagtagagtggggtgctgctgaaaagacacctaaaaatgtggaagtgactatgaaactggatagcaggcagaggctggaacagtttggagagctcagaaaaaggaaaatgtaggaaagtttggaactccctagtgacttgttgaatagctttgacaaaaatgctgataatgataagggcaatgaaattcaggctgagatggtctcagatggagatgaggaacttgttgggaactacaggaaaggtgacttttgttgttttagcaaagagactggcagcattttgcccctgccctagagatctgtggaactctgaacttgagagagatgatttagggtatctggcagaagaaagttctaagcagcaaagcattcaagaggtgacttgggtggtgttaaaggcactcagttttaaaagaaaaacagagcataaaagcttagaaaattttcaacctagctgggcatggtggctcatgcctgtaacaccagcactttgggaggctgtggtgggcagatcacttgaggtcaggagttcaagaccagcctggtcaacatggtgacaccctgtctctactaaaaatacaaaaaatagctggatgtagtggtaggtgcctgtaatcacagctactcaggaggctgaggcaggagaatcacttgaacctgggaggcggaggttgcagtgagctgagattgcaccactgcactccagcctgggcaacagagcaagactctgtctcaaaataaaataaaataaaataaaataaaataaaataaaataaaataaagaaaagaaaattttcaacctggcaatgagataaaaaagaaaatcccgttttctgaggagaaattcaagctgactgcagaaatttgcataagtaacgaggagccaaatgctaatcccaaagacaactgaaaaaatgcctccagggcatgtcagagacctatgtggcagcctctcctatcacaggctcagaggtttaggaggaaaaaatggtttcatgggccaggtccagggtccctctgctgtgtgcagtctagggacttggtgtcgtgtcctgtgccccagcaaccccagccatgactaaaatgggccaaggaacagctcaggctgttgcttcagagcgtggaagcctcaggccttggcagcttccacataatgttgagcctgcaggtgcacagaaatcaaaaatcgaggtttgggaaactttgcctagatttcagaggatgtatggaaatgcttggatgcccagggcagcaaaagtttgctgcagggacgggaccctcatggagaacctctactagggcagtgcagaagggaaatgtgacatcagtgccctagagtccctactagggcactgcctagtggagctgtgagaagagggccaccatcctccagaccccagaatggtagatcctccgacagcttgcaccatgcacctggaaaagctgcagacactcaacaccagaccatgaacacagccaggaggagggctataccctgcaaagccacaggatggagctggtgaaggccatgaaagcccacctcttgcatcagcatgacctggatgtcggacatgcagtcaaaggagatcattttggaactttttaagatttgactgccctgctggatttcagacttgcttggagtctgtagtccctttgttttggtcaatttcttccatttggaatggctgtatttacccagtgtctctaccctcattttatctaggaagtaactaactttcttttgattttacagcctcataggtggaagtaacttgccttgtattggatgagactttggactgtggaagtttgagttaatgctgaaatgagttaagattctgggggactgttgggaaggtatgattggttttgaaatgtgaggacatgaaatttgggaggggcaagggctggaatgatatggtttggctgtgtctccacccaaatctcatcttgaattcccatgtgttgtgggagggaccctgtgggaggtaaatgaatcacgggggtaagtctttcctgtggtgttctcatgacagtgaataaatctcatgagatctgatggttttataaaaggagtttttctgcacaagctctctctttctttgcctgctgtcatccacgtaagtaagacgtgacttgctcctccttgccttctgctatgattgtgaagcctccccagatatatggaattgtaagtccattaaacttctttcttttgtaaatggcctagtcccgggtatgtctttattagcagcataaaaatggactaatacatgtgtaaaaccaagctgtagctcgattatcttgggcacaagtcgtcaagccctactgaggctgtgtcatgggcaggctcttaacctcaccaaaataaacttctaaattcattgagctcaggagttcaagaccagcctggacaatgtggggaaaccttgtctctacaaaaattagctgagcatggtgatacatgcctgcagtcccagctacttgggcggctgaggtggcaggatggcttgagcctgggaggaagaggccgcagtaagctatgattgcaccactgcactccagcctggatgacatggagagaccctgtttttaaataaatacataaattgattgagacatgtctcacatacactctggtttacagtgtaatcaaaattataacaaaaaaagttggcaaatagaaaatctggatatatacgcaaaatattcttatttgttgacctaaaaataaattgattcctgcagaaggttctacaatcaaaatcttcctatcactttggttaaaatactgattgagaccctatcactagcttgctgaagtagctttgcaaatcattagatggttataaggaacatcatcatggtggcagttttcttttcggctgtaatcacagtctgacttcacgtgtatattcaaaattaattaagtagcaacagtaacaacgacaacaaatacattttaagtaacaatcgagtcagtcacttagatgcctgtctcggtgtcaagattgataaaagcatctccaaatgatagctgatatttttatagtgctctataattatcatttgtgcttttaaacatgcaataaaatttaacattctgaaacatcctatgaaatgagagaacctttttcaaaaatgttctttgaaatatttggggctaaatgggaagttatgtgaccacgctattttggggaaacaccaaagagacctccttctggtgattcacaaggcatctaagcatattaaaggccaccaggcatccagtactaaacctacctgcctaattttctataatccattatctttcaaaccttttggattctaaaagtttttcatatattacccataaatataccaaagaactctaacattttacagaaaacaggttattgagatagagaaagaaccccctttaggggcctgcagtggggggtggagggtgggagcccaagcatggaaataaaggaaaaacttgagatcctacaagaaaaattccaggcacctagctagccttgagaagtaaataagcaaattgataagcaagaaggtaacagtagcttaaaacaatagccaaggaagctataatcacaggatgtttcgttctctcatagaaactaacgataaaatatgtctctaagttgtttttcggaaatctgtacctccaccgaatggatctgcctgcaagcaggcctcagataagggagaactaagggctgaactttgaccaaagttctttgttctgcatttctttctgaggtacctagagaaagtcaaacccaagagccagagctaacattctttttgctcaccacaaatttcaaaacaaagcttctcttccttaactgattgcaaatcagaaaacatctgaatctacctatgaactgtaagccccctgcttcatgatatcctgcccttttaggccaaaaccaatgtgaaacctccatgtattgatttacaattttgcctgtaacttctgctttcctgaaatttacccctgctttaaaaaatcctcatctgtaagccatcagggaggtcaggatttaaatgtgagttgcctgatcttctttgcttggtgccctgcaataaatgcttcactctctctcgctgctatcaggttgtcagtgtttgtccttgctgagccaggtgagcaggcttctgatgtatttacgtaggtcaatggtctctaaaattatttgatcatgtactccatcaacaaagcaaacttttgacctgcatctccaatagaacatttagaaaaatagaaatcagaataaaagagacaaataatataaatattttcaaactttcttgccatatcccaatgctttagggatatctgaacccacaatgggcactgaacaagatttttctggagtgcaaaagaagggaacagatctagaaaagaagctatttagtttggtgcaacctcataaaaatctgccctgacaagagaagactgtccagagcaggggttgacaaactcctatggtaaagagtcagatgataaatattttagagtttacaggcactataatctctgtcacaactattcagctctgctattgtcacaggaaggtagtcatagacaacattactgagtgagtgtgtctatgttccaataaaaaattatttatggacactaaaatttgacttccatatgtatatatgtattaatcagttgttgctttcttactgctacttacattaatttcatactattttcaaatgtaacaaatcttctaatttatttccagccatttatactatggtctgaatgtttttgtcccttcaaaattcatattttaaaatttaattatcaatgtgatagttttagaaggtgggcattttagaggtaattaggtcatgagggtggggtcctcatggatcagattagtgcccttatagaagagacccctagagagaccccttgtcctttccatcatgtgaggacacaggtagagggcatcatctatgttaacagaaagtgtgccttcaccagacaccaaatttgccagtgcgttaaacttagacttctcaacctccagaactgtgagaaacaaatctgttgtttagaatctaacccatctatgacattttgttatagcagcccaaatggactaaggcaatttacaaatgtaaaaatcattcttaactcataggcagtacagaaacaggtgggaggctggatttgacccacggggctatcatttgcagactccttgtcctaagaatgaaggagtagattaaagaggaagaccaaagatgactacagagggtgagctgaaacaccgttttgattttcctgctaagttttaaggatgaaggatgaatgattcagtttcttaaggttaggagggcataagtcttgaatttatttataataagtagcagtaagaaatcagcagctagccaatgcataataatggattccaaaaaaattagtttccttgaaagagttcaaaacattatttaaaacatgattgcacttttgacaagtttttaggaaactccaaaattatcagagctggctctgtgatcctaatggccctctgtagatagtcaccactaatgtttatcagcaggaattatttctgcaaaaatggtatgaaaggaacagccatttaatatatccagctcattaggaacaaatatagtcctaatatctgtaatgtttgatagcactagatataattattttcaaatttaggtgagggttacacaaacatcataggtctccagaagccttttatctgataaatctaagtgcaataaaacctcatggctctgataaccaaaggctaaagaatgagtgatttatatacactgcagccttccagaattccaacttgttagctaaaatagctctaagggaagctaaaattgcaaaaaaaaaaaaaaaaaaaaaaaaaaaaaaagacaaataaataaaatgccagtatttcctcagaaacctttttggttgtagttgattttttaaaaaacagttctaatattactgaattttctggtagtgaaaatagaacaataggtataagcatcactgtttcatattagctatacagaagagtatgttgaaattcattcattagcatattgataagtttctgcttctctgataaaattaaactatactaaaggttcacaacttagaatgtagatactaaccataacaccatattatgatcttataattgggttacgatgtcttggatcaattttgtaatggaagtaatttcaaagtaatcttatttttttaaattgctacaaatctaatatacagagaaatgtgaaagattccaggtatctgaacaactggaagcaaagtatctgattgtttacttagataacatggaggatacaggctagagaaaaatacttaaatgattgtgtattcacatggaaaagtgttcctaatatataaaagccctcagccaggtcattttcatcgttcttgcaaataacaaatggatagctaaatagacttgaatatagacataagcagatcatatttgctaaatgtgttgatgttattgagaggaattaggaggtgctccaatggactgagggaccagattaagagatacaggtatatattgattctcataaacttcatacattccccctgcatttttcgaatcatttttttgatatgatggggcagtatggtgtattgtttaaaagagaatgaagtcaaattagctgtttcacatactgattcttttattttactatctgtgccacccagacaagtaaacagcctctttctatttcactttcctcattagtaaaatgaagatagtcagagataacatctcaaaaattaattgacacagccattaaataaggtaaaataaaaaagtgtatttagtttggataaggtaaaataaaggatgtttaaagtgcttaaaataatgtgtggcacaatacaaatgattattatgatttcgtggtcttccatgaattaacatttttaccctctctatggaagtaatatgtgcaatataatactgatgtatactttatctttggtgaatggatgctgggtgtttcagaggttgtatatagctgtaagcagtataactgcacgaggatactgggagaactttgatctttaggagggcttccaaatgctaacttgctgaagctgcccatgttagtgatacagttagacctacaaaagaattataagatttctgaactagggccaggcacagtggctcatgcctataatcccaacactttgggaggccaagacaggcagatcacctgaggtcaggagttcgagaccagcttggccaacatagcgaaaccccatcaagtacaaaaattagcagggcgtggtggtgggaacctgtaatcccagctactcagggggctgaggcaggagaatagcttgaacccaggaggcggagattgtagtgagctgagatcgcatcactgcactccagcctgggcaacaagagcaagacttcatctcaaaaaaaaaaaggtttctgaattagttatccacactgcttgatctggtaatgggaaaggatttgagctggagattgtgagtgcagaatgcagaacaacaatgcagaacaggtctaggccatacatcttttctgaaaacgtaatgtaagaacagagccttatatgcctacttcactgatgccattatgtataatgagatcaaacaagtttccctctaagtttcatatttcattgtctttaacttcaatatgttttaaaggggtcaatagggaaattataaaaacaaagatgggggtcccaggacagggaataaaaaaaacccgaaaaacaaaaacaaagagtccgggaaggagaccaaatatcttggatacagaatcaagatccaaaaagatgttgtgatggaccagagcaatggacttactttaacaaattaacatgtaacttggggtctaaaactgcaaccacacaactacaagatagagacagtagagtttatcagctgaaaacattaataaaacaccatggagcttatatttcaatatagtcaagacagaaatgagtattttcacagtaaattagtatgggatgtgatcgtcccactttccttttttttttttttgagacagttttgctctgtcgcccaggctggagagcagtggcacaatcttggctcactgtaacctcagcctgccgggtccaagcgattctcctgccacagcctcccgaggtagctgggattacaggcgcccaccaccatgcccagctaatttttgtatttttagtagggactgggtttcaccatgttggccaccctggtctcaaactcctgggctcaggtgatctgcacatctcggcctcccaaagtgctgggattacaggcgtgagccaccacgcccatcccgtccccctctttttcagagatgtttgaagtagtgccttcagtttttggcaaactagaaaactttaagtggaaaatgtaaaaaaagagacaggtttagagacttaaagacaggtcatatgagaaacagttaaaagaaacaagcatatttagcttggataaggaaaagagtcatacaaaaaatctatttttacttatctgaagaacagtcatagagagggagtttaaatttttctgaatcaccttaagatgggataatgtgcacaataattagaaactactcgaaagcatttcaattgtactttcaaacatccaaagctatttaaagaggcaattgccagtctctgaagagttcctcttaactaaagggtttgaggatagtgtagtagacacctactggattaactacccagcactccttttctgagaattgcctgttctctccttcacccacctggttgcagcctctgtcacaccttcatctcccctatgcacatcacttttgataggttcagaggcaacaacctgagaaagagtccatacatggttccaatttttagtacactttcttccttaggcaagttgctttactgttatttggatgtgagggacacctccgtatatttttcacttggatttcagttgtgcaaccaaaacaaaacttatatacatattagccagggcactaattgacagcaaattggggaatacagtaagcagatgatggccagtaagcctgtaagttcacttccaactgatactttgtatttgtgtgactactcacttttagtaaacatctatctttaaggacaagctttgggaatttgattataaaaccataaccttttctcaaattatattaacctaaatagccataatgagagaaaaatataggataaaatgttcccctaattatttactgaatttttaattgattttccagctttattgaggaataactggcaaaacttgtatatatttaagatatgcaatgtgatgacttcatatatcaaacattgtgaaatgattactataatcaacctaactgacacagccatcacctcacatagttgcctttgtttttttgtggtgagaatatttatgatctactccttttacaaatttcaaaaatacaatatatgccattatagtcaccatcctgtatattagatccccagaacatattcatcttaaaattgtaagtgtgtaccctttaatcaacatcttccaatttccaacctgcttcccaaaatctcctggcaactaccatcttactctctgcttctacaagttcaattcttttaaattccacaaagaagtcagatcatacaatacagtagtacttgtctttctatgtctggcttatttcacttagcataatgtcttctaggttcatccatgttgccccaaatgtcaggatttccttcttttatggcagaataatattccatgtgtaggcatacataccacattttctttttttattcattcatcaatggacacttaggttgtttttctatattggctattgtgaataatactgcagtcaacatgggagtgcaggtatctctttaaaaatggtcaaatgactcgaatagagattcttccaaagaagattcacaaagagccaaaaagtatatgaagaggtgctcaatagttccaatcaccaggggaatgcaatcaaagtcacaatgagctatcaccccacaccaatttggatggctagtatcaaaaagtcaagggacaacaagtattggtgaaggtgtggagaaaagggaatcctcatacactattggcagtaatataaactggtatagctattattgaaaacagtatgtgccaggcacagtggctcacacttgtaatcccaacaatttgagaggccagggtgggcggattgcttgagcccagtagtttgagaccagcctgggcaacatggcaaaaccccatctctacaaaaaacatagaaaaaaacttagctgggcatggtggaatatgcctgtagtcccagctacttgggaggctgaggtgggaggatcacttgagcccaggaagttgaggcttcagcgagccatgatcatgccactcactgcactcctgcctgggcaacagagtgagaaactgtctttaaaaaaaaaaaaaaaaggaaagaaaatgaaaaagaaaacacagtataaaagtttctcaaaaaattaaaaataggttaccgtatgatccagcaattttatttctgggtgtatatcaaaagagaatgaaatcatttactgaatttaaaaaagaagttaaatacttatgcaaggtaatcaaaatgacacaaagtctacaataaaatattctaacgatgaacaatgttgtttaccagaaatgcaattaatttgtattctaaatgtaaatataaatattaacacaatgaaatgtaaatgccaatatagcccattatacatactctgagtgtctaactaaacatatgaaaacataccaaagatatatttacaattagatacagatcaggtgttctgtcagacatatttcacatttaaaatttctggggaatgtctttaataatgtttaaatatttaaaatcctttgaaaagagagtttaggtattaaatcaacttaatacagacttacagattaatattactcctagtaattatatattagatgttctgaatatacttattaataattcatttaataacaacttaaggttcagtttttctgtcacagtttaagattaataaagaaacaaaaaataaatgataaacacagaagctatgtgttatttctatttaagaacaaacttgtggtggcatataatgtagaaaatgcatgtagatatttaattttggcattttgaatattcttcccaattttatttaatctgaatgagatatatgttataattatagcaaatgtttgatctaacttttatatagaattctataattaataaaatgcaattcagacataaactcctatcattgacttttggaattatgaaaaaataattccaacttttatctataaaaattatatcttatatctatgaaagttgctagaaaagttaagaaaatgtaaaaagaagaacacaggtcaataatatatgagaaaatgtaataaaggttaataatatgtattagcacacgtaataaaaatcagtaatttaaacagtatggttatgttacaagaagaaactgtaagaccaatggagcaaaacagcagggcaatgattgcggcatcatttttgtgggcattcattcatgtttgaatctgatatatagttaggctataatattaaattaatggggaaatatgagttattcatcaattgacataggataattgataatttagtgaaaaacaaagttaaatcatgatgatttgctatataccaaaataaactctagatatattaaaaacatatagataaaacagaagaagtagaagaaaacatatgttaacacatgcctcaactttaaatgttggaaaacttttaagtataaaaacagtgacaataaatgaataaataaatgacttaataaataagtaaaggaacaaattaatgagtaaaagaaaaatagactaaataaaaattcaaaatagagctagcatggattaatgttcttgatatattgggagaaaaggattaacggctgagttgtggcctttcctctagccctggggtagccaaattttatttgtaaagagccatttagcaaatacttactctttgtggatctgtctgtcacatctactctgcaactgtaacatgaaatctgccatagacaatataaaccaatgggtatggctatgttccagtaaggctttattttcaaaactaggctggtggccaaatttggcctgtgcaccttggtttgctgacccctgctctagcctcagagatgtgaaagacttgacttttggcctaatcctccttggcctaatcctccttgcaacaataactcaaaaagttaatacctgatccaagataaatcagagtcctgctgaggttacactctactcactggatacctatacattgttgagtttgattattaagtaatctataactaaggagatacagttacatcagaaaattaaagctagattcctaaccctgaggggagtcatgggctagcaaggtaacaaagagtaaatagatcccagagccgatggtttccctaaactgacagactacatcaatcagtccctttcctagtgaccatggaagtctatggtgcagaatcatctggggacactgaaagtggtgccagagccacatcactttcactttattaatactgtacctgctgtaacagattcatctcagatcctttttaaagacaaataaacttgatgctacatttctgggttggactatcaatcaaaatccaaaaataactgctgctgggaagagtaaaatatatgtgtgattataaaatgtgttcaaaaccaatgagaaaaagatgacccctttagtagaaaatgataaaaaatatgaacaattcacaaagtataaatttatatgaaaaaacaaagcaatgaaaaatgtttttaccttgttagtaatcagagataaaatgatccaattttatacttatcaagtcagaatttaatgataaaactatgcactggtagcagcataaagaaataagaatctttgtgaactgttagtagaatttacactggaaaacttgaaagtaattaggcaataggaagtaccacaaaatgtactttttgaactacaatcccagttctaggaatttatttcataaataagtcatagaacgtataaagatatgtgcacacagataccatgtttagcattatcgcaacaaaaatactaaaaaaaaaacagcttatatgtcaactacaggcacacctaggagatgctgcaggttcagttccagaccatcacaatcaagtgaatattgcaataaagtgaatcacacaattattttttgtttcccagtgtataaaatatatacactatgctgtattaagtgtgtaatagcattaggtctaaaaaatgtacattctttaatttaaacattctttattgctaaaaactgctaatgatcatctgagccttctgagagtcaaaacctttctgctggtggaaagtctggctttgatgttgctggctgcttactgatcaggatggtggttgctgaaggttagggtgcctggcaatttctgtaaacaagacaacaatgaaatttgctgtatcacttggctctttatttcacaaaagatttctgtgtaacatgcaatgctatttggatagcattttacccacagtagaacttcagtcaatattggagtcaacatttcaacaatgttcacagcatcttcactaggagctgattctatctcaataaactactttctttgctcatccataagaagcaattcctcatccatccatgttttatcatgagattgcaggaattaagtcacatctttaggcttcacttctaattctagttatcttgctatttctaacatatcttcagttactccctccaccaaagttttgaacttcacttgaactcagtgagagatatgcaactctgcctttcccttgaatacttagaggctactgtagggttattaattggcctaatttcaaagtcatcaatgattattggaatcaaattctttgaaactcctgttaatatgaagattctgacctccttccatgactgttcttctttttttttttttttttttttttttttaagacggagtctcgctctgtcgcccaggccggactgcggactgcagtggcgcaatctcggctcactgcaagctctgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattcatgactgttcttaatgaaacctagaatggtaaatacttcccattcaccactaaatgttttcaactgactatgctcagattcattagaggtatcactatagcagttatagccttaatgcatttcttaaataataagacttgaaagtcaaaattactccatgatccattgggtgcagaatggatatgtgttagaagacatcaccacattaatctccttgtacatctccttcagagttgaataaccaggttgattgtcaagaaggagtcagtaggtctcaaccttaggcttaaaatgttcagtaaaccatgctgtaaatagatgtgctgtcatccaaacttcattcttccagttaaagagtacaggtagagtagatttagcgtaattcttttctttccttttcttttttttctttgagatggagtcttactctgttgccaggctggagtgcagtggcatgaccttagctcactgcaacctccacctcctgggttcaagcaattctcctgcctcagcctcccaagtagctgggactatagccatgcatcaccatgcccagctattttttgtatttttagtagagacgggttttcaccatgttggccaggatggtctcgatctcttgacctcgtgatgcacctgccttggcctcccaaagtaatgagattacaggcatgagccaccacgctcagccaatttagcataattcttaagggccctaggaccttccaaatggtacatgagcattggcttcaacttagagtcatcagctgcaatttgcccattacacgagagttagcatgtcttttgaagtcattcattcactcctcttgtttagctgtaaaagtcctagatggcatcttcttccaatataaggctgttttgtctacatcgaaaatctgttatctaatgtagttaccttcatcagttctcttagctggatcgggatagctcactgcagcttctacatcagcacttgctgcttcgccttgtaattttatgttatggagatctcttctttccttaaatttcataagccaacttctgttggcttcaaacttctcttctgcagctcccttacctctcagcctttacagaattggagcacgtcaaggccttgttccagatcagcctttgacttaagagagtgttgtgctgatttggtctatccagacaactaaaactttccctatagcagcaatcaggctgttttgatgtcttatcatttatgtgttcagaggagtggcacttttaatttccttcaagaacatttcctttgtattaacaacttggctaactgtttggtgcaagaggcctagatttcagcccatatcggttttcgaaatgccacctccactaagcttaatcatttctagcttttgatttaaagtgagatgagttagtcttcctctcacttgaacacttagagaacactgttgtattattaattggtctaatttctatgttgttatgtctcagggaataaggaggcccttggagagggagacagacagaggaacagccggttggtagagcaaccagaagacacacaacacgtattggttaagtttgctgtcttatatgggcatggtttgtggtgctccaaagcaattacaataacatcaaagatcattggtgtaacagatgaccctaacagacataatagtactaaaaaagtttgaaacattgcaagaattatcaaaatgtggcacagagacagaaagtgagcacatgctattaaaaagaatgacatcaacagacttgctcgaagaaaggttgccacaaaccttcaatttgtaaaagaagaaaaaatacatgtgaagtgcaacaaagcaaagcacaatgaaacaaggtatgtttgtgaggtatgtttggaataaggtattagtcatataaattatggtgaaaccaaattcaacagttacttttcattgcctatccaacatccattcctatatttgttcttactaatgggatcctgatattatttagggggcaatgtgtccaatttaaaacttgctttaaattcccttgcagctgggagagaccatttgacttacatctggctagtgagaaataatctgagaatttctgggaaactttttttccctaatatagaacttgtatcttcctgcttttcttctatttctttctgcctgaaaaatatatttctcagtagcagcattaaatgctagaaagcaaggtgtaatgtgttgaaactttttaagaaaaataatttttttttactctagaaattttaaatctataaggatactaaaaatatacctactatacatcccttttgaacaatctctggatgactggttttaggaaaataaaatatcaaactgagaaaaaaaagaaatatgccacatggagagtggcataaagtaatttgagtactcagaaatgaagtacacttctggaatacgaaagacttgtctccagatgaccgatggaaactgacagaatctttggaattatgtgtaaaaaacatatacactcataacaaatcaggtaaaatatagaaaaaactaatgatagttatgtataacaggaagtcaatagaaaatgtttaaattggaaaaaagtgtagtgtagtcatactcttcggaagcatgaatttacaaatctaaacatagtaattgcaagtatagcttaacaagatcaaggaagaagaatgtgaaaagacgaggcagggaattgctgaatttcatcaaaatatttttggcattatttaatgtttaaccttgtgtacattttacttttctagaagtgaagtttttagttttaaaatattataaaaaggctgggcacggtggctcacgcctgtaatcccagcactttgggaggccgaggcatgcagatcacctgaggtcaggagttcaagaccagcctggccaacatggtgaaaccccgtctctactaataatacaaaattagccgagcatggtggcatgcacctgtaatcccagctgcttgagaagctgaggtaggagaattgcttgaacccaggaggcggaggttgcagtgagccgagatcatgccactgcactccagtctggggcgacaagagtaaaactccatctcaaaaaacaaaaagaaaaaaaattataaaaagctgaaagacaatgtaatatgaaaaactgatttgttaaagattactatcttctatgtataaaagtactccttaaaatgataaaggcaaataattcaatagaaatgtagtcaaaggatgtgcacagtttcatagaagaagaaagaaaaatgtaagtaatgatttgagaggacgctcaaccttactaatagaaaaatgcacatgtgaacgaaccatgagatgccatttttttttgcacatattatttggccaatatgacaaaaattttaaaagactgataacatccagtgctagagatcggaggtagaggcagggagggatgctatcttatattatttagtgtgtgaactgttgttgagatacttttggaaatttatcttcagtttctatcaacattgaaaatatatatacttttaaatgagtaattccacttataggagtctattctagagaaattatagtataggaaacaaaatatgaacatttcacagtgacaaaaattgtaaaacccaagtgttcatcaaaaaagtaatggttaagcaaataatactgtatataatccatactctgagaattacacagctattgaaaaagtgagttaataataccaaagcgttttcctttatctgttttacattctattatgagataataaacagaaaaataaaaccaaatatattaatacaacttttaaattggaatactaaaaatgacaaaattcaagctattccttaaaagtcatgattcctttggttataatgtttcataattgatagctgcattggcatggatttttgcctaacataaatattttaaattaccagttcttcagaaaattataatctctactctctctctctctctgtatatgtgtgttcattcacacacacacatatttagacacacacatacaaacatttctagagaaggatataatgcactgatagtagattataaaccatcgttgcattgaaagtatctttttttagattacttttactaaagtagatgcattatcttctcctatgggagtggagaagaaaggtctattacattaaaagttataacaaagtatattatatgtcaacttgacaacaattgaacaagcgtagtgctggtattgaaagaggagtctaaggggtatatataacaaatcctagatataaagacttactgtcaatcagtgaactatacagttatttaatatgtggatgtatccagttcttcccattgcattaaactgtcttattcctcctttaaagtggtgttatccatctgaacacatattcaattacattttccactaaggatgaactgctaaaatcaatgtcacatcataaacacctgtatttttctttttccactagagtttaagattgctacaattctataagtattgactgacatcattagattattaagaatgaagaacttgaaggaaagataccgtttccatgtgagtgctaacacagaaaatgtatacttaaattctaccttttttcttcaagtaagggctgaatcagattcaggtacacatggctaaagaacttgtttggataaaatgatacatccaggccagtttcattagtgataataaggaagcacttttattattatattgggaatcaaagacagcaaatttagtttttgtaatacgagtagccattaaagagaacagttagcatttctgtgttgattgtggatactgagaataggccagttacttttgtacagagaaagcactcccaccccacctcaccccacctctgcctttgcccctaacttcctatgatggaagctaagatttcagctcttttatataacctctcaagcaaatttattctcctccaacttcctaaaatatttaacacattttcagttaaatctaaactcattatattttatgtttgtagctatataaatattggtcacaacagaaccaaatagcagtctgtaatctcatttcttgtaccgctctctcatttcactctcaccccaacttaaatgttctttcatttacttgacttttcccgaatcacaggctgtcttcccacataccatggtaacttcataaaatggctcataatctgactttccacaaagtcaaagctatcagataactgagcagtttgctctgtttccggagaaattccttctagctcttggttacctgatcccagactgccctgaaggtatactgcatacctcttagcctcaaatttcctttgcagtcctatcagaatttctttttggtgcagtccagtgttcactttcttcatttatttactcgtttcagatgagcacgctctccagttgcttcctgagaaagggctcatggaaggtaaatgtatttatctgcccttgctatggtttgaatgggtcctttccaaaattcaggtgttgccaatgtcatagtattacttataagtggaagctgaacaatgagaacacatggacacagggaggcgaacgacactgactcggtcctgttggggctggtggggagaacattagggaagatagttaacgcatgctgggcttaatacctaagtgatgggttgttaggtgcagcaaaccaccatggcacacgtttacctatgtaacaaacctggacatcctgcacatatattctggacctaaaaaaaaatttaaaaaaagagatgtggcttttaagaggtgattaggccaggagggctccttacccgtgaatgggattaaggctcttataaaaaaggctgaaagaggcttcaagcagcattgggctagctagcttgcctgcccttctctcttctgccatataaggacacagaaagaaggccctcaccagagcggatggtgattccttgattttggaattcctagctaacagaactgtgaaaaaaaaaaaattatcttctttatacattacccagtctcagatattctgttgtagaagcacaaagtgaatgaactaagacatgacatctgactgatattttggttggtatagaattcaaaactaaaaataatttccaactgggtcccatggctcacgtctgtaatcacagcactttgggaggacgaggtgggcagatcacctgaggtcaggagtttgagaccagcctggccaacatggcaaaaccccgtctctactaaaaatacaaaaattagctgggtgtggcggcttgtgccagtaatcccagctactcaggaggctaagtaggagaatcgtttgaagccgggaggtggaggttgcagtgagcggagatagcaccactgcattccagtctgggtgacagagcaagactccatctcaaaaacaaaaacaaaaacaaaaacaaaaaaattcccctaggttttcagaagtattgtgttctaacttccagtgttgcttttttgggtttttgctttctttatagatggcttgcttattttcactctagaattttctaggatcttcctaaatccatgtttagaaatctgaagatggtaaatattggtgcgggtctttcttatttcattgtgcctttgtggccaccatgttcttcatttctggggacatcttctcattttatattgttggaaattccctcctctttattcgctctgacttctccatgtagcacaactgttttaaaggtatggagctattagtcacagtctctatttttcctgtcttttctttcctgttttcagttctgtcattttgttcttctttctgaaagatgttcacaactttcccttccaactcttaaaatacatatttactttgtactgtcacagttttaacttccaatatttcttctttgatttgtcaattgtaatagcattatatttttattcatggagttagtatattgtactgtttctctgcactgattatttttccgctcactgtattcactcaggtaactatgaattcatctcttatgttagactattgtggtctctgtctttatgtcaaggaatttccttaagccatctcttttctttctgactacttttaagggcttttctttgtctccgattttctgttatttcactatgatgagtgtaatgaggagtttctgttcatttattctgtttgagattcattgagcttcctcaatgtatacattaggtctttcaacatttctggacagtctcagctaacttctttgtattggatcttccctattttgtttatttactagaactctgacatactctcgtttgtttttatttatttagacagagtctcgctctgtctctcaggctggagtgcagtggaacaatcaatcttggctcactgcaacctccacctcccgggttcaagcaattttcatgcctcagcctccagagtagctgggactacaggagtgcaccacgatgcctggttaatttttctatgtttagtagagatgaggttttgccatgttggccaggctggtctcgaactcctgagctcaggtgatccacccaccttagcctcccaaagtgctgggattacaggtgtgagccactgtgcccagcctgacatactcttttttagaacttctcattgtattttccatgtcatttaatattttattcatattttctatctcctttcttcagatcactatttttctcttcagctatttaatcaattcattgaatttttttattaattttgatttctagatttatttggttcattttaaaatacatgtggtcatttttcagtttcattttcaggaatataattgccgatcctctgcaaaattcttcagctaatattgacttgaagcaactacaaggctgcccccagatagtttcagatatctgcagttggctaagtaacttacaattagtacactcactttctgtcttctaatattttgttggtatcctttactatgttcaatctcctgatatgtttgtcattgtgagtttgcatatatactgtagttttaaaaaattgatattgcaatatttaaatgaatgatattgcaatattgacatggaatagagattgggagaataagtatgaagtatgataaaactactatgtttaacaggaagttaatacaatgtattagttaaaggattttactactaatgcacaaccccaaatacccagattatgtgacaattcataattttaaagaggcacatcataacattgttattgtctatccagtgactaattaaagtataatctttttaaatgcttgtttttgaaatttataaagttcatggataacagttcagttgtgatttacttgtaaaatatgtaaggatagaatctatttgagtacattaataaattattttggccttccattttgcagtttttaagggctgaagagaacactcaatttttcatttgtactatactccattacgtatgaaataacagatgcacatttttgttgttgttgaaagttggggcctccaaaactttatgacagatcgttcataagtttcatggttctaatgactggaaaaataatacagaacttaagccatggagattatgggtagagagtatagaatttatatcacataaatcagtataagatgttggtgttttaagagactgttactcatttcatatccattactcagatagatcactttaatttagaatccttcaactttaatgattctgtaaataatgggaaggtatatcactgttagtgctatccaaatcaaattttatacaaatttatgattaattcagaatttctaaaactccaaaggcattgggatattttcattaatacctttagttttgttcttatttattatatgggtttataactcagtttttaaaacactaggctactgaaaaatcctagaattgagtaaagttttcttttttatataagctatttctaaacataaatacagaatttctctccataagttatcaacttgtttatttttcaaagtcactaaatagcattattaaaatagcaagcattaattaatgagtaaaaaaagataaatcagaaatagccatgcaaatattaaaaataagatgttttggagattagtcatctttgaatcattttatctgtactcttaggtcatatttcacatactttttaagaaataaaatgctaaaacgattaattttcttaaacatggatatttatttattgacccatttgaaattaaagatgaccaatttcatacataattgattatagtattttggtatatccacacaatggagaattatacaccagtggaaacaaagacaaagaaatatctttatattctattaatgagtgacctccaggatatttatttaaattaaaaaaaatatggagaaagaggaattttactaaggaggatatataaatggcaaataagcatgtgaaaagacgttcaatgtcattgcacattagagaaattcatattaaaatgacaatgaggccaggcgcggtggctcacatctgtaatcccagcactttgggaggccaaggcgggcggatcacgaggtcaggagatcgacaccatcctggctaacacggtgaaaccccatctctactaaaaatacaaaaaattagccgggtgtggtggcgggcacctgtagtcccagctactcgggaggctgaggcaggagaatggcgtgaacctgggaggcggagcttgcagtgagctgagattgcaccactgcactccagcctgggcgacagagcgcgactctgtctcaaaaaacaaaacaaacaaacaagaaaaaacaatgagatatcataacatgcataagagaactgctaaaataatttttaaaaatagtgacaagtgaccatattaagtactggcaagaatgtggaaaaactagatcacttatacattgcttgtgggaatataaaatgttacagccattctgaaaaacagtttggcactttttaatcaaattaaacatatagttaccatatgacccatcaattgcactcccttgtatttatcatagagaaatgacaacttatgtccaaacaaaaggagtacacaaattttcatagcaactttatttgtagtaacaaaaatctgaaaataacccagatatccttcaacaggtgaatggctaagcaaattgtggttatatacatagcatggaatacaagtcagcaaaaaaaaaaggaactagctattgacataggcaaaatcttggatgcatctcaagggtatgatgcttattttttttaaaagccaatttcaaaagattacacttgtataaatctatttatacaatatttttgaaattagaaaattttagagatagaggacagattatggtttccaggcgttaggaatgcagagagtgaggggacagaagtaagtgtgactacaaaaggttatgtgagggttgcttgtgatgatagaactgttctttatcttggctgtggtggtaaatacatgaacctacacttgataaaactgcatataattatatatacacacacatacacaaaggaataaaagtaaaacagggaaatcttcataagattggcaaattatattaatccaatatttgtgctcttgtaagtttaatctgtacttcataagcttacctcaaattactgtgaacctacaagtgctaagtcagaagaatcatgcctataactaggtaacactgaggtaggaggcaggactcaactctggaggcagggttcagacaccagacccaattgagacctagctaaaacagggccagggcagaagcagctttccacaagacaagacatgtccaccagtgtgccatgtcagtttaccattgccatagtaacagccaaaggttaccgcccctttccatggcaacaacccaacaatccaggagttaccacccttttcttggaaatttcggcataatctgccacttaatttggatgtaatcaaaagtgggtataaatatgactgcagaactgcctctcagctgctgctctgggcacactctctatggggtagccctgctccacaacgagctgtacctctgctgctgtgtatgctgccgcttcagtaaaagttgctaacacctctggcttgcccttgaattcattcctaggcaaagccaagaaccctcccgggctgagccccaatttgggggcttgcctgacctgcatcatcaccactatttgagtacaaaaaatgtagttgaagagacaacccatagctttgttaaactatttacactcactgatatcaggaatcctgtttttaggagtaatcattgtgaggaaaaatatattttcacggaaccacagaatttttggtatgtgctacattaagcaagcgcaccaggtttaacacctgagctcatgttcctaccttgaagttaaggcaaaaagctcaaatctaaagaatggatgaatttagcacaataaaggtaggaaaatgttgaccagccatgctcatctatacacaatactcccagagggttccatccttattattactacatgtgataaaactgtctagacctaaatacacacacatacaaaggaataaaagtaatactggaaaattttcataagattggcaaattttatcaacatcaatatttgtggtagacaatacacatggtacacttacaccaggacacaccacagccttgacctatggttattgtcctggttactcctgtcctattaaaataaggatgaaaaactacattaacaatgatagcctttgttgagtacttactatgccctgagtacttgctaaagttttacttctgttacatgctacaagagtacttgacacatgcatgaactcagtaaattacaatattcctatttcattataataattttacaaataagaaaacaaacttagcattttaaataaaactggcacaaagtcccatagctaataaattgcagaggtgggattattcattagttattcattcaacaagtattaatactttattaatgctctagaaatagcctttaacattaatacctataatattttttgaggactcactagaggctaagaaatgtatttagtactttcatcattacaccaaataaacaacaatgtgttcctggttgcgcaagtcactaacccttttgtgactcagcttccttcctgtaaagtgttaataattatactacctctactccatagtgctattgtgaaaacttacacgaaatggtatatgaaagatgcttaaaatactgcctgccacataataaatgcaccataagctgtcattgtcatcatcaactcactgcatattgacaattccttatagtagaaatctcatctgctataccgcttactaacagttttatcaagaacaaccattctgtctcataccttcatcctttattattatactactactaatataatatagaatatactgataatatattatatattacatagtatattatattatcatatatattattaacatatatattacatatattacaattatatattagtataacacactaataattgtataagtattatataacgtactaattatatactataatagtatattgtgttataattactaataattatattaataatataatatgtattattcatatttagaggctgcagagagaaggcaaaaagaggatgcatctcagggaatgttggatgtttaatctctagaataaaagagaaagaaaagaaaaaatagaaacacaaattggtacatctgggcccccaccagaaggtgaacttaggtgtacagtttcaagaagcataacatgagtggacaagtctactgccaacaactggttaatatctgcaatcaggtggaattcctcaacttaatttcttctctgaataaattaagattcagactttgtaatactattgccctgaaatgtaatgctaaaaaaaaaaaccaaaaaactgattttcaagcttagaagatggctacacctttcactaaatacttattttactacatttgctcttctgcagtaagctactgatttgctatttttcttagtatttaaaagatgtaactaaatagtgaatatatacattgcatataaaattctgcatatacttctaagattaaaatttgcaattgtatttccatctctcataaaatgatctaatgacttaaaaatatttataatatataaatatgtaaaaatttgttaatatataatatattaacctaatgatatattatttcataatatagatactacataataaaatatacattattcgtagtatattatatataatataattagtatattattatatatttgtatattatataccactaataatataagatataataataatatgaatagaatatatattgcatagatttgttgcagaggttcagtgagttaattccttcatggtgcctgggatataagtgcacaggaatagttttaaatgagggaagcacctaatggaatgaggaagggggcagataggagtggcttcacccttgaaactgaaaaataactaatttttgtatatactacgtaaccatgagggctcactgcttttctgtgtcttcatttccttttttaagctgattttgaggccaattttcagtgacatctttaatgaaacagagttgtgtagcagaaaagcactggctctgcaattatacaaaccaaggaagaatgctggcttccttatttaacagctgaatgatgctgaatagtacacttaattctctgggcctcagttttattaactaaaatttcaacaaataacaatataaacaatatgaaaatatttaaaacttctatctctaaaggctgttaaagctattttaatcatattgtctattatataaagtttttagatgaaaagggggttgctatacaaaaagatttgatcttacggttttgcaccatcatattaaacatgtttttccccaatagtagcaaattcagcaattctccaaccaacttccggggtagcactgcctttggaaaggcatttacaagttggtttaaatgttacagggcttattatggatacatctcatgtattctgcggcaggtttcccttttatgtttcaatgcctcaaaaagatctcttctgatactgtatttttaattcatttccacttgtcaaagggggatatcaggttttatttcaaatttgtgtcatctcattgctatgtgatatttgacattacaaaatatagtgcaaatctccacatattaagctcgatatagtcataaatttgtactccaagccctcattgacttcaatagggcttggacttgtggaatgattgcagatcaaggcattttgatataatgtaattttttaagtagctttttttccataaggagaaacatgctgcgaatagcaaactacctgcacagcatacacacagcagtcagtaatcctggtccttgtcaaaatattttctgttcatatgtaagtattgactgtggtgagagacttaaaatgactttaaggaaaatctctgtggtcacactctactccctattcacataacacaatttgaggaacttcattaaaatccattcttatagaaccacccttgcatgctttattacagtaaactagctatcaattggactattgacgttccacgtatgcagatcatagtatcttttccattattttaaaatgcttttgtttctaaatgaagatttattttgccagttgatcacagaatgagcatgcacaataaatcatgaagagcacagtctgcaaatatatgtttcaagttcaagcagcaatgatctgctacttacaatcctgaagataataaacatttttatccaatcatccagagtctaaagaaattcaaaaaaatggaaactctttgaaatatacaggcttttgggtatcaaattacctttgaaaccccccacccagaagtatctctaacaaaatccatttgaaatactgcttcaatattctaaaaaatcaataatttaaaccacaggttgaacatttttactgcttccactgcagactgtcatttttcgaaatgaaaatgctaatgataccgaaggggaaagcactaagccgaagagatgcatgaatgaaacgttggattggctagacttgctggtttgatctctttctccctcactcatctgtgacaagatgtcttttaaaatcaacaactttcatttcagtgtttctaaaaaatgcacttctctgttgtacattacatccttctctacaggaagttaaggaatatgctctagcaagacattttatagtaaatatgaatacagaatgtaataccaagtaggctgtcttatttcagtgcaacctataatgttgggacacctttaaaatattgcagagagcactggagagaggataatcccctcgtactaacggttttcatattcataccactgtactaaaacacaagccatgaaggaagccatggaaatccagagcccagaggagttcaaatcagaaaaaactttttcattgcctttgaaatttatttttgtctttaaagatttaagaagtaaaggtgtgagatcagggtcattgccttctccatagggctcctggctttgaatttgctctacctaatacaggatcttgctagtaaacttggttaatgtcaggtggagcaattttcatccaagaactgggaattatgattcatgggatgtaaaacatcttactggagggaagactagggaggtggagaaaacaaaacaatgattgtcaatgaatagccaaacatggtcccatgagctatgggactcaaaagggagaaagctggtgccctaaaataatggaattaaaaagaggcccacagcaaaccttttaacaagtttctcatttctttcttaaaaacctacagaaacctaaattctacccgcagcaaaatgatagcacacaaatattattgatcgatttctataatgtgataaatcacatcatttccatctggaagcaaaaaactctaacaagatagaagagggcaactcagtctttgttgagtatctgctgtgttcaaggaactgagatatgactgtagggacagacagaagagaggaattcgaaattattaaagctcagtttatccatgcagtggagattatgacatctaccacagtgagttgctagtagtaaaagagaaaatgtaaattatatggctttcgaaatgcttgacaaataatatatacacaataactacccaatgctagtttcacagaggaaaatggacctggtatacagataactctaaaaaaatttaaaatgttttaatttttgtttgtttgttttaaagataaggtcttgctgttgcccaggttggagtgcagaggtgcgagcatagctcactgcatcctcaaactcctgggctcaagtgatctttccatcttagcctgctaattagctgggactacaggcatgtgccaccatgctcagcttaaaaaaaagaatttaaatttagcatgatagaactgaaaagagctgatagctggttcacctatctcattttaaaaggcttcatagtgtgttagtggcagatttgcaatttcattgcaatttctgtctttttcctcttaacacaggcggttctaggactcctacagtttataagaacacaactttaagcctgggcaacatggcaagaccccaaatctatgaaaaatacaaaaattagccaggcatagtgtcacactcctgtagtcccagctgctcaggaggctgaggcgggtggatctcttgagcccaggagatcaggctacagtgagctgtaatcatgcaactgcactccagcctggatgacagagtgaaagtttgtctcaaaaaagaaaacacacacacacacacacacacacacatacgcacacacacacataattttaagataaaagaaagcttccagggtgggtcacatctaagccggctcctgaggatgaattgtattctcaaaagtcaaaatactgggcagagctcttcagatacgagcacaatgcatgcacaagtgctggggcagaaaagcacaagccatcttcagagactgtgcatggcaccctcaggcagttttaccttgagtaatgagcggcctgcgcatccatgtgcacaatcatagtttgtggattgaataacaaaaacatcatgtgaagtctgagaaattttatcaggttccaaagggacaaatattttaaacatgttaaggcttctgttattgtgtctcctttatgggaagaggttggtgggaggaattaagactaagagaaagttaagatgagagagggcattgtaggcatgctaagatttatggcctttctcctgcagataagcaggagagagagagatgtcaaaacatactttggggagatacagttggatgaaaatatgtagattaatttctgtaatgtccagaaagaatacagaaatcagattttaagagtttcaggcagtgtcctttctttgtgctccctcttcccttcattgaaagttaaaagtcaaaatgtaaatacagacttaaaagggtaaatcattctgtttttcaactttattcatgtgaactcaatgttttaataaatttctcttcccaagccacatcaaaatggtttgttatattgttgattttattattattgattatattattattacattagcatttgaatctgtgaagtgctgtaagacagtttgttaacaatttgtcatgacacctctgctgggtgggaggatgacacacatcattatcattattattaagattttcttttacagctggtatcatgataaatgatttacagataaacatagcaatactcaagttatttatatcaagttaattaatcatattgatttaacatcctgttctgttatttaacttttcccctttctatgttagttttagatctaattttagaataattaaatagaatttgaaatttagaactctgcattagtacctatatcacatctgaaaaattattaacattttcagatcaattttaataactgcaggtcctttattaggttgaccttttctttccaaatatttgacatcattatagttggagaataaaagtacctattgacagttttcttttgatattgaaaggtcctgcttcagtaactgcacagaacatagtaaccatgtttttctcatcttatgttcacttcctttgcaaaacaacaataaacagctggcaagtcagagataccagagtttttcctaacttctctcttcccatatctagcctcatgcaatcagtcaccaggactgctactttactctcttttatacatgtcaaatacgttcactttgctctagatacaaccttgagccaatatcttttcttccttactgtattacactgtaagctccatgaatttagggccttatattcctctccactctatcctcaacatccaagcacattgcctagaaataatttgtcaatgaacatgttcatctgctctcactcttgtgactattttctacactattatcagataatcctctctaaaatgcacatccaagcctgtcttatccttctttgcatatagttcattatcctttaagataaagttcaaactctctttgatgatcaaacaagggcctttattatgtggttccattctaattcttattctcactacatcatccttccagtgaaagtaaacacccatttttacggggctttctttttctctctgactttgctcatgatattcatctataatgtattctctattctttggacaggcactatgcagggcaactgtttggtatcatcttttttccaatggcattccttgctctagcttggtttggtgcttcctctgtagttttatagctcttcgtttctaattctctcatagcatgttttctcacgcacatcacatctagattttaggttctctgagaaccaggattgtatcttattgttatacaatacatgatctataaaaatgaacaaacaaattacacagagtataaaatactataaaaatacaatgctaagggggccaagtatgtggtttaagagcactctattgccatccaaatgaatttgaacaaatcttttgattaaagaataattttcattatctgtaaatgaaagctcttagactcaagctagatctcaggcaagtctttttttaacactcacagtctgtgctattatatctagaatgataaaattaccaagcagggcagaagtgagcagggaacgacaattgattcagactcctagagtaatgatctttctccttgctatctacagtatattaaatgctttccttttggcttctaattctgtatgttttgctcaaaatttagctaggaatatttattcatttctttgaactatatataaacagtaagagactactcattgaatatagatgatcctgtaacactttcttccaacggcaaagaacctatataactagctattctttggaagttgcctgtaactccaaaactctatttttagatttgctattacaccatgtttctaacagaactgggtcaaattgcccctgatgaccacactttctgaataaggggaaaaaaatatggaaagtggaagctactttaactgtcaattatattaaccagttgccacaatgattgttaataagaatattaaggaaattattaggccttcatatttttactttttctacttatcaataacactaggagtcaatatcataatgggaaacaacttcatacccactatgaagtttataacaaaaaagatgaacaacaaacaacaatgttggcgagtatgtgaagaaactggaaatatcatacattgctggtgagaatgtaaattggggtagctgctttggaaaacagtttagcaattcccaaaaagttaaaaatagagttaccatattacccagaaactccactcctaactatattccaaagggaattgaatatatatgtatctcccctcaaaacttacatatgaatgaagaaatatttataataggtaaaagtagaaaaataccccatgaagggttatgaactaatgaatggataaacaagagtggtatatccacagaaagaaatgaagcattacattgataaatgctacaacacaggtaaaccctgaaatattatactaaatacataaaagaaaccagacattaaagtcatatattatatgattttgtttatatcaaatgtactcaataggtaaatccatagagatagaaaatacattactggattccagaggctgcgggatgtggggaatggggagtaactgctaatgggtatggagtttctttcttagggtgatagaaatgttttgaaattagatagtgatgatggatacacatttgtgaatatactaaaaaccatgaaaagttacactttaaagaatggattttatacgtaaattataaaaacaaataattctggagatgaagttgatggttaagaacactaaatattatattttcgtattctgaattttttaaattacagggataaagctttccaagtggttaaaagagaaactgtctttacactaaatatacacacacagtactttgcctctctctctctttctctgtgtgtgtgtgtgtgtgtgtgtgtgtacttatttaaaagccaaagtaaagtattacatgaagttctcaacagataattgcataaaatcatgatatacagaattcactcttgtgatggctatatattaatggaagccagctacattttaaaaattattttacattttttatatattgacaaattatagttgcatatatttatggtatacaaagtggtgtcatgacttttgaatacaatgtggaaagattaaattaaaccatttaacatatcacctcaaacatatccatcacctcaaatatttaacattttttgtgattagaacattagaaatttattcttagtgataatgaacatacaatgtattgaaatagattaaaatttaatagaaaacaacattgaaatttatttgtaaacataaagaaatattttttcttaaaagttatgatttataaagagttcttctctaagaccttaatttcactgatagatctacttggtatttcttttatgtaaacctttataacttataataaataactttaaaagttattttcatgaggactaagatgaaaagttgagtggatcaaaatatagatgggttggagttacagcactgacctctatctgatttttctccctcaggagatatatctttaaataaacaatttctgtttatttaaaacagaatatatctttaaataaaacaaatttctgtttgtttagccttgtattcctttggtaaatttggtaaattcatttttctgctatcttgaataatttgtttatgaagtcttccaagactttgtaacctatgcttcaaatggaatgaatataatttttctacattcttgaaataaatatttttattttacatccatttttatgtctgagaactagtattttagaacattgaaaaacaccttttgtgttaaaacagtaaatattttcatttactatgcatatatctccaagattaatgctaaggcaaagacatttcagagactgcatgatgtgtatttctctctatctaaaaacatatatagtatatatacaacttcaaattctccttggagaacagcgggaacaaaaaaacatccatatctatctaatcacatacagacttacttacaaaaattacttacaaaagaggtgaccctcaacacttttctcaaaacaaagggaaatttattttatttaataagaaagtcacaacaatttttgatactataatttaatttaggccttcttatctcattacaaatacaatttttatttagtaatctagtttggaaatactgaaaagtttttcaagttttatttacacaatagtgtaagtcaatccaagggtcactgtgaacttgtggttctttgttacaactgcaacctaatgttctattcaaagtcttattgcaaaatcctcaaaatatgatgaatctgggtggcaaatggtaatagaggcaatcatttacattcaggtctcttatgaagaggcaatgtgtatgtacctaacatcatctgtaaaggacctatattctccaatggattcatttaatttatttgcagggtgaatttttatgttagtatttcagccataggtgacttattgaaatgaaaagttaaacttcctcagctacaaagaacaataaaaacaacaaagcaaacttctagaacttttagttttaaaggcactcaaattttacaggtaattcatcaaacaccactcacatccacacagaaatcaaatacatttaattatgtattgaaatattttttcttacaaattaaactacaggcaaaatccagttgcatgacaaaactgcataaacagtaaaatgaaaatgctctcattacaaatacaatttttactcagttaaaatatcatccaaacttatatttgtatcatgtctaatatttttatgattcacagtgatatataaattaataattaaataatgaattcaaagctcttatttcaaatgtcttctaatcagtcattttgttatcttatattttcataaaagaggcattgttttagatgcatgggattatcgttttttattttttgccaaatatatatgttaaaaggaggaactgtagaatcatacaaggcgtagattaatataatgtgagatagtgtatcagaggtgatacatgccacgcaagcagcatattttacattctgacacacattttaagccttcttttactcacgtaatttaggcttcagatgcatttctcaattgctcactgcagaatagctgcagaactgaaacaaaaccttcagtacaaaaatgacaacccttttgtttccactaaatccgtattctgtcatccactggcagggagttttccagtcatgttctctgccagtccttaccagtttgccaattatacaagctgcttcccagacatcagacacaaattccacaagactgctgtgcaagcgtaccctaattaaccatcagcttaattagacaatttactgtgtaattagcaggcaattagtcaacacctctcagatcttattgactgctgtgacagcctttcagtctttgcacattccaacattccaatacacaacagcgaccatgtttctagcactctgaaaccctgtacgacatagttctggacggagaagtgggtaatattatataacaaaggaaaaaatcaatatggagcctgtccaattactgaactgtttataaacttgtcttttatttaataccagaagtctaacattaaaactactttaatatctgcttcaaaatggttatagagccaacttcttaatatgttctatttcatgttttaatgtaaaacactttaaatttactatgaattatacccccgattggctctgcctatagtaacttgagtaaattttcaatcagtgtatcagagatctactcaattaaatccaattaatgtggcctggtgcagtgacgcacacctataatcccagaactttggaaggccagcacaggaggatcacttgagcccagaagtttgagaccagcctgggcaacataacaacaccctgtctttaaaaacaaaaccaaacagaaacacattagccaggtgtggtagtgcacgcctatagtcctagctacttgggaggctgagacaggaggatcacttgagctcaggagttcaaggatacagtgaatctacactccagcctggatgacagtatgagaccctgtctcaaaaaaagaaatcttactcatgttaatagcagttgtagacacaaatcctacaaacactgataaaaagtgctctggggtagggaagcgttttttagttttctttgagtcagctacgaagaaatcacacctcagcattttaatgtttacattaacactttacatgagttacatgattttaacatttaaattaacacattaattttacatagaaaagcatgtttacaaatgtattcctctgaggtcatgtatatgtcatataatacccactgctctttgtaatgcaatttctgacctatataaaatattttccattatctcgagatttcatgacttgtaactaatgagatcccaacaactgtaacaaagaatgatcctttatcgcttttctttcagaaatattacagaagaggataaattttattgaatgatttaaaagtcataagatcttctgttaaccaaaaagaacaggaggaaagaatttgtgaccactccttcatagtttaattggttaactgccacatacattttctaacacctgataaacttccataagtataaaaccactatgacaacataattatttctgcattatctaaactttgccattagcagcaattttctttttcttctttttgaatgtaagggcctgaaaattaccagcaagaacagttattgaaaggccacaggttggaggaatctagagaagtccattgtggccttattggtaccaggtaaagtagaatgagatgaggaccgagagacaggcaggagctgtttgctgacatgatttgtacaaagattctggattttattttaagggctaagagaagccattgaaatgttttaagcaaacagccacgatctgatttaagatgtcaaagtccactctgacggtggtgtggaggccggaatttaggataagagtagaagcagcaagactcttttaggaagctggtatactattctgtgagaaatgatgggggctgtgatgtgggtggtaccagtggagatgggaagtgactttctaccctttaataactgatcacataactattaatgttttagtctggcatacagattatggtaataagaattataacttttattgacagggtattttacatgttacgaatcattttaatatatttatttaaaaaaaattcaatctaagcctcactagaatactgtaaaaaggcagagcaggtattatggtctattttgtaattcaacatgtggaagtttagataagttaactaatttattaacagtcaaattacttacagaagaggtaaccctcaacacttttctcaaaacaaagggagacaactgtaacgtttcaataataactagtatgattcactatgaaaaccataatttaaaacttaagagtatattgtgcctctctagccttctgcatgcaagcttgtttttctcttttcatattataatacttaataagataatatttgtatacattttatttacctgtggatctctgttgtctatacaatatttctctttatattgatcaacaggagatgtccaaaaatcacaccaatgtttgtttattccccccatttaaaagccatatactaagtggctgcctaccttatgctgagtattgtaaaagatccaaatatctttgtggcaatctcacgtaactccaactatcaggagtataactgagcaaggaccccagctgctgtgctgtgaatgaatccactcctggattttcactgcagccatgcttcctgtggcttagccaatgactgagcagggcagagatactaagcaggccccttcctgagagacatgaagactctagatggctttgtcgaagctttctcagtctgcaaggcactctatgatgctcctactcaacctttctttcttctctccccaatgtatggcttgacttctattgctgtcttatggctctcccagtcctcctcaacaccctccatattgtctcccacaattatttcacctaatcaaatccatgcatgtttaatcacatcttggcaacggtttcttggaagatctgaactaaaacctgctgccatattaaaaaaattaaatgttactgacaaaatccagaaaaaaaaatctctatatgcaaatagttgtatgaaatgtaagggtttttaaataatgcattttcatatactaaatgtccataagtaaaattcaatatggatattattaatgcaacagaatattaaaatatacattttggctgagaccttaaggggcattgagataaatcacaaaaataaatttttcccttacagaaatgttcaagtagataacaaaaatctgcttagggaactcttacacccttcactccaatatggaaacaaaatgttaacaaaaagttagggatggatgttggagattatgacatggtttctttggagcatgcttctgggattatatgagtcccactgtcatcccaaatcctgagagacagcttttaaaagggacccttcagagcactttatatgtgttccccgcagttttattttcttttttggaggttggtgcaccgtatacagtgtcccactctgcttgatatatcgaaaaggtgtgagttgtctgttgctaaaagatgagctaaaagagatgcaactgtacagcaactagcctatattcctagaatttgtcaggggaaaggaaatgtaagattttcctgtggaccaattaagggacccatatttaaataagtaatgtgaagtcaccttaagctctgttcaatatggtcccttggaaaggcaaatgtgttgcagcagagaaaagctaagttactcaatagcttcctaggagtttcctagagagcaagctatgaccaaagattcaaaagcaccatagggaagagttcccaagtgatgggaagtatttttgaagaatgcttggaggtacccattagataaacgttagtctaaacaaaagtatgtctcctaaagaggaatattatagctgtacaaaattatatttagccatgaaagtgaaaatactcttcaagaggtaataatatttatcaatttaaaattcattatattgctgaacaatgtattacattgcaaaataaaactggttgataagaggagggaggtagtcagtcagcaggttccctttgcagggcctggtggtcacgagatctgatctccaaaggcttccattcaggaaaggggccggggggtggggtggagtttaaaaggaatccattccctcttgtgtccattgagtaaaattctataagagctcagacaatggagagaagataaccattgattaatgtagctccaggggacttgggtggtcattggccttttaatatttgaagaacaataaatgtctccttaccgataaagaatggtaaaattaaggtatagacgatgcaaacataaacctggtgataaaaccagttttgtcagaaaagagagtttgtatgaggagagaagtgaaagttattgttgaaatgataaacagtagttgtattatgattaacagtctcttccaaattgaattatgtaatttctttgcttaaacctcttaacaacaggttccctgtttatacaacaacatttaaattcctaaccccacaggcctttctcactatctctacagctacttataacatttcatgagacattatgctgcatcttacatatgctcggttctctcatgaccgtgactatccgtgtgctatcccttctccctagaataaagacagttcaaatgtgaagaaaataaaaaaataaaatattgaaaataaaaaattattaaaaaattaaaattataaaataatttaaaaaataaaatattgcatattaagtaacattttagtattaagtaacattttagtctaagaattcctgtggccttaagtcatcttacatcttttggtgtatatattttctgaactacagtttaagttgtctaaagtgaataccatacattacacacatatacacacacacaaacacacactcgaaaaatagtatatataaaaggacattataagagctctcaaaatacatcaaatcttgcccagatacctaaaaatggtactttctttaatgacattttaagctaatttttcacataaatagagggtaaatttggcaggatagaagtgagaaactgtttcagacacatgagatattgtagaaaaacatgcaaatgaggaaagcagggcaggatgaaaagggcaatgggcttagctgaagtgaaagaagcagatgaggcagtggggtaagaaaaggtaattggtgtgtgatagggcagtttgagtgaatatttaactaacacaccagtaacttccttgagttagtgacactttatttctcatgacacctcatttcagaaatagtggtacttgaacattaagcacattgctagtcctttaggaaaaaggagcatacagcgaactgtaattttactaaaacagagtcagtcttgtaacaaaatagccaatgtaggtatgcctttaataaaaatctgacagtaaggtaatcatggtataaagtatttaaaatgagtataaagaatatcattacatagtagttactagaatcttattaaaaagcaataaagaaaatacaaaggcaaggagaatattatggaattcaatccaactaatttcaaccaaagattgtatcatctaaacatacccaaaatatggagatttttaactggttaaatttaaaattcacagaagaattatgtgagacagaataagggtaaaatcagtttctcaaacagcaggactgtactttaaggaaatttccattaaccataattatgagaattttccattaaccttgacaccacttgctttttttaaaaaaggaaactgaataagaggtactttccattacaagttagattcatctaccagctaacccagatcaaaattgtacacgtcaatttatattattaaaaagtctatttgagtttcactttgtccactctaccaaaatgattaactaattaacaggtgtgaaatcacagcctgaaatgggaaagtggtgaagatgtaattatattggaaaattgattagtctgcttcatggttaaaaatattactttggctataattaaaagatttttacttaatattcgaaatacatgcattaaattgtgtttgaaagcatcttaatctatattttttacttaacagactaagtctggcaaacatggtatgattgcgaacagagactgatttaaaactttaaggatagacagtggtgtattcattagattctaacttgcaagatttagcttcaatattgaatgtgtacacacgagtgtgcaagcacacatacaggttcttttgttgatgaagaaatgagggttacgtcatagaagagcttgctaaatagtcttgaagtgaacacttggatgaaatgtcccataggagtactatatgtgaactgtagccatttaataaactaattctttataattggaggatgagttgattttatgaatttcaataaaatacgtctaagttataagaacctagctaggtgataaactattagtatacagaagtcatctcagttttcagcatgttaaaagtctcccagataaaaagcttacattgaatttatttaaacaattataactcctagttaatgtatattatcaggaaaacaatactatgcaataaatagaaaataatcatatacaaaattggaagctagaactatagcagcaaaaataatgcactggactattgttaatttattgtttcatagactttcatgatgaggtaatagataaactcttaataataaataagtaaatcagttttatttaatctttttaaaaaatccagatctttatttctaacaaggtttccaaaatgagtttcaaaaataaattgtgatgttttgtattgtaatccatagagaattacccaggctctaaaatattattacatgacatgtttgtgaaattttcaactttaaatattatctttagcatttacagtcctgacaatgttattcctcagttctcatctcgttgataggtgctggcaatttgtgcaatttgtgcaaacgcaggagcaacttcctctcaattaagataatgtggattgaaacaagtttcttggaatccacatgggagaacagacaacctacatggtaaaaagtctgcaaaccttattatgaaaagaaaaacagaactatttagaaaggaaaaagaaaaggcttatggataggacatgagagctgtctccaagtaactgaagagctgtcatgtggaattgtggttcaaattagaatactataattattcattcatctaacaagtatgtattgcgtcctttctatctgccagacattgttcttggcactgggcatgctgtagtgagcaagaaagacaatatctctctacttacagagcttacttcaagtggctaaaacagaaatagatgtccaagagcatggcaatttcatatggtgataagtgcagtgaagaaaaaaacaaccaatgtaatgtgggatggagagcctgggttttgaatggttaacaagagcttctctgaggaggtaacttttgatctgagaactgattaagaaaaaagagccagtcatataaatatctgagagaagagcattccaggcagatcaaacaccaagcaaaatggtcctaagacagggaggaagttgccatgttggagaactagaaagggggccagtgtggctggcaaaaaattggcttctgatgacagcagattcacagaagctgttaaatcaaaatgctctcttgtattctctctgaaattgcacatagaaatataaaatttctgtgcaacttttatttctcaatagaaagacaagcataggtgccactctatacgaagcagtgggtagaaagtcctcagtgtaaatgctcaggctgaactctaagtctctgaagacatgagtgcagtcaaactgccttcattttagacataaagtaatatggtccagagaggatacattatgtaaaagcatgatatagtggaaattgcagggatttgtatcaaatagaccttggttcaaatcctgacgtggtggatttcagtgttttgatgggaggggccatttccatgctgttacaacctgatctggtcttgtgatgtgccctaaagaatggaacacaatgaaaattatattgtgcaacttccgagccttggcatcaagaggatttgcaacttctcctcctgccttttttgtagcactgacaacttgtgaacaagtccagtgtagtctctttgaagataagaccatacggagatacaggcctaatcacgtcagctgaggacccaggcatgtgaatgaaatcatccaggaccggccatcagccagccaccaaacagtctgtcaactgattgcaaatccatgagtgagaagaactaatatcatgtgaagcaaaggcaagtcaacccagctgagccttggccatactgccaaactgtcgaaacaagagcagaaaacgtgttgctgcttttggtaaggttgtctgatatgcagcaataggtacgtgatgctgaaataggttatgtttgctagcataacaaaatataaaacatgtggccctggctttggcattgtgaggcaggcagagccttgaaaaaccaagagtaagatcttagtaaaggctggaagaatggtgaacaaactgttgtagaggtttaaaatatggtatgaaaattgttattggagggttggaaaagtggcctgtattatgtggtgacagaacaattggcaagaatgtcagcagtgataatttggaaaacagaaagtgaacataatacatctctagaaagaacactgaacgtgttcagttgagtgtttctacccaagtgtgataaggtactaaaagagagaaaagagctaaataaggctatatttaaatttgccatgcaaaacagacagaatccaagggacctaggacacactgggtcagaaaataaactattctttatatttgttctctcctagatggaaaaaaggttctcaaaataaagtaccttaaagatcatctcaagaatattgcagtaagacagtttgttaagactttagaaagacctaaggcaggtcctagtagattctctcagggcttctaacattcctaaagacattgtaccacaacagcaaggcatatccaaaaataaaagaaatctgtttaaaaagaattatggatgtgactttgggcatcaatttagtccttaatagattcaaaattatgttaacagagttttatgatgatatcaccatgagttaggattaaaagaaacaattcaaaacaaagagaggaatagggtgctataactttatttgggcaggaacaggctgacaaaactactcagctgtcaacaggggccatcattagccatttacaaaacaaacaaacaaacaacaacaaaaaaaaaaaaactcagaggagaaaaccagtagcccagagataatcagtagcccagaaggcagagccaacagtagataggaaaaatgtattaggacatccttaccaaggagcataaatggaccctgattctccatccctggagcaagaggccctgaaaatatgtgccaaactgaatttcaaaattgctatggacaagtgattgctatgtgccttccatttctccagtttctaaaggagattttatctactgtggttctcttgactgtatcgttttgtgttgggtatatggaagatagaaaacatgtctttctatatcacagaatcctcagtaaaaagaaactaaaaccaaataatctcataggcatttggacttgatgaagatcataagataatgaaccttgagcctaatgccatgattagatgatattttgggtgtcttggaaaggagtggatgcagtttacatttgggagggatgtgaattgctctaatcagagggcaagttaggactgtttgcaaagatggctgcaataatccttccctacttctatgcatgtccctttgtaatgtggttttgcacttctttttatcaataagtggatggtatttacctacttcatgaacatacattgactttgtaacatgctttgaataaaatacggaagtaacactgtgtagactttggagtctttgtgtcaagagatctttcagcttccactcttgtcctcctagaacactactagccttgtgaagtagccttatcaaacctaaaccagccaccttgataagacattgtgaggcaagagagattatgaagagatagagagaaaagctcagccatctccgcaattatagcaatcccacatgattgctatatgccccacatgaggctccagacacattagtggaacatcttgatccccagggatccaaacaaccaactgtaaatgcatgattgaggccagctgacaccctgtgaagtaggagaactgatcatgcgtgctgagcccaaattgccaacccacatgactatagtcaaatagataactgttgtcttaagtcctggacaatttatttaactttctcagactattatttcatctgaaaacaatactatctatcttataaacagattgtgaggattaaatgaaataatttacaaaaacatttagtctatacatcctaagcactgaatatagggtatctaataatgtgaataatgataacaactataacaatgacctataatattacacatgtccaagacagtgatttagaagcagctttggattaagaccagggcctcccaggccaaagtacctttccccacactacactgcttctccatatttgttagatttttttctaacgtatttatttacttgtggaaaacaacaacaacaacattttattttaaataattcatttatattaatattactcttatttattccatgatgtatcagagggcagaactatatataaaacatggatgaaatttatgagaagggtgatatggggtcaataaaaggaacatatttctaaaacagatctttctacagtcatacaggttatattgccttaaagatgtagtatattccttgtcactaaaagcattcaagaacaggttacatttcttctctcaggactaccaatacatgcagttagaagttaggccagccgatttttacgtatcttcttaatattgtgtgatacttgccctgttttctcaaaaattctctgcattttaaaggcttatacaacaatctaagtcttaaaccacaatctatacattcagaaatttcactgacattttcatttttagacacgtatagatgcactatagaaaagcaacatagaatatgaaaattttttaattggccttttctccttcgattgagatcaatactcaaaacattcaattcttttatgtgttaactgtctgttcatatactgggaaaaaaataaactcgatatgctcttgccaaaaaaatctatgtattcatttatccagcgaatatttatgaaacatttatcaagcctctcctatacattaagctttgtgctatggggtataaggttgtgttttacagaaacagctacataaatactttgatgccaaaaaaagaggcttaaatattttcagtctttacttcttagcattttataagagagacctattacatggatacttatttacctaatttgatacttattaaaacaaaatctattcatttgagatattttcataattaaagttaatcacaagttaatctatgtatagaaagggcttacaagtgaagtgaactgttgcttgggtttagatttgatttaggatagaaataaatacttcttagtttatttatctgtgcagtaataaagctatgcaacttgcagtttcatgttacagatttgcagtatataatatgtagctctccaagagaacaaaatttatggacaaaattaatgaaaacaaaatgtttttatctacttcctatcaatataatgtgaacacaggtcaaggggttattttatgtgaagtccaaaccatttctaatattccctcttaaacagatcacttctctgttttgtcatgataatttagctttaatcaagcttgacagatcgatttctctcccacctttcaaaatttaaacttggagccgatatacatttgtatagaaaaatgatttcataactatattttaaatatgactttactatctttataaaacataaatagaatctcaagaaaagcaaccttgttattttgaaacattcttggaaagacagatttgaagaggaagaatatagttaataaaagccatttttgatgttatttaacacaaaagcaaacagatcttttcatatttgacattaaaaatatgatcatttgcctttctaaagaaagcacatacagcttttatatagactgcacagtaaagaataataatatttctgtttactgagatatcaactggcatttcactgtaagtcaatggtctatcggtgctacagcatattagacctcaatctggcatctacaaatgtcaagagtataaaatatatatatatatacaggatgaaaatcaaaagcatgttccaaactcccaaaaaaataaaaaaagggaaacaaagttcacgcaaacatatttgctgcagaaatcagtgcaatattcagctgtcaatccagaaaaacaacgagggagccacactgtcagtaggacaggataataaaatttctagcagatgttcagtcagggctctaattttcaccgaactcccttggtaagcatttaatttctttatcatatgcaagcttggcaaattgtacttcatcaaaattgtattgtgaaatattaatatttcatatgataacaaaaccccatagaataacctttgtcatattaagagcatccaaatttcaaatgtcaagattctgaattttaattcattttaaatagattcttcaattgccataataaattataataaggctaatctaaattggtatactataatgtcaccgaaatgtatagtacatgtaatattttaatagacgtctttagtaaaaggctgtggggaaataagtatgttcatactactgagttgtatactaccaacatttcatcaataggaaagcatagaaataagaaataagcacatacgatgtaattatatattcacaaatttaatcactaattaggaaccagataaggaaacaaaaaaagtagacctctatgaggcaaacggactactctgcaaaatcacgtatggaaaataatcttttttgaaaatggcattacataagcccaaggtggcttcattatttttgtcattgcaatttgcagaaatatgtttaaaatagtctgcacaatattttgttgtacccaccatcaaagtaagtaaaatagggtttccaaaaaaccccgcatggttacatttcatgtgccaaatttaatttccatttgttcataactccccttttgaaccagcatcacacacttctaaattgatagattaaattcaaattggaggtttagaaggaagttagcttccacatttatttctgctggtgatcctaataaaggcaagtgctcctaggttactgaaagacacagcatcacaaatcaatgcatgtcaccaacagtgtaaagactgatgtctctgattaatcagaattcaattattgcaagcgaagaaaacatcaaattcaaagcagcaaacacctctttttttcagctataattcttcacctgtgcccaattagccacctatttcggtttacatatatgttttttaatagcataactaatatagtcagtatatgctatctgagactcagttttctccaatagattaaacatttgattacagcttctcagtaattcttaacgaatcaattgaaacaaagacaaatatactatcaatattctacaaggttataaacaattgattcatggtattctaaagctgaatctagtatattctgttacgcttcacactttgtttaataaaatattcagttgatctatttgaaaaaataacttctctttaaatataaaaaatctttacgaaggatttttttcctgcactgtttttttttctgacttttgagaattctctagattttcctgaccacacttacacattgcatcttgtaaagctgtcagagtaagacagccttaatgttttagccataataatgccagctattgatcctagtaagaggaaaaagagagaatgtgcttaatggggcatgtttgttctctattattttctttgcctaaggataaagctgattcaaataatgatactcttttcttagtcactaaattcacacattcatatacattaattattactaactaccagttagtattaaatacattgagaggtttagcatttgtaatttatcaataaatggtctaaaaatgttaaagtctgttgttcttttctaattcaaaaccatataaggatgcaatcctcttgtataaagcatcttactttgaaaacatgcatttatatgctttgtgtactttaaagactcaatctcaactttaatacgtagtttatttcctactaagtataagatgtccacttctggttaagtacaaagtcataatgttaaatgaaactcagggtatttgtttttgagaaaggtttctgtattccaaatttataaagaatctatcttatcaccaataccaataagttacactgagattcttttcaacataaattgaattccagaattttgtgcaaaccaaatcaattgtgtccctatctttgagctgaggcatccaaaaataatgaaacaattaataatacaaaaataagagtttgagattattaaatgaaaaagtcactttcataatatttatatctttgttgcttcctagacaatactaaatgagcaatatatgcctgccccttcttccatgggacagaaaggaaggaaagaaactaaagattaatgtgtaatgataggtcttgtcaaatagtttaataagtagtatttcttagtaaaaaaaatccattataatgtttataccttaattaaaatatatgatagacatttctatatgacttcaataatattttcttaccttatcaagagagaaagttttggtgagggcaaaaccccatccagcttcaaaagctcttcgaatcattgatgtgctggtggctggagttgcgctagcaagaccaaaaggatttataaacttcaatccggccatttctacactaatgtccaccagatcaataggagtgtaaaagaggggtagttcaggcttggcagaaacggaagctccatattgtgactgcaaaatacaaaccaatacttggtttcatattacatctaaattgtccatataatattttaccaaaaaaatcacttcaacacagcatccgaattaatatagattacaacagtctgtttacaatgaaaaaaactggcaaaaagtcagtgagcagtgaactgaattcatataatatggccttttaatttcaaaggcagtatgaagagtactagcagaaataaaatcaattaaatcaacaaacaactgtatttaaaacatactgagattcaaatacaaaagggaataattttagaatttttctccctggtccaatccagtctctttgtacttaagttatgaaaatacctttagtgctcagagatatgggcaacggcaagtcaggaggcctaaattcaatttccagtaatttcactactgtttaggcgattttaggaaagggaactaataagtccctgtcttttcttctctatagttttcagtatagcagcaggaatgctgcttgcctaatttctacctcacaggaagactggaaaattcaggaaatcataagctgcagggagacatttaatttggaaagtgggtagtgttctcatgcattacgggggtttgttcttttttctgaaaccaaataggtcccaaatagtttacgtcaaaatcttcgactggcactcaaaactgtaaatttacctttgttaaatgatcatggtaataatgcttctttgcaggattattggaatgatttaataaaaacacttactcttagcacatggcacactgaaacatcatacataggtgcttgctaaatgttgtctctttttctgactggggaggttattaaagattgcatcaggccttttgtttgtaaagtgtctctctcactccattcctccctccccttctctctctctatctccaaaagacaaataacattggaaaatataaaaaggatgaattttctcagccaaagcagttactgaatggacagggctagttaattcaaaagtagaaatccattctcttgtgaatcatcactcaaaagaaaagttatttgagcagaactttaattttataggagtgtgtcttgtgtagataaagatttccatgacttgcatagaaattatttctggccctccaccacttacaatgcaaagcaaagttcacttaatatgtaaaaaggcatcaaacttgtcaattgaaacactaatgtgtctctggtacatgcaaagagatgcctgatgggatccaggcttcagctatggcaggcaccttctcccagggatgttctgggcttcaaggcacatttctgaatattggttagtctgggtgtgaacataatttttctgtcctcacacaggattgctatactattaaaaggattattagcaaatacaaaagctacaatgtaaaatataggaaattggaggttaatttgaggtgtgtgtatgtatatctgtccacgcatggatgttaacaatgacaaaaactggcaaaaagtcagttagcagtaaaccgaatatatacgatatcatcctttttaaatttcaaaggaagtatggaaagtattatcaattaaataaacaaacaaacaactttatttaaaacatactgaaattcaaacacaaaagggaataatttcagaatttttctcctggtcccactaaccagcctctttgtacttaatttatgaaaccttgcttgatggtattttcttagctttgtgtaatcataatgtaaattcaatcaagcaagttttagggttagactaaagaagaatttcctgacactacaggttgattaatatcagtaaaagtatagaagcaacttctctgtcttagaaacaatgttgagccaacttgcctttgatggcaatagcataactacatatggtcccatgtgtctgtactttacaaggtgaaataagtgaacttacaagtattcttctctttttatggctgtgtgttgaaatatctatttttttcaatcttacagatgaattttggtttgttcataattgtagctatatatggcattaggcaacagcccaaggaggcagatatatgtgtagttcaacttgcattgcttaatttatgtagttttaaataaataagtaattgctttgaaattcttacgaacattgctgccttaatacttagaaagaaaatgatttggacacattttgcaagattttccttaagcttcaaaacaaaacaaaaaccaaacacaacaaagcaaacaataataaaatacacacacacacacacagacacaattctttcaaatgagaaatacagcttcttatatattttttcttttattcacaaaagtgctactatgtatatgtgtttataatataatctaaaatcttcacttgtcataggcagtcttttttcatactgtgcaacacagggctatttttagctttgtctttgtcgtgctatagcaactcagtctgttcagcttcatcatatatccaagccctaatgtacacctccttttctgaattttaaaagcctgttccccctctgtacccttgctcagagaactcaagcatatctactttcagctcccatcacaaggttaattcctcccaaacctcaattgcaatctccaaactcagatttccaagagacatcaaggcctttggatgtagatgctttgctcttacactttaacctcaactcttttatctcatcatattccctcctaacaaatatgttatttagattttcaatttcagaaaatactatttttccattcatccagtagtgttagtaaataacagatataaggaaacaacctaggtgttgaacaatggggataggttccataatggctatattgtaaaaaggaatgctatgctagtatcagaaatgatacagaagaaaataatttattgacatgaaagagggtttattatgtacaaagtaaaactgtgagttaatattataatattatatgtaaattccaagtttttggtggaaaaacacatatatctattttgctgtacgtttctgtttatccatcaatcacaaaagataaacatcaacatgctaggagaattacatctcagaatcagggttttagatgacctttaatttttaaatttttgcttattataattttcatattttcaataataaatacaagttaattgagatagatttgaaggtaaactaaaacaatttttaaaagccatgtgtgttagttcatttttacactgctgttaaagacatgctcaaaactgggcaatttacaaaggaaagaggtttaactggacttacagttccacctggctggggaagcctcacaatcatggtgggaggcaaggaggagcaagtcacatcttacatggatgacagcaggcaaagagggagagcttatgcagtggaactcctctttttaaaaccattagatcttgtgagacttattcactatcaggagaacagcacaggaaagacctggccccatgattcaatttcctcccaacgggtccctcccacaacacatgggaatacaagatgagatttgagtggggacacagtcaaaccatatcatcctgatactctaaaacccattaagtgaagctcaaagtaaagagcctgccctttagtttcctccatagagtgtcctgaatcaactttttcagttctatgtattattatgtagagctagaacaatcaaagagactatctactttaaaagctttattttacaaagagaaaacaaaagccaaaggaggctaaatgaatatctgtaagttgctcagttactggtaaagccacaataaaatatatagtttgctgtcttgttggcttatgttcttaagccacccctcagaaataaaatgtttcaatcattgcttctccaaaatactttgtgcctccctacctctgcacttttcacattccatctttcttctccatctgctgaaaattacccattctaaagtccttcccttgtcattacagagaaattattttatctgagacacttatagatcataaaaaatataattattttaattaattacattgaaaatatttggttatatgtttaagtattaaaatgcattaacttccccatatttttcaggaaaccaacttaaaatttctttgcatggcatagtctgatttttttataacatagtgccaatatacctgttagactcagttattaatgttcatatagaactattttcattcatttacttattcagcaggtatttgttaagaacttggggttaaaaagatgaacaaaacagacaaggtctctgacatttatatgcaaaaaaatacaaataaatctaccacctaccaccaaataaacacaaaatttaaactaccaatagttcatcacactgttacatgtattttacctgcctaaaatacaaataaatctaagactttactcatgcgttaaactcttcataatccttccaaactcaactgattcattcaagcatatacttcttgggacatttccttactaccacctatacacttttctgaagtagttacctcttttttatttactattccacaattttactttagtattattctttgagttctgggatacatgtgcacaatgtgcaggtttgttacataggatgctatggtggtttgctacacctatcaaccagtcatctacattaggtatttctcctaatgctatccctcccctaaccccccactccccaacaggccccaatgtgtgatgttcccctccctgtgtccatgtgttctcattgttcaactaccacatataagtgataatatgtggtgtttggttctctgttcctgtgttagtttgctgagaatggtggtttccagcttcatccatgtccctgcaaagcacatgaactaatcccttttggaggctgcgtagtattccatggtatatatgagccacattttctttatctagtctatctctgatgggcatttgggttggtttcaagtctttgcaattgtgaatagtgcttcaataaacatgtgtgtgcatatctctttatagtagaatgatttataatcctttgggtatatacttagtaatgggattgctgggtcaaatggtatttctggttctagatccttgaggaatcaccacactgtcttccacaatggttgaactaatttacactcccaccaacagtgtaaaagtgttcttatttctccatatcctctccagcatgtgttgtttcctgacttttaagttatcgccatgctaactggcgtgagatggtatctcattgtggttttgatttgcatttctctaatgaccagtgatgatgacctttttttcacatgtttgttggctgcacaaatgtcttcaaacagagagccaagtcatgagtgaactcctattcacaattgctacaaagagaataaaataccaagaaatacaacttacaaggaatgtgaaggacttcttcaaggagaactacaaaccactgctcaaggaaataagagaggacacaaacaaatggaaaaacatttccacggataggaagaatcaatatcatgaaaatggccatactgcctaaagtaatttacagattcaatgctatcccaatcaagctaccagtgactttcttcagagaattagaaaaaagtactttaaatttcatatggaaccaaaaaagagcctgtataaccaacacaatcctaagcaaaaagaacaaagctggaggcatcactctatctaacttcaaactatactacaaggctacagtaaccaaaacagcatggtactggtaccaaaacagagacatagaccaatggaacagaacagaaccctcagaaataatatcacacatctacaaatatctgatctttgacaaacctgacaaaaacaagaaatggggaaaggattccctatttaataaatggtgttggtaaaactggctagccatatgccgaaaactgaaactggaccccttccttacaccttatacaaaaaataactcaagatggattaaagacttaaatgtaagacctaaaaccataaaaaccctagaagaaaacctagtcaaatacctcaggacataggcatgggcagacttcatgactaaaacaccaagagcaatggcaacaaaagccaaaattgacaaatgggatctaactaaactaaagagcttctgcacatcaaaagaaactatcatcagagtgaacaggcaacctacagaacaggagaagatttctgtagtctatccatctgacaaagggctaatatccagaatctacaaagaacttaaacaaacttacaagaaaacaaacaaacaaccccatcaaaaagtagatgaagggtatgaacagacacttctcaaaagaagatatttatgtggctattccacagtttaaaatatgctgctactcagctgtcatcatagtcggctgtacatgttaattttctcttcaaaaacaagctccttgaggacagtgaccaaacatatcttaaccaaattattatctccattgcaattaaaaatatgcatgtatgtcgggcgtggtggctcacacctgtaatcccagcactttgggaggctgaggtgcgtggatcatgaggtcagtagatcgagaccatcctggctatggtgaaaccccgtctctactaaaaatacaaaaaattagctgggcatagtggcgggcacctgtagtcccagctacttgggaggctgaggcaggagaatggcgtgaacccggaaggtggatcttgcattgtgccaagatcacgccactgctctccagcctgggcaacaagtgagactctgtctcaaaaaaaaaaaaaaatccatctatataaaatacttattcttgaaggcaattctttcctctgtagagatataaataaaatcaccttttcacatggcattcctcaagtatattttgcagaactaacatatacttcctacatctcctttttttctctaggctaaacatttttatctttaataattatttttaatacaaaatgcttttagtattctagttatcctttgtcagatatctcatttacctatatgctatgaaattgaggaatccgctaacatagttgaaaaggttaaaaatgagaactcgaatttttgccatttccctccctcccttcccattgtaaagcaagaatcattttataacctggacatcaccatgacctctttgattgttcaaaatacactcaatgaaaactaaagaaaactacaaaaggaaaagaagctgaagtcctaaagaactgagatgagaatggtaaaaatggagattaaggaaaagctaaatgtccaagttttagagtgtaaagataaagagcaacctttcctttttagaagtccttcctagacataagaaaaattgaaaataacaaggatgtttaaagactatttttttaaagtttgctttcttcacccttagaatttttggggggagactgagtaaaggttttattcacttacaataaaatttctaaaaattaactccatgacaagtatagaccatcaggagccccaaatatatatgcattacacttaatttttttcatttcattgtcatctgcaagttccttcaagcttctttactacatacagaataaagcagaacctcagcattatataatcccaattgtgatctgggcccttctccctccccgccctttctaatctcatctcctatccctccttcaaaatattttttgcttccacttattgaactagttataatttctcaaataaaacaatatcattaatgcatctttgcattttgcctttcgttttttgtttttgcttagaatgttctttcctgccggtgttaatgctttgaaaattccaactaagccttcaaaagtcagtcctgttgtcctctccactaaaaatcctccttatgtgtaaaaaagggagacagagggggaaatgataaactatcatttaatgcgtatagtgttttagttttgcaaggtaaaaaagttctggagaaacatgatgtatgtgcttaatgccactggaactgtacacttaaagatgtctaagatggtaaattttatattatgtatgttttatcacaatttaaccatgaataattattttaaactaaaaaaaaaaagtctagtaagcctcttgacagaagataccgcaaaggtgtcatgaaggccaagggttgaagttttaaaacctaaactgtgtaacaggctctgtaacggggagaaacccaagaaacttatggtcaagttgaaactcacaaactgcaggaatatagtcattggggtcccttagatgcagaaaagaaaattaactacagcgagttatgtttgtatttcacataagaaagaattttgaaatagagttgtccattaggggtagggtctgtcctgggagatgtgagctcatttccattggatatgactcagattatctattagtcatgccatgggtgtgaagttggagctagataaactttaggatattttccaagccctaattccatgactttgtgattattatcgccataaactctgaagtcttggctgggcacattttccacaaggggcttgtggtaaagtgtagaacaacgaactcagaaaaggcctattcaaaaatcagaactagtcatggtctaagatatattcccacaaagttctgaggccaagataacttaccgatatataacccaagaatatttctggatgtttcagttactgagcatccaggaagcctcacctctggacattgtgtgctaatcatctcttctttctttctttttttgaaaacagtctgtatccatcatcaaacacccctaggatgttatccttcttgatggacacattacagtttattcaggatataatttacacccccaaatttctatccctaactcagacctctcctctgattagattgttgcaatcagttggatatttctgatttgtattttaaacttattacacttgaatatttattaggcattttaaactgaaaacccctgacgcaaattttctgccatcaaacctgcttcttctacagccttgcccatttcaatgaatggcaactgtatccttccaatacctttggccaaaaaccttacaatcatttgtgccttttcttttacaccttacagccagtctgtcagaaaaatctattgtccctttttccaaatatattacgtttctcatctccactactacctcctggtctaagcatggttatctctcactgaatttaccacaataacctcttaactcatccctttgcttcatgtctcagtctttcgcagcacaggaatcacagtaggctgatgattcctactcaacatttatggtgagtgattgtggtgatggttgcatgactccatacatcagtcaaaactcatcaaatggtataatggaaattggcaaatgttattatatacaaattatattgcagtatagctgatgaaaacagaaaagaaagaaagaaaaaaaaacctcctcagcttcccacaagcaaagctgcttcctaatcgtactctgtacttatttgcttacatatatgctatctcccgcttgatttaatttcagcacctagcataagacttggcagagagatactcaacatatttactgaatgtattagactagtgaccttgggtacttagtgtctttttcaaattagtttccagtaaggtgataatcagtttagatgaaataatcattagctttattccaaatctataaaagcccattattctatgattctaacatagagtggcattgaagctctggaagattgctgattttaggccagtctctccaagagccatctagtgggaagagtaagtaattgccctgggtaattagagagagagagagagagagagagagagagagtgtgtgtgtgttttaggccagtctctccaagagcatctagtgggaagagtaagtaattgccctgggtaattaagagtgtgcgtgtgtgtgtgtgtgcgcgcgcgcgtgtgtgtgtgtgtgtgttttaggccagtctctccaagagctatctagtgggaagagtaagtaattgccctgggtaattaagagtgtgtgtgtgtgtgtgtgtgtgtgtgtgtgtgtgtgtttctataattcagtcacattaaatgacacaaagattcaccaacatcacacttttgccaaggtcttgcctaaaatagagcatttttctccctactggaattctgacttccaatttagaatgaactcctttggtgggaagtaatgaattggcctcagatacttatcatgagttacaggaagatctcatgaaactcatgcagaaatgcagccaggcctccaggaagagctgggaattctcgaggaaagtaagaagatttttcgtgctttgtcctctttctttctatgtacagctactttattcttctccctcttccaattggctttctctacttctttatccagaatgattaatattgtgtaggtctagaccagtaattttttactctacttaccagaaacacgtagagagttttaaaaattatgatgtccaggccaggtaccttcctactaattatatcagaatcccttggagggggactcaaataatagtatttttaaaaatattttaaaaatccctccaagaaattacacagagcattcaaggatgaggtcacttctccagtaacatgagttcttttcctagttcctaattatcaagtaagagattcaggcttggccaatattgtgttaggtgtctattttattcaactacgtggctactgggggtctgttcaagagaacagaccgtttaagttcggaagatagtctaaaaggtgctcatgtggacctctcatctgctaataaagtgtcagctctgacaagcatcaacacattgtccaaatgttaaggtctactgtaaaaataggacagttaaaatgtttttctattttattcttaaaatcaacaagacagttgtccatttgcaagtaatatttataccagatccagtgataagtattttttaatcacgatttttaaggtatgcattattctcctattgaagatgaggaaagtgaggcccaaagaaagtaaactgcttgtccaaagattaataagtggtagagcaagacctgaattgaaagtttacacaaactacattatatcaaactgcccccaaccttttttttttttctttttttttgagacggtgtgttgctctgtcgcccaggctggagtgcagtggcgtgatctcggctcactgcaagatctacctcccgggttcacgccattttcctgtctcagcctctcgagtagctgggaccacaggcgcctgccaccacgcccagctaatttttgtattttttgtagagacagggtttcaccatgttggccaggatggtcttgatttcctgacctcgtgatctgcctgccttggcctcccaaagtgctgggattacaggcgtgagccaccatgcccagctgctgcccccatcttacataaacatgaattttctaaattattaatgtcctcaaaacaagaaactaacctaaaaagttattcatgatggtttgattgaacacacagagtacatatacacacacattgaaaaatcttatcaaaaataaaaaccataccctattcaaatatcattaagacaatcataatgccattaaagaatagaaataaaaatacagtcaaactataataacccattattttattattaaattattactctttaccactggtttcctctgttatacctcgtggggtcatggaattatagcagagacatttggatgtgtaatgattatgttgttgggaaaaagtaactcacatggtaagtatacatcccagtggcattttctcctgatttgctttgctagaatgaaatttggaaaaaaaaaaaaaaaaaaaggaagagaaaagcactactaaaagcaatactagtggtagtgtttgttatatttgattgaagaagaaatcaccatcactatgttccatgcaattcaaaataatcaaacagctttcacttagtcattttgtttatatttcattgtgatatgctacaacgggccctatcttggagtacagctgctatagaaacatccattctgaaattattttaaggaaaagaataaataacattgcatagctgcttgtggctagattaattcacagactggattaatgcattaataattaactcaagatcagttccttcgctctttgaagaaatatctattgagggaaaaatcttacagggtaaaaattaatttggattagctgtttccatgatggaaaggcctagctccagtgattacaattataatataaaaacagatttcattctccattttgagaaattattattcataataaaatttccttctgatataaaatcttttctgatttgaggcttcagaagtttctacaaaataatgattccattttacgcatttctttaaaagactgtgttcacattcttctatacttgtaatctgagcataaaataagactagaaaattaaataatattaattggctccatggcataatggtcagcatatctggactctgaaaattaaatgatattaattcaaatccatgtcccatctttctccatctaaactctacctctacccccaattatcagctctttagcaacttaatgtagtaacatgcaaaaactcctcctccttcaacaaaaaataactattcctccccagttttcccccatttactttatgacactaccatccatcaagcttgttaaaacctgttaattgtattatttttgatatttcttctctctcaaatcccatttctattctacagcaaatctaattatttttgactccattctctttgccactattatctcttactgagactttttcttactgacttctgcattctccttgcctcctactcaaatctgttctttactctgtaccagagtagggtttttaaaacagaaatttgattgtgttatgcacctgcttaaacttttcattagtttttcattggattttgttaatattcaacttttcatgatagcctacaagctctttcatgatatggtcctgtctgcctatccaaacttaccttatgccaatctctataaatatacacatcatagtcacatgtgccttctaccaaactctgcctttaactggacatttacacttgctattttctctttctgatgtattctttttccatacttctatttccttgtaaactcttctcccactgccacgtaccagctctttagcaacctgaggtagtatcaccaatgagccaagtgaacttgtaaaatatgcttcctaaaccccatttgtcccatgatctaaaatatttccttagcatataaaatttatctatatctatcaagtgcattctatacggcaggcattctgtccaggtgctaggaacacaacagttaacagagtatcttttctttcttttttaaaaaaagtagtctattttatttattaatggttaaaaaacggcttcactaaacattgttttgttatttaaatattaatatgctgagagcagtattattacacacctttttttccacagccttattgaggtacaatcagtctacaataaacataattaatgtataaaagtcagtgctttggatatatgcatacactcatgttactatcactacaatccacgtcacaaacatatccatcacgttcaaaagtttacttgtgtccctttattgttgcttactttatcccttcctttttttcttttctctttctcttttcttttctttctttcctttcttttttctttcttcctttcttttctttcctttctttccttctttcccttcctttctttctttctctttcttctttctttctctttttcttttttccctttttctttctttcctttccttttctttttctctctcttctctctcccttccctcctgtcttccctttccttctttcctctttccttctttctccttcctcccttccttcttttcttttctttctctttctttccttctttacttttcttttctttccttctttctttccaatatacccagcatccctctcacccatctcctggaaaccatcattctattgtctatttctatacatttgactaccttagatgcctcatatagagggaatcatgcagtatgtgtccttctgtgatggccacttcatttggcatgtcttcccggtctatccattctttcacaaacagtacaatttctttcttttttaagtctgactaatattctcttggatgtatacatcagaatttctttttttttctttttttttttttttttttttgagacggagtctcgctctgtcacccaggctggagtgcagcggcacaatctcagctcactgcaaactctgcctcccaggttcacgccattctcctgcctcaacctcccgagcagctgggactacaggcgcccaccaccacgccaggctaattttttgtatttttagtagagacgggttttcaccatgttagccaggatggtctcgatctcctgacctcgtgatccgcccgcctcggcctcccaaagggctgggattacaggcgtgagccaccgcgcctggccattatccatttatctatcagtagacatttaggttatatcttggctattgtgaataatgttgcagtgaacatgtgggtgcagatatctctttgagataatgatttcagttattttagatatatacccagaagtgggactgttggatcatatgatagttctattttaaattttttgagaaacatctatactgttttctatagcagtttcaccattttacattgcaccaacagttgtataagggtttcaatttctccacaaacttgtcaaacttttgtttttctgataatagtcattgtatcaagtgtgaggtaatatctcaatgtggttttgattttcattttcctgatgatcagtgataagcattttttcatgtacctgttggccatttgtatggcttgtttgaaaaaatatctattcaagtcccttgctaatttttaaaattggactatttaaatattttgctattgaattttaaaagtttcttatattttttggaaattaactgctggttaattaatggtaaatatttcttcccattctaaaggctgctttattactctgttgattgtttccttagctatgcagaagttcttttagtttgttgtaatctcacttaatctccttttgcttttgttgactgcacttttggtgtcatatccatgaaattattgccaaaaccaatgtcatgaagcttttcccatatgcttccttctaaggagttttagagttgcaggtcttacattttagtctttaattaattgtgagttaatttttgtctgtggtgaaagaaaacattccaatttaattattttgcatgtacatagccacttttcccaatgtaacatttattgaagagacaatcctttccccgctatgcattcttgactttcgtattgaaagtcattgtatatgttgtatagttgactgtacatgacatggctgtaggatataagctctctattgttccaatgctctacatgtttgtttttatgccagtagcatactactctgattattgctttgtaattattttgaaatcaggaagtataatgtttctagctttattcttatttaaaattgtttttgttatttgggtattttgtggattcatacatattttaggattacattttctatttctgtaaaaatgtatttggaattttgataaggatttcattgaatctgtacattgctttaggtgaaatggatattttaacattagtttttccaatccaagaatataagatgtctttccatttagttttgtctgctttactttctggcagtattttagagtttttattttaaaagtatttcatgtccttgattcagtgtattcctaagtactttattctttctggtcttattgtaaatggatttttttcttaattttttggatagtttattgttggcatacagaaacacaactgctttttgtatgttgatttgaatcctgcaactttactgaatttgtttattagatctccagtttttgtgtgtgtgtgtgcagttttcagggttttgtatgtataagatcatgtcctctgcaaatagttaatttttcttcttgttatctgatatggatgccttttatttctttggtttggcatatggtttttgcccatcattctgttaatgcggtgttatcacatttattgatttgtgtatgttgaaccatctttgcatcctaggaataagtcttgctttatagagatttataggtcatagaatatgatctttttaatgtactgttgaatttggtttgctaatatttcattgaaagtttttgcatccatattcatcagggatattggcctgtcattttctttgtttgtggtgtctttgtctggatttggtaacagtgtgatgctggcctcataaaatgagtatggaagtatttactcttctactttttacaagcctttaggaagaaaggatattaattcttctttaaatgtacagtaaaattaacctgtgaagccacctggtcgtaggctttcctgtttgggttggttttttattactgactcaatctccttatttgttattggtcttttcaggttttctatttcttcttaattctgtctttataggttgtatgtttttaggaatttatccacttcttctaggttgtcaaatttgttcataatagtcccttatggtcttgctttttatttctctggcattagttgtaatgtctcctgtttcatttccgattttatttttgaatactctttttttttcttggttcagataacaaattgtcaattttatcttttgaaaaacaattcttaattttgttgattttgttctattgtatttttattcattttatcatttattcctgctctaatctttattatttccatccttctgctaactttgggcttagttgttttttttttttgttgttgttgttgttttgttgttattgttcatcgatgtttaaagttaggttatttatttcagatcttctttcttttgtaatgcagacatttactgctataaaacatctcttagtactgttcttgcattaagtttttttttattagtcttttggtattttgtgtttttgttttagtttgtcctgagagatactctaatcctgcccccatgattcaatcaccccccaccatgccgcacctccagcactggggattacaattcaacatgagatttggtggagacacagatctaaaccatatcactgaactacagtaatatgttggtttctttcacattctactagttataatattatctgttaatataatagcatgtagactattatagcctctactgcatacaaaccaaagagtctgttcaaagaataaaacagtaaattaacttcaagaaatgactttaagttagacagagatccccctaaaataataaataacatgttgacaaattttcaaaagtgtcaatcaaaaaggtaacaattgccatactgacaggccccggggcaaaggtggtgatactgctgacaagatgtcaatgactaaagtaataaaaacatggtgaccagctcagggtggtgcctgacagcaaatccatgtaacataaaggagtcagtatgatcaaggtgagagtgacgaaggtaaatcaaataagctgacatttaagacaggtgacagcagtgatgttaaatattaagccttggaataagaagttcaaaattgtaagtcaacaacatatcagccaatacttgctcttgtgttaacctattaacccttatatttctagaaggagaattctctgaaatagactaaggtgaggatagagtgtgaagagaaaaccagcgtagttgcccagaggtcacttcaaaatagaaataacaatatctatagggaaggatggttgtgaagatcaaatgagaaaaactacaaaccccaagcatgctcatttgtatccttctgttcccatggtaactctaccccaccatcaaacaccagatcttttagtagtctaaggtagtatctatcaccactgagccatgtgaacttataaaatccatttcctaaactcggtgtcctcataatctaaaacatttccaaaacctacccattgtttcaattgtatttattaagtgcctacatatggcaggcatttcattggccaaccaccaacaataaggtaaccactgttctagggatacaacagagaacaaaactgattaaaaatgtatttgaaggctacattctcacaggatgttgtctggtatacagtgactgttcaatatatgggaagtgatctaaaatgaaataaggtaaaattttgagtattggttataagaatcacaaaaagtccaatacttgtccccaccctggagcagagttctctgataactggtaggaacttacttatgtgttctgacttccacatgctcagctggaactcaaaaaaagagaaaagaacatcatgaggaaaaagtaagctggttattgaaaagaacagtagaaccgagaacagaaaaacttgggttctacccccagcattgccattaactagttttaacaccttaagaaaggcattacatttttttcttttattttttatggatgttattcttttctttatctctttgaggatatttaacaatttttacaacattttcagataattctattattgttgtattcttctgagtaaattatcttactatgtgaatttactcttttaaatccagttcctcagcttcctaactcatggccaactacatcttaaccaaatccagtatagttctccatttttttaaatgggaaaatggttaatccataggtaattttgcacacaatgtgaatgctaagcctctaaaaacaatcaaccataatgggtattcaataaattagatttttaattttttatatatattatttgagttttagaaccatataaaattataattctgccccttccatgaatgaaaatgatgaggttcaagataacgtattggagattttaaaagttgttaagtccttgagctgggaattctacctctatgatgacaaagttctgtctcagagacataagtgagaaaaccaaaaaggcaacatgatattcccaaaagtctgaaggcagaattactgagcaattagttcacaacttgaacccagactgcttgactttcaggatgccattataccatcctggatattttttgatctgatcctttacagcttgtttgagattcaactttactaaatcactgaattcagaagaacacaattctggtcaaaatttctaactaggttattttgtatttaaattctccacagcaaactaaagattttgggtgttttgttttattgtgctacattgccattagacccagcagaccccatgcattagagcgctgaaaatttggcatgggatgcataacacttctactctatttggaccaattgatactgcagtggttaatttccttaatactccatcaacatgaactaaggttagattccctacgtattggatcagatttttcagttagtttttatttctgccattctaatcttcaattatctctgcctgaagtagcaatctattgctatatgggtaaggaaatattctgtctttatggagacaatttcattttaaattacttttcaggtcaaacactgccatttaataaaagtttggaacctatacaaagtcaataaaaggcattaaaattacttattagtcatggtattttctttctctatcaccaactagacagttttgttttgatagctccattaggtacagcctcattgctcattttttccttgacttccttttagaacatatggatgttacaaaaaataaattctcctttacaaacaaaaaccttcacattattaggaatataattgttaatagaaaaagtgtcaagtatctgatgcataataattatttaaaaatattagctgaagaacacatcacaatttaacctgaatgtactatcaaagaggaaaattatgtggagagtactatagggtttaatgtatgtttatttataagcaactgaagaagacttcatttttctatgactgtaagcaaatttgactttactacttgccattgcgagagataaaggtgagatcacatacatttctggtactagttaagtctaaaggcccagtttcccaatgagactgacctgaagtcatctcaacagtatgatcctgacccagtggaaaaacttagcatggaaacagcatttagccatgacatacttcaatattattttttggaggctatcactatctcaaactaaacccattatgatttaaaactgtctttttattgatattcattgtttttcaacctgacagtggccaatgatttatatcaatcttctcttaacacaggaataaaagagtttgcaacatatcttaaactgaaggacactttttcagtaagtctcaagattttaatacagttgtcatttcaaaagcctacctcttctcagttggaaaggtttagagaagaagaagtcagctctgttgataagattgtttttatctgaagcagtagaggattcaaaaattagtatgacatatcgatgatgccctttcttcaggcatttttattctttaagtgcaagaacactgcagctggctgtcaatcattaaactacaaaatgaaatcctttgcctggctaggagatttgcaactatactgatgctggtaaactaaacaccaaattatagccttttctcttgcctcacccagatttcacaggggctgcacacccaaataaatgcctcttggctacccattcatctaacagctggaaagatgacacttgacatttggaaactttcctgtgaagattgctgcaaggctttcccattagcttcctggtgagactgtaaggtcgaataagctgcctcaaaacctgcaaagggtaacggaaatactctaatattaagcctgtgcaatttaaatttctaattctcgaatcatagttcttcagatattgtagaaatcactggtatatttcagggcaaaagaatgcctttgaagatgtgaaattaaagtgatattttaagcaatgataatgataacaagtgtcttttatttaaagttgggactgaaggtcttctaagtaacagggacttcaacacagagaagttcttgtaagtttgttttctaaaatccctgactgtcatattttcaacaactgttcatctttgtccagagcagaaatctttaacacgaggcagagttattaccattcttcactttttttcccacatcataagcattattgaaggtagctttaaaattcttacaacccagcattgtggattcatttcaaaaattactgcccccaacataaaataaaatagtaaatatgccattattaaaatgctgtcatcttataaaattttcaggtataaacaagccttttttcctcttcagaaagataattcctttaaaatgtccccaaatcagaaattgttaataaaatgacagtttattaaagatagcagaaagacaaaattcctcacataatctcaacccaaaaaagaatgtaaaaaatttcatttattgatatgaatgcacacaattcaattagattttatcacaatgatctttttccatgatactcaatttggaattccatatttttaattgtctttataattgtctgttcttgtttgttaactaagtatttttcaagtgaaagattaacaagaatgaaaaggcttccctaaatgttcagtcatatgtccaaattagatgaaattaatgtcatgattaaaaaggaaactgaaacctttaaaaaatatacgttgagggcattgaagaaatggaagacatgaatgatgtaactttcaatcttgaattcatcatcatctgagactaaaatcactttttaaaagttcaggaccagcctgaccaacaaaactaactgggcgtggtggcatatgcctgtaatcccagctacttgggaggctgaggccagagaatcgcttgaacccgggaggcggaggttgcagtgagccaagatcgtgccattgcactccagcctgggcaacaatagtgaaactctgtctcaaaaaaaaaaaaaaaagtcaatttagtgatgctgaattgtacctcattagcaatggatgtgcacctcttggccccaaatcacggcataaacctagttttctcatgccattccattaacgaatccaccaaaaggaagctcagctcacagaaagaagatggaatatctagcaatgactggacttctcatttctcttcaaaccaaaaccacagctaccatttgtactcactctactgcaggtctatggcatgaatttgtctccactaggtcttgaaatcacacattcatttcacatagcctattgaactgccatcagatggtaatgactttctgtcactcttgacctggggcagatttgaactagtgaccaagaggttaaaggctctgtatctcattaccaatcccctgagatacttagttccctcaaccactagtgattttttttgtgcctcagtcaagccagaagaaaatacacacagaaaaaatctaagcagtagaaaagtaggtcaccaatgcaagacatctatgatagttctcatgaacctaataaacacctatttcaaaatatacccatatactacatgtacctgagtagaatcacagtaactgttaaagaacttcattgtaactttcaatagtatttcacataagctaccattaagctgaaaaacactgcagagaaactgaagatacttgtgcttcatgagcttacagggttaaggaatgtattttagattcagtatcattccagaatatttgtgtgtgtgtcttgtgtatctattctaaaataattctgcctcacaagttagtttcagaggggggttgacaaattggaagaaataatatagattcataaatgaaataatcaaaacattatcaaacaccttaacgtggacacttactataggaatacagcatattttaataaggataaagtttgctgaagaaaacagaagaatagtatttaggaacatatatttaggcaaacatatatatatacagtagtagaaatattgaacctaagccaacaatgaaaaaattaactttttgttgttgtttttattgttgttgaaggttgacttcaaatgctggctgctaataaacaatattctataactattcaacggcaattattctgtacataactaagtaggcagtgactcctgaagtcacttagaaatatgtactcaaattttttttaaatttaatgccctgacgcctccttccttacactttgcattttcccctaaatgtttgattttcatggaatgaatcccacttggaagaaaatagatcttttccttttcatttcttgcctatatttaaaatggtgctctatacaaattattttatttgaatttctacctctacctgttgattccatatttatccttctattaataactcttattttttgtctctcaatatatatatatttctaccacaactgcttttgtagcagcaacatgtacatttagttgttcccttccactactggtaataaatactgtggctttttaaacgttgcatctaaaatatagagaattgaaaacaattcttaataaaagaataatgacacggcaaaaataactctaatgatgtaacaaaccagttagttttgtgattataatttctataaagatcaacattatttgacaaaatgttccatgtttataagagctccttctcaggactaccatgactactgaagggacaatgagcttctgatctgggattataatttagaataatttagtttgtgttctatctccaagttttttctcagtggcaggacaaaacatgatgagatatccatatagcctttttctctccactttttgcaaccaaatctgtctatatgctaatactagaacaaagtaagtgctccgccttctgaatgctgtgtgagtggataaaacaaactcagtttctccactaaaatctcacaacacgcttctgacaccaggtgtgtgcgaactgctccccaccagcaagcaagcaagcaatcaattctgtagtggacacaagctgaatgtcttctaattcagctcaattctgacactatctacctgatgatagcaccagttcctacaggttgagagctcattccccaaaactgccccctaccacttcaaatgccaataacaagccccaggttattttacctgtgcttctgaccaaccagctataaactgggattcccacaaccccttcttcgggttagattaactggttagagcagcttacagaacccggggtggggggtggggggtgggggtggcggcggggcagggaacaaaacaaaacaaaacaaaacaaaacaaaacaaaaaccaaacttttactagtttattacaaagagtattttaaaggatacaaacacaacagtcagatgaagagacacatagggcaaggtctgaaagggcccccagagcagaagcttctgtccctgtggagctggggtgtgccaccttcttggcacacggaagcgttctagtttactttcctggaagcacccccgtcacccatatttgtctattggcaagttctcagaacctagtccatttgagtttttatggaaagttcattacataggcatgattgattagatcattggccactgtcaatcaacttaaccttcagccccttgactctccccggaggttggggagcagggctgaaagtcccaatcctagtcctgcctcagtccttctggtgactagcccctatcctgtagttacctatgggctgtcagccatcagtcaactcattagcatacacacacacacacatactcatcactttggagattccaaagattttaggagttgtatgccaggaaacagggtaaagatgaaaatttcacaatatcaccatgtgtttttataaattagtaacattggatattaattcagtctctatttggtgcttttgtaatgaagaaactgaggtcctctacatgctctcttaaccaagttggttgcatctgacagatttactggactatttccttcccttgttttcctccctaagagacacaaaagatggccaagtaatgctgatgctttataaccagtggtacccctgtatacctacgaaatttctgcttttattagttgagttgtctacttatcaagagtcagctgtatgtttctcgccctgtttctgttggatataaatgtaaataaataaacattaattagttatatggatgcaaaaagaaagaaggttgattctatgaaaactaagttgaatgttcttgaaggatatgataaaaatgagttacttaaaaaatactgctgtcaaattaggtgttggtcaaaccactgaaatgactgcaggacaaacataaaaatctggaaaattgcattgtatgattctcgaaggtcttgtaccacttttaaaaatgaaaatggtagacaatatgttatagatagatttaggcaagatacataatacacatctggctattttatttaaaaacatcttggccctggatttttttaaaagaaaaaggaaaatgagaaaatatctatatgctttaaataaaattataagctttggtcatgtgctgcttatgtaataaataataaaatgatgaggttaatgtatgtgtatatcctttttacagtttcccattttaactttttctgattaaccaacaaagtattaattttggtttcataggaaaagagaaattaaggaattaaactaattaaggaattcatttagctatagtcattctttcagttacaaattctttctttaggtacactgtcaaaattatctttcgtattcagtaattcttattcatttggtagaagaaaataaatatgcctggactccactaatatcacattataaacaattaaggtgaagtcatattgaattattagtagaagtaactaaaaaagtaaatttaatattataacagaatgacacttaagaagggaatttctgacaaactggaaaacgcttttcttcacattaataccagatctgacactaccatatcatttctatacatgaacaattcctaccacattacctactccaaattgaaatcctagctaggcaatctcatcatgttctactcctggtataattactgaactttctctctctcatttttcctatataatctctatattcagagcttccatttgtccaccctatgctttttggtgaaataaaaaggagttgctgcacagtgcaaaacttatggaccaaacagagaacatctttatgaaaatttgaggaaggtactccctcctctgtatagaagcagaacaacaaaaggttttattgtttgattagtggagcttggtctggatttcagccagcttgtaccctggtctgggtacccctcatggagtgagcaacatataaaatcttatccagtagccttctttaaatcccagtaaatctaattacccagtattattctaatttttcttattctttttaaattttgtttcttgttgtttgtgatgtccttgctgattccacatcctaatacccacatccagatggaatcagtcattgtctcttccaggttacctttgtaacttgatgctttttattattgtgttaagtatgctatattgggcttacatttacacaactcacttctttactagacaataggattcttacttgcaaatttaaatctaataattggtgctatctattatatccactactttttaaaatgcatcttttgaatgaatgaattaattaatgcataaatgagattgatggatgtatgtggatgaataaattaatgactaaataaaatgcttttgcaactacctaaaatatcctatttcaatattcatctgttaagactctatacatcagatttctattcaaatttcctatttgccatctttttcctgatctcgttttaacaatacaaggtgaatgatttctaataacccacaacaatggtatacacaacaaatattcacaaagcttagtctttaccaagagctttccatactttctttcataatcttctgcaagacccaagaagatagcagctctaattattattttaagtaataataataatttataattgcttattcacttctataccctggagtgctgaagtaacctgtccaaggtaacatgattggaaagtgttggaactggatctgatgtcttctctgtagttcagagagcccaaatttataaccactatattatactgctcttatttatgcattgtggtaccctcccgaagtcaagtgtgggcccaaaggctattacttaataagtggtaattgagcaaattaactgatgaaatttaagtgaagctctcctcagagaaattgcctccactttctcccaacatggatgtcttcaaacaatcacatttatctgaaaatgcatattacaaagaatttctaaacacccaattgcatgcattaatactataatctgtttataaaatcatattttaaaataagctattcaatgttaccttttcccccaaaacaaactaatgtaaaatataagacaaaatgtcataagccttagttgtgaaacatactatagacattacagaaatttttttaacaaatgctacatttgtgagaaaacaatattatatgctaatgaacttatcatataacaaactcattagttttcttaactcctccttaaatgtatttaagataaatgatttctgcatatttttcctatgtaatagatgaatactttattttgagggtacagcaatacataaacatggttcctagcttgtgcagagacagaccagtaagcaggcttcaaacaaggagcacaaaggaagttcatgtcacaaactccctggacgaggaggagaaagccaatcctgaaggacaagtgggactcaaccagagggaaatgggtgaagtgggggaaaggcccagattcaggagaaatcttggtatgcttggggacattcaaatcagcatctcaaagctaagaagtttggcctttaccttgagtgtgagtaaaagtcattgaagggttttaaatgagctaattaggattcaactgataatctagaaagatgactctggctgcagtgtaggggcattggatttgacaggagagaaagtggaggcaatttcaagagaggtgatagaggccagaactaagttaatgacaatgtggagagagaaaaatcccactttgtctatatgtaccttgttagccttatcgctgcttagcactttgcatccaacaccctggcaggaaggtggaaatgttgattttacttgacagagatttttacctaccttccatctctactccattttaacatgtaattcaacacttagtttgacaagtctgaatccttcaaccaaatccaaaattcttacatggcacaacctttattttatatttcaaacactatcattcctagcaatatgtgtttttaaagcacatgcatgttttcttcattatagctaaaggtctgtttctctcctttctctacacatcagatttctattcaaacttcctatctgccattacatggaagtaaaataatttctttttttttccagtacacatttattagattcaggaagttacaagacaacagtgaaatgaacagaaaaaaaaaaaacattaagattcctttagaatgatattgtgaaacaccaccaaactacaatcataaatatatttaagcattgtttattcattttaatttaaaatctataaatggatttaaatatttaggataagaacaaaaaacaaaatcctccactgacctgtgttcaattttactttttcaaatctttttagcttctctgcccacataccattttcactatgaattcacacattcactgggcttcatctggtctaacacaagaacctcatctcttatcccttgattccactttcatttcttaaaggagctagcaggctgctcagtaagatttctggtcaatcaaaattataactccacacaaaagataaaataaaataagggtataaaagagtttttaagagatagaataagaattgaccagttatatagaaaagagagaagaataaaacttagataagtagttggtaaatacagctatgtaccgttttgtcttataatgaaaaaaaattatgtgcatgttgtatatgtgcaccaatgtaaatcttttaactgtactttcttgagcgtatctcttattctgagactctagcctttcctaactttttcataaagtgtcctattaatttatataaataaatgtcagtttcctttgttctaatattgttattctgtaaaagaagaagccatcagcattgtattgatttccaaatcaatgttgaaattttaattattctgagtaatttatgaggaccactaacttagtaggtttgaacctggaaataaaaaatgttaaatactggagttggagcaagttgggaagaaatgtttgacttaaaagcagtgaatctgaaatgtaggaaagacatttacatgaagatgtttggtgaatatgaaaagtagattagagacacaagggaagatattcagtggactgctggattatgcaagagagtgccctgttggaggtacagattagagagttacacagcaggaggtaagattaaaaactgtgaaactaaaaactgccaactaatagtaatggccccgaaccgtgaagaaagggaatttcgtgctccaactttggcatccctagaaaactgcatgaagctttctcagatggccgttcagggacttcagcaatttaagtctccccttctgcagctcccttacattgaagaggacaatcttagacaggtttctaatcataagaagtataaaatttaaactatccaggatttggtgagtttaaagaatcagattgtcatactctactgcacttccttgaagatgaaaaatatgaagaggttatggctgtccttgggagttttccatatgtgaccatgaatataaaatcacaggtgttagatgatgaagacagcaacaacatcacagtaggatccttagttacagtgctggttaagttgacaaggcaaacaatggctgaagtatttgaaaaggagcagtccttctgtgctgcagaggaacagccagcagaagatgggcagggtgaaactaacaagaacaggacaaaacgaggatggcaacagaagagtaaaggacccaagaaaactgctaaatcaaaaaaaaagaaacctttaaaaaaaaaaacctgcacctgtgctattaccacagtcaaagcaacagaaacaaaagctggcaaatggagttgttgggaatgaagctgcagtaaaggaagatgaagaagaagtttcagataagggcagtgattctgaagaagaagaaaccaatagagattcctgaagtgagaaagatgatggtagtgacagagactctgatagagagcaagatgaaaaacaaaacaaagatgatgaagcagagtggcaagaattactacaaagcatacagcaagaagagagcgctctattggaaaccaaatcaaaaataacacatcctgtgtatagcctttactttcctgaggaaaaacaagaatggtggtggctttacattgcagataggaaggagcagacattaatatccatgccatatcatgtgtgtacactaaaagatacagaggaagtagagctgaagtttcctgcaccaggcaagcctggaaattatcagtatactgtgtttctgagatcagactcctatatgggtttggatcagattaaaccattgaagttggaagttcatgaggccaagcctgtgccagaaaatcacccacagtgggatacagcaatagagggggatgaagaccaggaggacagtgagggctttgaagatagctttgaggaagaagaggaggaagaggaagatgatgactaagcagtactctgaatggaccatagtgtttgcacatatttgcaattttttgctgttttggaagtttatcataaaccagaaacagtacagaactgatgttgagggaggtgtagtttttttactctagaaatgggtgcataatataactaggcagtggcagtgccttggtacaacctgaaaaatgttaaggcttactgaaacctttcaagtatgggatggtgcatttatttcatctgcaaatgataataaatcctttgttattattaaaaaaaactgtgaaattactctgaaaataagagtagaatgagaaaataaaaacaggaagatagtttggggggcaggaaatgcagaaggaggcaaagtagggaaccatccactccctgagtggatagctgtcctttgctgcttcctctgtctgaggcaataaacacttggtaaagcatagtgctgctatctatccttcagtcactgcaaagactggagcctgaaccactcaccaacttgtctcctttgggttttccagtgtctgtctctgtttaaattgtgttctttttctttctttctttctttgcctagcctagtcccttttgatgtataactttttaaagttttaaaattttagatttggcatctccctagatgctatttcctgaatcaaagctttgtctctttgcaaaatccacaggctcctttctctctctttctctctcgttgttttgttgttgttgttgttgtttaaagatgaggtctcactctgtcacccaggctagagtgcagtggtgtgatcatagctcactatagcctccaacttctgggcttaagtaatcctcccacctcagtctcccaattacctcattcattttgagattcctacatttctgggacaccacggtttggcccaacaactcaagccccactactcaaagatgccaaggaggaggtggaagtaggcaggtgaatcaaacttttaaaagatgatactatcagtgtcaagtccaggccctacctagcaaataagtaggtcctgcattagttacacaaacatgagaaggacaactagaatagacaaaatggtcatggaaaagaggaagaaattaaaggaagcattaaagataaagtgaattttgttagcatgtgggaaacaaacaagagaaccaaaacaagagtggtaaaaacaagagtggtaaaaaggcatagtgtgagcactcttccttgaataggaaagaaagaataaaaattttattaacaagagcaaattttccaggaacattttacataaatgaggtaactgtatctacatttaattaaatcacagaacaaaaagaaaacaaagcatttagtcggaaagtaagctactgagatctggtagttacacttttcttcctcaagaccacagtcgttgtggcaaagtatgctcagcttcacatctcatcatttcacattctgtatcctaaattgttaaaaactaaattgttttcaaaaattacaactgaaggctgggcacggtggcttatgtctgtaatcccagcactttgggaggctgaggtgggcggatcacttgaggccaggagtttgagaccagcttggccaacatagtgaaaccccatctctactaaaaatacaaaaattagctgggtgtggtggcatgaacctatagtcccagctactcaggggctgaggcataagaattgcttgaacccaggaggtggaggctgcagtgagccaagatcgtgccactgcactccagcctgggcattagagcgagactttgtctcaaaaaatataaaaaaattaaatttaatttaatttaaaaaataaaaattacaactgaaattcatcaaatgtttgtttcctttccacttaggtgcatagaatttggaaaacagacaggaccttatctggtccaaatgaacagatcaaaccatcttttggagtatgtaagattataattaatgtagattctagtatatgtcctataatattgtataccatcagatttgataagtgtatgatctatgtatttaagccaataataaatattttgaacacatcaggactaatgacttcacagtactcaaatggtaggaatgcatgataaattttctttcttattttttttttttgagacaaggtctctctctgttgtccaggttgaagtgcaagtggcacgatcatggcttactgcagccttgacctcctcagctcaagagatcctcccacctcagcctcccaagaagctcgtaccacaggcgtgtgccaccatgcccatctaattttttattttttgtagagatgggatattcctatgttgcccaggctgatcttgaacaccgggctcaagcatcctcccgcttcagcctccaaaattgctgggattataggcattaggtggcatgcccgcctggcccaatttttaatcaactcaacagttctactacctagtctacattttaaaatttgtatccaagtatgtacgtgacatattgtatatatgcttattatataccaaatagaaatgctcttatagatgagtatcaaaaataaatgaagcacttatccattggaaaagaattaagtggaaatgatggcaaatgcctacctgtacgtatttgtgaatgtaccaagaagcttgctttccatcattcaccgattccactgtagtgttagccaaaccaacgacatcaccacctgcaaatacccatgcttcactagtttgcatagtttctggatctacttctgggagaccccatctgttaaattttatagggctcaaggcttcttttactgaaaaaacaagtgaaaaacaatagacaatcactagtcaacagacaattccataacaataattttaaaattaagaaaaattatggtttaattattgttccagggattcaaacaactgtttttagtaaactataaaaatgaaaagctaacgaaatattggagttaacaacacatttgaagggcactgacttaactttacacctcacatacaggaattaaagaccacagatttggtcaatgtttcagagcggacatttatgtctacgaagtatggatctataaagaaggaaagtacaaccttttaaatacatacaaaatacatttttctaaaactttattcatagccatcatttttacaaatctgttactacttatattatccccaacttgttcatgtgtgtcacttttgaaagttacatcatgaattcaggtcaatggctaatctcccttttacaacaaaacattttataaagcaaaatgagacaacatatataacattttcattaaattatttgcacttactattaagcaatttaatggatctagtatacagttacatttagccagcaatttctgctttgttttgttaaaagcaacaaatgcaaacattaccattaattccttgtggaaattgctctgtaaagtagttttgcaattatttactaaatatgctgcattctaatgaatctaaaagagtcatggaagaggaatgaagctgtgtttctttaagaaaaatatctaacgaacattttgaaagcataatcctgacatgtggaagagatcaatggatgcaatttagagaaagggttgagtaagagaagaaatgaagaaaggtggacaacaccctatttgatggagtaaactgagtaagccagtgtttaggataaaatgttctctccaggtaacgtcataatttttaagcacagcatctcagacagactaagggccttattctttactccaactccaaagagaaaatattagtaacaacttaaactaaaggaagagagcttgggagattttggaacagaaaagttagttgttgaatttatttatgaatcaagtataacacaaaatagccaaatacaaaaaatgttatttttgacacctaaaaccagtttcttctgagtaaaatagaggaaaaaaatagaaataaaataaacactggtatatatttgtagctttctacttaaagaatgttagagttgtagaaaattattgagggtttactgttgattgtgtttttcccacaagatcataggttccatgagaacagcaatttgtccacactgcttgcctgtgttccacagagcacactacagtttttggagcagaggacactcaattggattgatggatgaatgaatgaatgagtagatgggtcaatgctatcatactcaggtttttattttaaaatcttctactgtttctatttgttttttcgtctttcattgagaggaaaattaaatattcatgtaattattttcaaagcagaaaggcattttaaggaaatttttctaatgtttttaaaggtcacatgaaaagagatctttatcatttgttccctgttgcataacagatcatcactaccatctgttgacagttacttgagttgcaagaaagtcaatagtgagtatggctcatcaattcaacctattttaataatggcaactgtaacacatcatcattgaatgatatatgtaatgagctttataaatagtggcaaggggtaaaaatgaattctgttctatcagaaatgatcttatgtttccaaaactttggcctacaacagatctgaaataaagataattaataaaaagataagaaattcaaaattttatcactaggagatcaaagcatttttttttacatttatctcatgtttcacagcaatatccttgaaatttaagtagagatttcattctatgcttgagcaaggtaggaataattccttagttatctctgagtcccacaacataaattagagtcaaagacatgtttacagtcggccctccatatctgtgggttccacatctgaggattcaatcaactgtgcattgaaaatatttgggaaaaaaatagaatgtttatgtctgtactgaacgtgtacatacttttttctttccattattccctaaacaatatagtatatcaagtatatatacagcatatacattgtattagatataccataagtaatccaaagatgatttaaagtatatggaaggatatgtgtagattatatgcaaataatacactattttctataacagacttaagagcatagatggattttggtatccatgggggatcctggaaccaagcccccctagatgtgaagggataactttatcatgaagttactgaagcttaagtagggtccctcacttgcatgggactctttcaaagccctgcgcctaatttcaaatctatgaatttttcttttcttaaagaagagctctcaaattgtatacacttcaggcctcataaaatttgaatcttcacttgagcacagtgaattgtacacaggaggtgctgaataaatgcttcacaaattaaattgaagttcttgaagaatgtgctttaccatattttaggatgcaaaaaatgtacatagaacaattcactttaacactccacctgtcacaaactcggtccataagtagtcaggaaatgttactctgagtttaataagtaactttatgtttcttaaaatatttagcaccaacatcataagccaccctaggggcatttatttgtgaattcaaaagcactcttctgctcatgggcatttctattgtatatgcattgtgttattatgtatccttaaacattcataatactcatgtatacttttaaaaataagctttctttccttaatatttgatttatttattctgtgaagtcttaaacctgaatatcaactgttttaattattttatcatttgtaatatccagctaacctcattaaaaatcaaacaattctttgatactctattctaaaatagaaaaaggattttctttcatattaaaaatcatctcagtctccttttgaaaattaactaccaaatttcctcctgctcattttggagaccttcaagtttaacatgttcctaatttcattccagaaataaaaagaaaaagctgagagatcacacagctggttatgaggttactaacatcaatcaaaatagagaccatctgtatatattttaatacccaatatttggctcatcaaatatctacaaaaagatcactaagaaagtagaatatggacaacatttataaatataagcaatgctacagtgggtcagaaatatttctttcagtagccctaagcaccaagaatgactatcacaactggaatatcaaatggttaggatcatttccttgtacatgtagtagactctaagcacatgtaatattcatatatagtatgaatttgattcatactatatatgaatttactgaaactttgttaaatctggagctaaatacctttcctaatttcaacaattcttttaaaatatagccattattttaattatttaatcattttcttaagcttagaactcaaatcaaggattcagtgaaaaaatccacgtgcatgttattcataatttctcagaaaggaattcatttatttagttgctccttatgaggaagactatcatcctcatcattgtaactgttcttctatgaactcctcagagctcttttacatctctgctgatagatttaacttggaatacaataaaaataaaactcagaagcaaatcttctgttctgtctttacccagcttggaaggagtgaaagcataagtgaatgaaaaatgtatatttacatctgcaaaccaaataactgcttgccatttcctctgaagtgttaaatgaatattaatagaaggattgtattattcctttcttgtttataaaacgggggggattttctgttatgttcatgcacagttttctcagattttccatgagattgcatcttgatggagactgtggcatatgtcccaggagctccatagttgaacagaaaaagaacttgaaaaagaatcccaaaacatgcttattcacagtctatattattctgcaattggaagagaaatttgttaaatgatatggtgcctggaattttatgcagtctttataaagaatgaaaacgtccttaattcataccaaacattcaagatttatgttaattttctgctttaattactactatgttcaaatgagcttatttaaaaaacaaagacactctgaggtagctttataacaagaaacggttttgaaattggaacttttagtcaatttaatgctgtgcatgaaatgattttttatacagacttaatggtattgtgacacacaagttcttcaataagccacagcttaaaattgcagaaaccgtccctcagggacacatcactagcagatgcagattgccaaggtcaattaaactgatgtagctgtgctgtcacatatgtaaaagagaaacccacaagcatatgacaagtatatttctcagtttttataaaaagatgtcaagaatgttatattttagtacacaaatataaattaattctccataaacaataaaacaatacaacagatatcataatgaagaaggattattagtattctttggagagtttgatgtgttataaaacaatggggggaataaaaactttcaacatttacaataaaatgataccttgaaaacatagatgaattcatctatgtccttgttgtttaattttacataacctatcacccactaggaccaaatcacaatgaaactaaaaggtgtgctgaggcagtaatctcagtaattcagcgctgaaagcaaaatctcagcaagatcaaaataaattctaattacaaggccaggatatcagagttctgtttaaatagaataacctggggtaaggaagggccagaaccagagaatgcctccaactaagaatatcaagtctggatggcttgagctttgtcttcacatctcccttccacttctcagtactttaatcagtatgctctccacaatgaagattcattgttttccttctgccagtctctcagaagataaccttgattctgtaccttcctgctcctccaggtcctcaaacactgtctcttactcttttcagtatattgtatgtgtcattttctcctctcctctccaatttgaaaaaaactttgtttttgacatggttatcttttctcactgccattcttatatcttcctttacccaatttctcggtcatatacttggactgcttacttgtctcaccaccaaattattccttgaatgaaagtatggtctccacggtcaccaaattctgtgaccttagtcttcagctcttttgcctttctgtagcatccaacagttgaatggcattaattttgatcttttttgatttgcagaatgctcctctaccctggctctgcttatctttaaactgtccttcttgggctctagcccctcttcacctcttcattttcctcttctcagctctcaaatattcagtccactgcactttctctgtcagaaatcatagtcatttagggccttcaatttcatctctataaagatggcctcgaactctcccttgagttcttccttttattctggaacttctggatgcctgtttaagattataacctgtatgctctaatgtcccttccaaatcatcacatccaaaactcagttcacaagcttcccctgggccttcccacctcatgatttattattggtgaccttactctttcatttcctccactcattgtgaacacgtcttacctttgcttcactcctcaaaacttctatagacttgactcctttctcttgcccccactgtcaggagaaggccttgtcccacaattcacagagaatataaaagccatcacatgggaactctcttttcttcccatcagcaaaactacaaacctactggatctataccttcgctctctctctcttcctttttaataccactaaggaactctccctactatcagaagccattctctccacatgggcccaagaatcctctcctctgacctggtaggaattttgcccctgacactatatccactctcttctctattaccagccactctctacaaattagaggtttcccatatgtaggtacatacatgtacagtagtacctcccaatttaaaaccattccacatctgcatttgactccaaagcttcactaaacctcttttcactgatatgattaattggttccaggtcgccaagtccagtgattcttctcagtgatcatcttgcttcagagcctgaaatagggtgaggtgagtgaggcagacaaagaacaaaatttaaggaggtccttactctcagggtcatgcaaaggcaaagttgttggacaggcacctaaggtgcctcccccttgttgtgctccttgatttctcagcaaaattcaacagataaccacttcctcctcatgaaagtcttttagcctggcttctgtgacatcatactttctgctttccacctgtcctcatgatgcatttttaatagtcattgctgcttttttctattccctttttttttattttattttattatgatttttttcttttttttattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaagacatgaactcatcattttttatggctgcatagtattccatggtgtatatgtgccacattttcttaatccagtctatcattgttggacatttgggttggttccaagtctttgctattgtgaataatgtcgcaataaacatacatgtgcatgtgtctttatagcagcatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctattccctttttcttttcttttttttttttttttttttgaggagtctcactctgccgcccagtctggagtgcagtggcatgacctccgctcactgtaacctccacctactaggttcaagtgatcaagtgattctcgtgcttcagcctcccaagtagctgggattacaggcgcttgtcaccacgcacagctaatttttgtatttttagtagggatggggtttcagcaggttggccaggctggtctcaaactcctgacctcaagtgatttaccagcctcggcctcccaaagtgctggaattacaggcatgagccatcgcatctggtcccattcccttcttcaaaactaaaaatagagcttacaaatcttagtataatccatgaatcttgtttccaaatatatcaacatccagtcagttaacatgttgtgccaatccatccaatgaaaattttatcctagttacttcttacattccattaacatcactgtcaactaaagaagaatgttagaaaaaataatcaatcagcacttatggatctctagtacatggcaggcatactgctggatatttccatagaatatcttattagatcacaaaagaacccttgaaggtggatattatcatcctcaataaagccaagaggtggcagaggcagtatttgaatccaattatttcatctccaaagtcctgctgcttctgactttgggtgtgggggcaagagaaagccagaataaatagactctccacagtctcataaaattcagcattggggatcatgggaataactaaagtgaagacaggaacagcaaagaattctagtcttggctagcttcacagattcagccttgagagcatcctttccaatgaaacctttttccccccctttctagtgaattaaccactaacgactttctgttacgctaggcactatgtgactttatttcaagtatttgttttacctctactactcctaagttcagataacttatttaagtcagctacttccccccagcatctagcatataattggcatataaggggaatctagtatatgttttttggtcaaaaaatgtagtatttgtccattccatttatttagcattcatattattctgtcttagttatttttcttgtagatcttattttcacaattagtcagttcatcatgtggagaaaaagtatttctacactgacaaacatactgactagggaagaatgggcacatagtgaatttcttttgatcaatttaaatatctgattttcctactgctatggttagataattttcagtttgaatatgctagtagaattcagtcagggtaaaatacagatctgatcttctccctcaccctattcaggataaacttaggctccccaagttgaatggaaacgatggatgtcaataatagcctatagcaactccttttgtgttatttgtattctattggaagtttcatttccacttcctaaactgaccaacaaaccaattcagaattaaaatagtccaagcacttcaccttgatctgcttatgtctctgaaataattctatctatttaagacgctgaactccttgaacattggatttcattttacctggaagagatctcctccaggaggtcagtgtccttgaagtaaatatatgggaattgttttcaaattctctgttggattcccaaatgctgtactttgatttgcttatttatattcaatgataccatctctttaagactgcaaactgcttgaaggaatagatcatcctttaatctggtttggaccataatcattataattctatgcacatttgggtgcttaatatttcttgataattatgagatagtgaaaaaatagcgtattgaaatattttttgtatacttctcagcaaacaaaattttttaaatgctcaattatgtcatcaaatgatataaacaattactgaaaggggttaagaaaaatgtttcatataaaattcccatttgctgcatttaacggaaaaataaaaacaaataggaaaccagtagtaaattatactacttgtgaaaacaatattattaaaatataagtgaacactgaaaaatattttaattaacaaaataaatcaaatggaaaagattccctaaatagagctttaaaagtaagtctatgtgtgtctgactgccatgactaattatgtatccatgtaatgtgtgttcaatttgggcttatttaaatagcagaaatgctcattagctgcagtatatctgtgaagcttcagtaaacagtttaatggtttttatgtttaaccaatttcataagttcctgtaattttagctttagcagctcattaatgttattttttgatatccatcttacggcttttttttttccttgtcaatcgtcagtaggcacacttcaatgcaaacttaaaacacacagtagaattttgtttaaacaattttagtacataagtaaatgtgcaattcaaaagtatagtttctttatatagagaactagctgtattatcatgcactcaaaaaatatcaacattggcaaaggctatatctaatggggataaaactataataatggaaaacatttattgagcgctttcatcagcatgtagctggctctaggctaggcactgtatatactatctctttggatcctcacaaaataggtataactcaattttatagttgaggaatgtgagattgagataagttaccaaggtcacacccttaggatttaaacctcactagaaattaactacatatgtagttggaaaatgcctgaaaaatccacagaagcatttggagatacacacctagacctcagatgaaggcactgcaacttgggatcaaataaatcacaaggctgggtaaagtttccaaagaaagagtgcaaaaacaggtgacaatagaatcatccacttatttttaaagtgtcagcaagcataacctgaactaaagctagagaataattcctcagagttacgtgagaatcaaaatatttctaagccacaaaagccaagtaaagaggtaaattcaacaagtattaaatacaaaagaaatataatgtaggtaaatagattgatgacgtggaggtcaatgaaccgtaaaaaggtgacacttgcagttaaatagtaaaggcaaaaaacagaattctgaagttatggacaaagtatctggcaaagacataagacagtgtacacaagctattcttcccaggtgtttcataatttttaataggaaaaaaagcaaggcattaccttgccttcattcattcaattagcaaaaaaaaaaaaaaaaaattgtttttggtctctcatgtattacatcctgctgcaggcaccgtagtaaaccacagataagagacccatccttgtgtgttgtaaatttcatctggcagaagataaaaaatgaaaagtaaataagtaagtgaactatatgatagtgaaaatggttatgaatagggttacatgaaagagactagtacaagatgagggatgtgagaagcagaaggggtgctttagatcatagcaattatggagggtcagagagcgcctctttgatgagatgccatcagagctaaaacataaaggataagaatgaaccagtcacgtgatgacttagaggcagattattccaagaagcgggaacagtggcaagggtgttaaggatgagatgcagttatagcacgtgaggagtagaaggaaggttttatgtgggtgaaggaaagcaagtgagacaagagaggaagtctgagaaataggcaggggccaaaccaaggagtgtgttagaaactgtagtaagaagtttgttacaataaaataggacagcatttgtagatttagaacaacaacaaaaaagaaattaaataatctctgtttagaagctcattctggtaggattatatggaagtgagagtagaagcaggatgaccagtcttaggaaaccattctcaatgcaaagagaaagcatccagcgtctgaccattccctgaacagaaggagggctggctggccttcatgacacctcacaaatacaacactttcacatgattttgcccttactgttaattttcagtacagacatttagaataagtcacttcattcttttcattcaaccatttattcatctcttcactcattcatccatttggtgaatatttattgagttaaggactgtgctggatctttgggttaaaatataaataaagtaccctgcagtggtactgtcaatatacttcagaatatgtaagatatacagagtgaaatagaagagcaagaatcaaaaaggagaagcatatttaactacatggtccctatatgtgtgtagcaaacatatttaatctacgtgcctctttagatttccagtaccacaattctggaataaaattcacatagttaaacactaaaaacatttcatgaattagcaatgatatgtttttccacccttactctattatttcgcatataccttataatctagacgaagaaactcccccatgtattcatccagcctgtttactataactggaatgggctttcaatccctgtctctgttctcctaattcctacccaatcctcaactattataaatgtcactgcctccacaaaaccttttaattcttgctgctgcaagtcatctctctaccctgtatgttacaccagaaatttatctgtttctcctgagtcactttctacctaaaggtaactttatttgcatgcatctttcctcctttattagactgcaagctcctgcagatggggacaatgtattcatttttgtgaactttagagaacctaaaagaatcttgtataattaatacaaaacacatataataaatacagaatgaaagaatgggaagtaacatcccacaagtatgtaggagggcagattagtaggatgtcaaaattaaattgaagcatttggttttaatcccaccatcagggaagaatagttttagattccaaagtatgagagtaatgtgatgagactggtgatgtaaagttcatttggcatcagtatgcaaatacagggagaaacactgggtcatgttaaaccaaatgaattgtaaatacactttgaggagggcttggaaaatcactggatatttggcaaacacttactatgcaacatgcttgccattctttcacatacttgtatggaaaaaatggtcaggtaagtcttgaaaacactttaaagagctttagaattacaaaatataacaagtatggttgttaaagaggaaaaaaagattagcactggttagcattaatccacatactgttaggcaggatccccaaatggatgttaacattaatactggtttcctcctccaacaatggcagtatattacatttgaattgagtagcttccatattttgggagtagatattgaataagatttaatgtaattttctaatttatacaatagcatatatgcagatcaatgtcttatttttttgagatggagtctcactctgttgcccaggccagagtgcagtggcatgatcttggctcgctgcaacctctgcctcctgggttcaagtgattctcctgcctcagcccccccgagtagctgggattacaggtgtgcgccattacacctggctaatttttgttttttcagtagagacagggtttcaccatgttggccagctggtctcaaactcctgacctcaagtgatccacctgcctcagccgcccaaagtgctgggattacaggcgtgagccaccatgcccggccaaatatctaatttaaccagagtattttagatagggatgttgtcctatttatattgtgctttgagtcaagaacagaaacacaaagtaattaacaataataatctcactctgcaatacaaaatacatataattaagaaccttactatactctatattatcattttatagtttaattaaatcttacatcttgattttacatctcacagcggcttagttttagtttaacatttcaccagcatgttaggtttcagaataaccttttactatactataagctaactagtttttaaaataaaaatattataggctgtggtcaataaagctcagtttatctattacactcaccgtatctattacattaaatacatctattacactcactgtgtgttcaaaaccattggctatgttttatgatttctgttctctgaaacaattacgttattttttcccattttctaccttctttccctaacaaaacttgttacatgccactgctctacttcttgtatgtaatcttcaatttgatggaaaactactgatttatccactgtctccctgtaagaatgcatatgatatcaaccagtagtgaaacctggaaaataaagataaggaaaggctctgagcagagctattcactggggaaacaaacctattcctatgcagttattagagggaagtaaaataattacagaaatatcatgttgtgcttcaaatggatatctaaggcagatgtaagtgatgtggtgttgattcccaatcactttcaacactgttatcagtttgacctccatcctcatcacctccaccctttcaaaataattccaaagaaaacctgtgcaaggattccattagtttggatagttattctgcagaaatgccagtacttacactagattccaccacttcatcctcaccctgcacaacatatttcgtaatagaaagatgataaatctttcaaccaagcaaaaatacttctgataatcagaacaatttttgaaacatgtacagtgtttcagttaggttcctgaaaattcttcttgcccaaaatataattaaaggcaaagcactgtacaaagaaggcaaaaatagttcattttcatcatttcgcaatcggtacacaggatctatcaatgttattattcaggcattttaaaacaacatggcagcacatgaggaatcatgtgtgttattaaaaagcgaacaggtggtagagagagtaccatggaataaaactgtcccttcatgtcataacctccttaaaatatttaccatcaggaaatcaacagtaacaaaagctgaccttttttctcttcatattatggaatatgacaggcttctggatttccagaatcaatgccacatatactctttaatcacactcttaagaagctgttatttaaatgataggctacaacacctttcattaattaattaaatcaatgaacagctcctgctgtaggcattaaggtatagtagtgaaaagacaggaagatgatgtgtactaattcccaatgtctgttttcagtcattctctgtttccttagttctagtcccctgcttcagttgttcaatagcaaatccaaattcaacacaccaccatttcactcagatctcttctatctgtgagttctgtcagcactataaacacctgtttacctcccagctagctaccccacatccaatctctttatcaagcagataaccaaatcctgactattctacttaagaaatatatcttgattccaaattttctcctgtatttccacttcctctaacttagtcacggtaactactgaaaaaattattttaatcctttaacttgtctttcttaattccaggccatctttcccaaaattactgacactgtagttccacactcctgatgttgccttccatgtaaagaaacaatcatttgtataacagtcagggtgtcgcattgtacctttctcgcctctctccaaaacactaaaatagaatccaaattagtgaatctggaagaagaaataaggcatatataatccaccctggtcaaacctataacttgagagctgcccatctgagcataggttctcagtcgcccctgatactgaaaatgttactgggtcagcttctcataacggcatttactgtgtgggatcataccctgtgactgaataaccacctaattcaggtcaccaaatgttagaaaatgcatttgcctactaacatgaaccatctcaaaatgtggttgcttattttctaacccccaactatttgaagattattacaaatggtgcacaatccaagcagagagaaggaagctctaacacctgctagaattacctcattcaagacaaagagctcttccttatttaaacctcctcatttgtcacctgcatgtctacagcataaaattcaaaatccctactttagcatataatcctttgactccacatatattttagccatatttcctgccatcttatccctacctgctccctacccttatgtaaccacacaccatctggtccagcaaaacagaatgcctccccgttgtctgggcatatgaggtcattttgtcggcccatacttttgtatatgatgttctctgtaacaggaaaactcctactcaagctctaaaacccattccaaatgtgatctcaaattagcacactgtgttgctatatatgtatttacatgtctatttctctcattagcctataggtccctgaagggcaatgactcttttacttgtgtctgtattcctagtgcctgagtagtgcctggaacacagttgtgcatcaagaaatgttcattgcatggtgaataatgagagaatgaatagtagaaatcataaaataaaaagttctatttagaaatacaaatgaaaaattcagaccatcatttacgaagatgagaacatgcatgaagtaagtaggctgatgacaactttctaaagacatatattttttacagctttttaaaatgactgtaaaatgactatttaatctaacagtgcggtgttgagcaaattgcataatctccctgtggcttccctcccttccacccccgttccacctggaaactcctacacatcactcagacttcaatttacaacccacttcctctaggaagcttccctgaatgcttagactctgttctgtgcttcctcgggaatctaaacttctcaaagtacaatttattgtaattctgagcctcccctgttaaaatgtgcattcttggaggcaaagtttgcatttctcttttcactactttatccctgaaacgtatctttaaaaagagtctgcactagccaccatacgttatttaaaaacctgtgaagtgaggggattagaatatatgatctctaaggtccttctagcacattcagaaatataaataaggaaaatcctaatgcaagttattgtattgtatccagtgtattataccggactgattactttagttcttaatgttaggtaagaatgtcattcattcttacttatattaatccttaataagtcccttcctctaatgttttgccattagtcaaaaaggtatcctaattagcaatataatgcagtattctttaatctgttctttgaaacttcattgtaaatatttgtttattaaaatgcatgcaacagtgaaaatttgatgaattatgatagtttctcaaattagtattcaatttttcccccttcccctttatttttgatatgagaaattacgtaagctgaaggtcataaagagtggttagttgttcaaagaaaattttgccaccagtagcttctataagatatgttttgttgtttgaaaaatagaacatgatgttaaccaaaaactgtggtttattaaaatgttctagcattctcaatttcattataaattaccaaataagttacattttaataaggagtaaatcaaatcaaacatactgattccaggtcttttaaaacatagctaactaccatttttgaatacctaaataatataatgccaacattaaaacatttttcataggctcttcccaacacttaaacaattgagaaaagaaaaatggacacatttgaaaaattcttgaatttttgcatcgtaagaatcttagcaggccatttcttgcctaactggcaatttctagttctgagttaggccagaacaaggcaaattaacccatggcctgcaccttttctcagtatgggggcaagtgaatcaaagctacactcaaagctgctattgacagaatgtttgatttaccccatgaggctttcaaaaacttttctgagggccttctaataagaggaactgatgagtgatttaaaaacctttttttttttcctgcaaacactcccttatggaactaactgcaatcaatgttatcaagggagctgatttctgagagttgcatttaagattcagaactatctaggttttgtgtttccttgttatctctagttcccagtgagtgagcagaaagaaaatgtaagcagtgggtgaagtacgtaaattcctttcctaacagaagggtcgtatcttccctggctgtgccctgagctcagtcaccttgtctccgctctactgagcagtgtggtgcaacatgatgctgagtccctcaccattcatcctaacatcttccttcccaaaacatgggtttttaatcttagttatgtaatcccataattttcaagcatttaaaatctcaaacttagttgaaaattcaaaagtgcctttcttgtcttaaaatacaaatgaatgatccttacactaaacaaaaaaatgtggtccaattttcaccatttctaagaggaagaacaaaagtcatttaaaaatatgtgctttttacatacctcatttgcagaaattcaaaatggagatttcttttttttttattatactttaagttttagggtacatatgcacaacgtgtaggtttgttacgtatgtatacacgtgccatgttggtgcgctgcatctggatcaagaaaatttggcaaaatggagatttctaacaactaaaaatagttgaaaaattgttttcgatggcatgaaaaacattagaattgataatagtttaaaaatatataatacagttacagactgttcaatctttttttcaggaaaaaaactaaccaaatatattgaacaatttctcattaaaaaaatcatgaatgtatgagcatctgcttcacttatttacaaagtcatgttgacagagcctccaaagttcctgatgaagtattgatattcaaatgactttattcccaaacaacatgaatagctacataaaagttaatataaatcaatttaattactaaaatatggttttgttacagattaataataacatctgtaacttaagcttactatatgctacgcctatatgtaaatgatttacatatattattaattcatttcttctaaataactctaggatattcatactatagtcatcccccttacagcatgaggaccatgaagaacaggtagactaagtaactcattaagacgatgaagttagaaggaggacagccaggtttccagctggggcagcctggctccagagaccccactctcagccaatataccagatagactctaattagtgtaatatttattgtattatgaagaatacaacaatttatgccacaacaaaggaaaaattcagagcaatagaataatagaattatttttctaacttttacattttcgaagaaaaataaaccaagcagatcccatcataggagaaaatagtaactcataagaaaattaataccctaacatgaagcaagtcaagtcaaatgcacaaatatttttgtggatctattatgggcacactaatatgtcagttgctattgggactacaatttagtataaaggtgcactccttgctctccttggggtttataggataatttgaaaataaaatagattccggaagatcacagaacataaatctttacagagtcaaaatttcatataatgaaagagtggttgtggtacagggtatggaggaggcacagaatcacagaatgagctaaagtacattcattcagttgtctgaaagcatattcaacaaatcataaaattatgtcatccagatctcctaggaatgtgaggacacaggcaaccttattgccttggttgtaaaaatgaagcagtgagattagtgaaagggtggaagaattcttactaatgcaaaactaacagaaatttgggcccacttaacaactgccagtttggttccaacaagaaagagaaggagagatacactataaaacaaacaataaatcgattaaacctgacactgtaccaacaaacaagaagaaacacaattcaattcaataaatattgaaaatagtgtttagcagaagaggaaacatcctatattaggaaatatatatatttatatcatatatagaaatatatattcatatatttatattatatttatattatacatatatgtataataaaatatacatatacatattttaaataaacgtttagaactttccagtgaatggacaatatttgtaaagcagaaatgcagttacagaaagtttgtgcttaatctcctgatagcctttacagtctatctagaacaacaaaatcccaagttaatgtgacgtgatatggagtcgtacattcttagagggaatagaggagactttttaaaagtagaaccattttgagtttttcacaagaaagatatttaaggctgacgttatatcaattgagtcagaaattggacaccattgcctttaaaatttgagctagtgtttaatgaagtattcaattaaattatgctgatcggcacataacatattccatgcacatggatatggaatatgtagtcttttgttcctacttcccactccctggtacaatccaaaaagtgatggaagaaacagaattatgtaaagtaatgatgattacttatcactcttattatccttagtggcaacgaaataattagcaactataatcccaaactcttatccaagtttattttataaatgatatacttatcttttctataagctgttgaggcacttatcattttatgatagggaatatttattacagatatattaggtgtataacactaaaaaagttattttacattctccattgtgaaacaaatttagaaacttacaaagattgtggaatatttcagaaaaaactgacattaaaaatgtaatctcctttcaattttccaattagcttagcttttcaagttcttattattgatatatttgagattttaaaagtattttcatttacaatattattgcaaccagagacttctgagagtgtaatttatcactgtactttatatgtactctgtcaagtttacttcattacttgaatttttcagtatgtctttatgtaatgcatttaccaaagattttctgtgttgccactatggaatgttccctgtgctggatgctggcaggaataattcaacagggaacagaagaaaatataggtggatacacagaatgtatataaggccatttgctgatgttctcaagtgttgagaagtggaagctttataccatagtataagataacattggtacatttaataaatattataattagaaatttgaactggggtaaaattttgaactttggctatggggagtactaatggtaccatttgcaataatagtgaatttgagaaaagatctgttttaggtaaatctgataaggtgaacttttttttttttactttgtgcaaatctctcttaatgtacacattcctcactttgtaataaaattaattgattacagatctgcctccaccctagtctatggaattttaaagcccatgcaatgactcgctcattttcatactctctagaatataatttggcacctggcattcattaggtactcagtaaatgtttgtcacatgcctgagcaaaaatttaggatgaaaggaggtcttctgcgaaatggggagtggaaaactagatttaagagtcatttttacacaaaaaggaaatagtgcctactgtaagtctagccactgtctggcacagagaagttcatttatatgtcttgaggaatgaatgcacgtatgaatggataaatgaaagaatgaacaagacattcatttcactgaagaaataaatacgataaggagagaaaatgaacaaattctgaactttggaaagtaaaaagctagaggaagaaaagcagtcagtgataggcttggaaaggaatagttaaaagaagcagcaaggtaatagagtgtcacaaacaagaatatgctctagttttgtttccaagtcttttacattatttcattttaattctgacaatagtcctgagaggtagaaagataatgtattactacgcttttttttagtagataaagaaattgagcctcagaaagtttaagtgacttggaggagagcattttaaacagaattcttaacattatcaatcataaaatgcagaaaatatactaaggactgaaaggatgtcactgcatttggcatgcagttcactgaagtctgggcaaagtgaggttgaaaaggagaaaagtggaggggtggaaagagaagtaaacattttaaaagatgaatgcattaaaacaggtatcacatatgtgataatcactaggtaccatccagaaatgacatgacatagtgttaggatggggaagaatttatggtagaagaggattaacatgaatatcttctcttcttacccaaatggacatcttgcttccaataaaatgcttttcattttattttacatatatgtgtgcacatgacagttttctgactttgaaactattaagattttaaatcctattgagtaagatcttcttgatcaaattctaacaaacactgcttctgtgactcctttatttaatgttttccatccaaaagaacagtactgaaaacatttagatgggagtccaggaatgaatgctatctcacactgcagctctgccagctcccctctcacttggagaataacttcttattaaagtaaacatggaaggctcctggtaaagttagtaattctacttaaggataatttctacaggcagtttattatttcaaaccagaagaggaaaaaaaaatagcgaagaaacatttttttccttgacttctctaaatttataagaggtggcatatgtgaagtactagaagaaatatacacagtaaattctggaataaaatgcataaattctgaaatgacctagtcaaacttgaatagatcaaattttctccttcttcatattttatatgctaacttaaatcttttattcttcatacatacatacacaaatacacatgcctgcgcgcacacacacacaagcacaagcttataaaatcgtatctgagattgcaaaagctgttttctgagccaaatctgttcaggtttgtttaggaaaatataattattattaatattaggattgtcaattatggaacacaaatttaaatagttaagctaacctttttggataggcaaataatcaacagaattgctagttaaacatgattcaacattttactcaatttttggtgatgtacatagtatttaatagtaagaagaatgggatttttaagataatataagcactttatatatcattcttttttccttcctgaattcagttaaataaataaactatactctgactgtgtctacataccacataaatgtctagataaaaagtgacaaatttaggccatcatccagctatttgaaaacatttatctcgatgacattaaacatctggatgtttccacataccaagatgtttgatgccctgcagataaaatatctgatgactagttgaatcctttacttatctgtggcataaaaatatacattttcatgtatatatctcttccaacttcagacaaaaaatgtaattttagcatggatatagtaggaagtcataggaatcatcaggtttagagagatttttggtatggttgttcttaatgaatctctgacctagaaaaacatattttattttcccttcagaaaacaaaagagttaattgtcatttcaataatgtgaattaaaaggtaaaaggatttgtaaaatgaaagtacctagatacataagctttcatctacaatgacccacagaaacactgtatgtgggaaaagtataacataaagtagtcttacttgactgaatcattattcagttgaaatgttatataaaacatttctttctctcattatctttttaaaaaacattttgtttttcttagcatgctcatttatgccatccaggtgaaaatgacagacatttaaactttctaatttgataattctgacatctgaagtgatgatctggcacaaggatggtaataaacacaaattctatttttggccattcattagattttgatttgtctgaatcattgaagactggctgttccaactactctgcctcattttcttactctagtctaattgaagaaaaagccattcttctataagaaacaaggcaaatatcattatagagtagaatatgtgttttggttataagcttaaaagaaagattaatgttcttttcaatacttgccactttaaaaataattctatataagcattaaataacatttctaagccttttgaatcaagattgcttttacttcttaactagaagaggaaaataaattttaaagtgaaaaacaattccctgaaagctagaaactattacagcactaaaataacagacaattgcatcacacatttcagctcccagcactgtacctttaggatcactcagaactgaaccaaaggcactgatgaccacatcggctttcagatggaccatctgatcttcatcttcattccattttccagtttcatcttgctctgtccgaacaaactgcatagcaacaattctcccaccttttactataaccttccgtggggacaggaatggcagaaattcacacttttcttccttagcaagttccatctaaaacaaaacagaacagagaagaaacttgaaaatgtttcttattccacacagtatttgatttctaattgaattacacatgctaaagcttatgatattaagtcaatatgcagctttttctttcaccaaacctgagtttcagttaccagttatttgcattttgtaaatcactgactcagggagtcttgaattggagttgtaatgtggacgtttatagatcacggcatcataaggtatttctcaagttttaagtactgcatgctctacatttggtagtttgtgaggtttctgaccatagtagcctattatttttatgttttcaattcagtagattaaggtctctttttttaatcatgctgcatattaaaataaatacttctgtttattaccaggttgcatacatccaagctggaaaaaagtcaataaagtgggtgagccaatctgtgcaagtacatgattagaatggtaggtaggagaaaaagactagagaaactctgtagaactaagaaataaaaaacattttttcttccctttataaaaccacagaagcaaatactataaatgaaaaactgaggacagcgaaacaagcatgtcctcctgatgaatgcccagttcttccccatttcctacgtaattcattttgccataaaatctggatacctcggtttctgtttgttttcatatgcataatggaatgttcattgagacagaatattaatgtttactcatttgcttatttttccattaattgtttttggagaaatccaggcctttgtcaatgcaatcagaagtactatgttgaatgttctttttttaaaaaatgcaaaaatgtcctactgaagtgttttgggatgttgtcttattattttccttcactctgaaagccaggtagattctcaataggctccctgggtaatgtttccactgaggttgtgtgtatgaggcttcaaactaagagttatctgagctttgtcaagatggaaaaactgagacataaaataattaactcaatgctgtaatcaagccatgggcccatctttcaacaacctatccagagctagtgccatgcatcacaatcacctggaaggctaattaaaccagactgcgcaggcccattttcagagtttctaactttggagggttaagtggggactgaggatttgcatgtctaacaaatgcctaaggtgatgctatgcttctagtgcacagatgatactttgttaaccactgtctttattagattatagctgactggctcagcacttgttctctatgatgcattttcaaagacaggaatattgcccctagggagcaaaaattaattcttgggggaaagaaaaaaatcctcagatatcataatggtcttgtcccttcaagaagagctaaagtatgtaaacagttatacagtatatctatggtattaaaatcatagcagggaggattaagaaaaaaatctaaagatactcccaaaaagggtaagaagaaaatggttgggaaacactgatctatactatacattattttgaagctattcaatctatgtcttatttaggatatttttaatattgtcattaaaggcttaaaaattggaaccacataaaaattattacacagtctttccctttttattatgaaaatcaagaaattagcaatataaaacaaaacatgtgggatgttatgctggtaaacatacaaaacagttgatataaaactgctcactcctcagacaggaagattagaggtaagcggaattgaatcaaatttgaaaactgctctgctgcttatttgggatagtttccttatatataaaatggggagaacaccatctcattaatcggtatgtgtggtgttacttaaaacaactccaaaatgtaaaatgcctaaagcagaatttagcatatagaaggctatgtactcatagttgctattttctgaattcactttttttttctctgaatcattcttcagctattcaatatcacttagaaataagattgtgatttcaagagaaaggtggcccaataacaaaggttagtaaaaggcagcacaaagacaaaccttagactcctctttagttttctacaaaataaaaatgtatgatttctggaaggcaaattattccttgaataattcaaattacaaaataaatatgattccaatatgtaaaatatgttttctgtatcgcttttgtcatatttgtgccacatatcaccttataactcatcaatataaaccagtttattgtgtttcaaaatgtcaagtggtgctacattttaatgataatgccacacttgactgaataacaactccaaatgtttatggtttgaataaatcaatatacaatgtgtacctgtaacagtactgttttctgtggagggcagaaatgaaacactgaactatgctgtacctattgggaatatgtcttacagatcgatttaggatctgtttgatcccactctatctttgctatctattaatacctctacagtatctgttattacatatagataatctcttatatattttggcaaatttggcattaaatttggaaacaaaaaattggacatgactaaatcaaaaacttctatgaatttaaaataaagattattaatcactgaatgcctaagcatgttttagtaatgtttagtaatgttctcaccatggttttgatttttgaggaccttgtataaccatatatagttacaaacataaaaaaactggctttagcatatgctcatctatgtgccccaggtttgattacatgtattcaaatatctggcattcttaccaattatccgacagtgcactggggatggcatgagcactggaccccacagagattcatctgcatttttgcttttgaaactttggagattttcttcactcactagtacatgtagaactagactattaagcagcagacataaatcacaccacttctgctatttagctcgatagctagattttccattttacataagaaagggaaaattgtttaaagaaaaaatagtaatatcatttgcatatatatatttgtttggaaagtattaatattgggagagtgagatcatgttaagatttatcttgggaaatagggaaatactaggacaatgaaaacacagggtaaacttgtatagtgaatgcttatcattttatgctgccttggcatctattttaaatataagctggactttgttatagcagaagaaagattcagtcacccttgacacacatagtttccaattctatactctacctccctgcagcacccccgtttctcagtgtggtggatcaagatatttcccttatacacctgctccctgatcaccacatccctatgaaacgagtagatgcagcctgctggactggtcctgctgaccctccaccctgcatggactgtgcagacacaccacagtgactgcctctcagtcaatgcttgacgtcctggaacttgtgcctgcttgctttaaaccaaccagttaaaatttcccacgagaaacctgtttggataacgccctggacccataaataaaggcactggcccgcaggtcccattttctctctttctctttctctctctccatgcactcctaacctccgtgtgtgtggcctctgtgcattatgtgtaccccttcaggaactgtaagtaataaaatctttatttccatcttgagcctgtcccaatcattgaaggaatgctctcatcttaaagatcctaaattaaaattgacattacatgtgaagtgaaatatactttgaaatatttttggacattataaggatttactttcactatttaacaaatctattatttgtcttgttataagtattgtcttattatttttgttattttttattttattttaattaattaattaattaatttgagacggagtttcgctctgttgccagttgcccaggctggagggtagtggcaagatctcagctcactgcagtctccgcctccccagttcaagtgattctcctgcctcagccttccaagtagctgaaattacaggcacccgccaccatgcctggctaatttttgtatttttagtagagacggggtttcactctgttggccaggttggtctcaaactcctgacctcaagtgttccgcccacctcagcctcccaaagtactgggaatacaggcgtaagacaccacgcccagccataaatcttgttttataagaagataaataataatggtaataagtatttataacacttaaaagtattcttttaagtgctttacaggtaattcacttaatcttcacacagaaaatacatataatgctttacctgtaactcaatcttcagacagaaaatgttatgacacccatatatttgttacaaaaaaaaagtatttagcttcaaaccgactttgtctccgtgctgtggtgcaaaaagccaaaaccgcactgggcatcatcatgattttacagatttagcatacagccttaggcacactgctgcttgctggcctcacaaagaaaaaaaaaatctgtggacaagcattattttcttcctacagaggagaaactgaggctcagagaagccaaaaatacactaagggatgaaaaaacttatctgaaattaggatctggctgaaacgaaatcctatgtgatcttcattatgtccaagaataacaactgtagtatatttgaaataatgagactgtatgattctagttgctgaacctcaaacaaagcaaagtggaaaaggaaaagctaaagtgaaaggtgaagggcttggctagacatagttccctttgtgggaagaggagactcaagcttcccagtctaagctcatttacaggtactataaaatcatgaaatataggaaccacatgatggatttatgaacccaatactgtaaacgagttaatagagacaccttgaatccagataaagagtaaatttagaacaaaaaaaagtactacttcacaaagtggatattagatacacagaacatattatcttaagatacaaaatttaaaaactaacagaatttaaataagtttgttcgatagtaaactcgttctcaacactctttagaggaagaataccttatttaacattctatcctttatgtccaagagtgatattaaaatagtcaacaattgataagtataagcccatgaacattaagatagacacccagcaaatcagaatatatgccagtcaataagccaacgaagaggcatcaagtgaatgtcacatggaaggacagggcatcaagactggtcacagccctacctgtgtctatcaaaatgattggcacacagtagaccttgaatacagttttgtttagtagaatgaaggacaaattattatgaaaatctgaagaacattcaaattaaggaaagtacaaccaactagtagtatactgagtgaatggctattaaacatccatcccaatgtaagtaacaggacacagcagaagacatgctacctgcccagatcatcctatgttgcgaggttgaaataaaaaagcaaatggtgttcctcatcagttgtcaagttatgctgctatcagaaaacatggaccaaattgacctgtggtctaaccacatgcagcgttactgtttaaattaaccagccttctgtgacaagtaattcacacatgtcagtgttagtgccttttaacaactaatgtttgtcaataatcattaataatcagtaactctgaatctggatatgaatgcttctcctcatggcacccatatatatttatttgtttgatggagcatgtctttatgagggacaactggtttatcaagcaaacatgccaacctctcttttcctagtctccaccaataaagtagtaagcagctataagggtccattttttacatttgacaaatcaggttgtcactttctttttacacagtagtgggaaagttaaaaaaaattctcagctttgattttcacctccatattcaggaaagatatgtggctgatgctgagtgaaataaaaatagcatgctataaacttgcaataatgatcatcattttaatgattaactttatgtaatgcgatgatttggtctgattaatattacaggcatcatactctagaaattatgaaacaacttaattttctataattaaaagcatgatgtcaactcacttttagattgcacataggcaaagcaagaataggttataaagtataatgagcagagctcaaaaccagcatatattaaattctggaataacttctaataagccaaagtttgagaagcaatatgaagaaacaacattctttataaaggttaccctctaatactaattgaccatttatccattctatatgaacacaaaaacctaaaaatattatttagaagcaaaattgtttagaagtccactttggccagtgataaacctagaaaatattatctcatttcatcactgttaaattattggatgtaccagaaacattcagagccatgtggtaagagcacgctctatgcataaatctaaccaaacatttgttaaatattatgtacaaaaatagtgctgtgagctacagttaaaataaactctgccttaaaaatctcatagaagcagaaaatcagcatttgtaggtaataatgtatgacaaacattatttgcttgacccaactttagtcaggtttctgaaccttttcctaagcccacttgtgtgcttttttgtaaaatccagatttagcaataaccctgctaagtcagtttagcaaaatccctcacccttgatatctaatcatcttcaatatctcatcaggtacctcatcctccactatgacccaggtgatgtcttaccctcgcctgtcttctgcaagaatcctgttagattgatttagccaacaggattaagccttaccttgatgtttcctttcagtaatattttatctactaacccgcaacctactccttggctattacttcctacctccgcattctgtatttggagtttaactcgcatttgggggataaaaagtgtcatcagatattgataatggagggttcttgctaaaactgcactttatggggaagtacacaggtgggccttggagaaggtttaggagcctgattaaaatttggcctttgggaggccaaggcaggcagatcacgaggtctggagatccagaccatcctggctagcacggtgaaaccctgtctctattaaaaatgcaacaacaacaacaacaacaacaacaaaaattagctggggtggtggcgggcgcctgtagtcccagctactcaggatgctgaggcaggagaatggcatgaacccgggaagtggaggttgcagtgagctgagatcgcaccactgcactccagcctgggcgacagagcgagactcagtctcaaaaaaaaaaaaaaaaaaaaaaaaaaaaattggccaagttaggaatctttgtcatgtgtaaaggcagtgtacttgaatggcacataaatgggcatttcacctagcagtagtgcagatcaaggaagggcagcattgctgggcatggtagctcaggcctataatctcagtgctttggaaggttgaggtgggagaactgtttaaggctatgagttgaagactagcctgggtaaaatagagaaacctcatctctactaaattttttttaaaaaatttgccaggtatggtggcatctgcctgtagtcccagctacttggaaggctgaggtgggaggatctgtagagcccagatgtttcagattgcaatgagctgtgatcacgccactgcattctggccttggtgacacagcaagatcctgtctcaaaaaaaaaaaaaaaaaaaaaagaaaggacagcatggaaaaggtgctatataagctaatcttgaaagaaaagtaggaattaatcactggaaaggaattagttactaggaagttcttgtatggaatccattctctctctttgaagaagtgggtgtggaagggtaaaggagtttatctcaagaagaaaagaaggaaagcagcttggttaaagctctatgtaatatgtaaacatcctactgggaaacaaactattgtcatttataagtggaagagtccttaccaatggaatgcttttggcatggcgtatctgttagtttaggattgctatagtaaacaaacctggaaacgtgaatttagggggcatagatcactataaagagtaatgcaagttacataactatctgagtataaattagatgtctcataagtgaaacaagttttttgacctaagtgatggagctacttacatgacttagagaccacatgttaatctggtttagagcaaatcctaatgcagcaagatagaacctgaggaaatctgtgggcagtggtcctgcacttcttgtttacctgagtttgtttttaattgtatccttgaagttaataataaagtttgatacagagtgatatttaattcatatgaatttgatttcacaatccaatcttctagttatcttggttaccaaggacatgaaggagggtaaaggaagaggcatcaaactcggcccattcacacttgatctcatattctttaatttactaaacagttttttaatatttagtaatttttgacttattttattttgagtggtgaaatgcagaacaatttttatatgttaattaatctctggcctgtacaagcaaattctgcaattattcttttaattaggcaaaaaaagtttgctgagaccacaaattgacattccttcttttagtacctggtatggtattacaggcttcattcacatatagaatgttttcattttaagttttttaaagttgaagaatcttgaacataaagaaacatttaaccaaatgagagttgtactacacattggataaatatagtcgtcccttaactgagtccttactaattttattgtgtcactattgtgctgcaaaacccagatatgcaatgtaaggaataatttagaggcttaaaatggcttgacacaactatcattaaatacatctcttttaacaagtaaagggttgattttttgttgttgttgtttgttttttgagatggagtctgactctgtcgcccaggctggagtgcaggggtgtgatctccactcattgcgagctctgcctcccgggttcacgccattctcctgtctcagcctcccgagtagctgggactacaggcgcccgccaccacaccccgctaatttttttgtatttttagtagagacggggtttcactgtgttagccaggatggtctcgagctcctgacctcgtgatccacccgccccggcttcccaaagtgctgggattacaggcgtgaaccactgcgcctgaccaaaaagagtatttttaaacactattcatttactattgatgacattttctttttttattattattatactttaagatttagggtacatgtgcacaatgtgcaggttagttacatatgatgacgttttcttaaacctaacacctattttcttcatcttaggttttgatggattcaagcctccctggcagctgttggagtatctcacaaaactacgttctgtgtaacttggtgcctttgtagttcctcctttaatcttaaaatgcctccatgtacaaattctttacaaattaggatcatctgttttctgccacctgctaatactctcggattctagtaatttttattattttttgcttttttatatattgcttgctcgtatttcctttttttttttttttttagttctcaggtatcttttaagagactgaaaactagggataatttacttttttcagtctacttttaatgttagattgacataaaaatgtgacgcaatattttttttaacagtttaaaataaaatgtgtacttattccagtctatcattgttggacatttgggttggttccaagtctttgctattgtgaatagtgccgcaataaacatacatgtgcatgtgtcttcatagcaccatgatttataatcctttgggtatatacccagtaataggatggctgggtcaaatggtatttctagttctagatccctgaggaatagccacactgactttccacaatggttgaactagtttacagtcccacgaacagtgtaaaagtgttcctatttctccacatcctctccagcacctgtggtttcctgacttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatcctttgcccactttttgacggggttgtttttttcttgtaaatttgtttgagttcattgtagattctggatattagccctttgtcagatgagtaggttgcaaaaattttctcccattctgtaggttgcctgttcactctgatggtggtttcttttgctttgcagaagctctttagtttaattagatcctatttgtcaattttggcttttgttgccattgtttttagtgttttagacatgaagtccttgcccatgcctatgtcctgaatggtattgcctaggtcttcttccagggtttttatggttttaggtctaacatgtaagtctttaatccatcttgaattaatttttgtggcacatatacaccatggaatactatgcagccataaaaaatgatgagttcatgtcctttgcagggacatggatgaagctggaaaccatcattctcagcaaactaccgcaacgacaaaaagccaaacactgcatgttctcattcataggtgggaattgaacaatgagaacacatggacacaggaaggggaacatcacacaccggggactgttgtggggtggggggaggggggagggatagcattaggtcatatacctaatgctaaatgacaagttaatgggtgcagcacaccaacatggcacatgtatacatatgtaacaaacctgcacgttgtgcacatgtaccctaaaacttaaagtataataataataataataataataaagaaataaaataaaatgtgtacttatttaaaagctatcagaaataattttgagttgtatgtacatacgtaaaattatatattttgaaaatttcatattaacttaaagtcttcctatgaagttttcaatgcttttaatatattggctaattcaacatgcctcactggtctgccaccttgaatcaagggctgcactatatgttgagtcagataccaagttgaattcatcaatccaataaagaagcttgtatttcagtttatggaataagtataaagtaataagtaccctatgtgataaattctattaacagcaggaagcataaaaagcccacagaaaagagaaattaaattggtagggaactaaggaagccttcaagagaaaatgacatttggagcagaccttgaaggatgagttcacgtgtagtagttaggggctcccctggtactaagatattaagtacacctctaagactttatgatgacagggggatgacacattccaaggatctgtatatgtttatctttttgaaagttgtgaaaattcagtatagtatgaaaaggtagaatggaattttagaatttagaattttagaaaaaaattttaaaattttttaaaaaatcacttttaaaacaatgacaattctttgtttttatgttaattcatgtgtatttttcatttatgtctttcgaatagcatatacattgactaatgtgtgtttaatagattatacaaattactttttaatattttcattttataggacaagaaaagatattgaaaagcggaggtgaatatttttaaatgaagaggggcttctaatgttcacctaaaaatgaatgaagtagagcatacagatctcttcccactttcaattattgccaggcagtggccaaagggaagttcaactcctttgtgacttctgacagcaagaaagaaccataaaaggtatttcaatgcaccttcccatgttcacagaacaattatgtcttccctctttccaaagagctgagatagaagtacaatgtttgatccatgcccatctgaaaggatgatgaagttcaggttgtgtgaggacactaaaaagttcagcaagttggcaaagtggtccaaggttacaggaagaattatgtcatttacattgaacgggtgcagcagaaaaagactgggctaataggacaactattcgtttgggcattgccccagcaaggtggttattaggttggaagtgaaaaaaacccacaaaagatccttgaatggaaagccaaatctcaccaagtgggaaaggaacaggacaaacataagatagaaacgatagagatggtgcaggaataaagtagtcttatatacaattttcattacaaactactaaaatgaaaaaaaaattaatagagtaataacaacttgttgttattaaataaggcctgacagtgacacaccaggtaaaaaacgttcacttttaatgaatctgtgggcttatctgtgaaaatacatacatacatatatatatatatatatatatatatatatatatatatatatatatatatatatgctgtgaaaaaaatatatatagaagattagtaaagatttcttaaaagcatataattttcagctcctcagatattcctggtcaacataatgcaacaacctccttcagaattttgaaaatagttatgcttttaaaatatgtaatcttaaatgggcacaagcttttgttggctcctggcctatttgcagtcttcttttttttccactcaccatctgaattatcacatgtactgtagaattctgacaatttcacctgtcagtttctttatactcatgtcttgaatatggtagattttacctcaccaattggctggggatacattaattgcaatttgttttaagtgtaatatttatacacatttctaaaattttcagtatagagctgtcactctgtgaagaaatagagccttcctgtccagattccacatcattcatatatatttctctgaatgttaaaaatataaaatgaggaatggaaaaaactttaagaagcatataattacaacactaattttatagatgggcatactcagactagaatgtaaatcaagaaccaagtgctccaactgtaattcctttttgactattccattctaccttttcatactacactgaagtttcacaactttccaaaagataaatatatacagatccttggaatgtgtcatccccctgtcatcataaagtcttaaaggtgtactttaatatcttagtaccaggggagcccctaactactgttaattagctttttgtgcctagagaagattttgtgtgagtgttcgttttcagctaccttcagagagcaaatcatgtcaacatgtctctgattaccttccatgaagaacaccaactcaaatgacgtgcaggtgccaaacgttgaagaactgctgtaagcatcacttttagtaaataaaattaaatttgtcagcttatgggggctattttctaaaaatagtcccaggttcatatttgttgtaattaaattaaaactagaaaacatcagttatctgtagaaaatacatgtttaggccacgcacggtggctcacaccggtaatccccgcactttgggaggccgaggagggcggatcacaaggtcaggagatggggaccctcctggctaacatggtgaaaccccgtttcgaacttaaaaatacaaaaaattagacgggcatggtggtgggcgcctgtagtcccagctactcaggaggctgcaggagaatggcgtgaacccgggaggcagagcctgcagtgagtcgagatcgcgccactgcactccagcctaggtgacagagcaagactccatctccaaaaaaaaaaaaaagaaaaaaaaaaaagcatgtttagccataagaaattgatgacaaaactatccatagacatagctttaacatggtcctttgacattaaaaatatctgagaagaggcctataggtcatgccacaaaaatgatctattatggggtatgctgtgtggtggtggaaaaaaatcaggtaaaaggcacattcttttaaatgttgtgctatttcaaagttgtagtaccagatgaagaaaaatttgatgaacagactgagcaatccggtattgttatttttctaattaaaataataaagtagcattaattatcaaaacagttaaccctctcaatagctaaaacatgtaaaaactgacataccaaagttaaatcagttaccattttgacaaacaaacaaagggaagctaaggcgtaccaggggtagcatgcaggccccataaaaatgcagcagaattaaagatcaatcgtgttttgctcctattggaaaattgaatatgtaaataacagatctttgaaatatactttgtgtgtgggattgtgctattaaaagtaaatttgaaaccatcctcttctcggtaataattaataagaaatataaagtccttctctaaccttatcctttaaatttatcaactctagcaggtctgttgagttctgaccttcatgcctccttttagggattcccaactgcctaaagcatccttgcagttctatctgatctgtcaacagcttttaataccagcattttgggggattctgttatcctgtgaaatttaatctcacctatttaagcttgcagaaagtactggagggaattattaacagattttccctcatcttcttagaggatagtgtcgagtgattggctggtttccctaaggacccatggctgagaagcgctagtttgtcagtagcatcctatttagcatgtgtgtgaggccacaagggagctggaaagacacttggaatcagaattacatcaatatgctgatgatgcctgcatatcttcatttcatcaaacctatatcctttagtattaatgctttcttagccaagatggaaagtacctccacacagcacactgtttgtgactctaattagacagctggaaagcatgttgatgatacatcagagcagtggaccagcaacctcagcatcacaaggaaacttgttaaaaatgcaaattctcagacccaccccagacttactgaatcagcaactctagggacagggcccagcaatctgtgtttaacaagccctctaggtgacttaatgcaccctaaagtttgaaaacctctacattagagaaatgggatgtgtttgtcactacagagtctattggatgatgtctcctacttttgtggattaaaacattcctgagtctaaccatatagttcttggttactaaccacataatatacatggtctcaaacaattccatgtgtatggttaagctttgtgcccccactcaattctcattttgaattgtaatccccataatccccacctgtcaagggagaatcatgggggtggttcccccatgctgttctcatgatggtgagtgagttctcacagatctgatgattgtataagtggctcttatctttttgctcagcacttctccttcctgccaccttgtgaagaaggtgccttgctttcctccatgatcgttaagtttcctgaggcctccccagtcatgctgaactgtgagtcaattaaacctcttgcctttataaattacccagtctcgggcagttcttcacagcagtatgaaaatggactaataaaccatgttaaatgtaactggcttctgtcataattcatatttgtcactaaaggataagtaaacttcatattgttctgtatttccctcactcagagaatgagaattagactgcaccatcagacatatacatgttgacatgcctaatggtgaggcattttactgacaaaccatgctatttccaaattacacccaagagtccatgaccattaaataacacacatatttgacgacatctctaaatgtccctgtccctcaatcttcactgactctaaagaaaccaaatgtggctgaagtttttactaggggagacagtgtaggagaaagaagacaattactcaagaaattagggccaatattaaattcttcatattggctaaaaattatgtgctagacctaacctttcaaaacctgtatcttaaagtagataatgatattggacctgtactctcctgactttccagtttcatgagtgttagcactgcaatattttggctcctcttttgatgtatacaaaaccaagcaatggccataaaggattaacactgaaacttctatgaatgccaaaagttcccagtccttacatggtattacccctggtaagagaatcaatcctgaaaactttgcataatctaatcatatattacttattattccatctctccaagaaattttgcctataattatgagatgaaccttcaaaggcctactgttataatatttatctaacttggaaggtattagcccgtgtaatgctagaaagccttcggtgctgattccctccagtaaatattcattccacaattattggttgaatcttttataggtagcacccaaggtgctaaacaggcggaaggtaaaagtgacccagagagatgatcatggccctttctctcatgaagctcaaggtcaattagttttaatatcatataaaaatttggttaattgtaagctaataataaaataattcaaacaatctaacatttgttcttctagttttaattaagaccagacccatttgagttctactaagctctactgcaggcaggttacctattatctcaaggatctgttgcttctcaacactttggtaatcaagtttcaggcagctgagctctggccttccaaggtgctatgcctctactctgatcctgtgcttcttgtaatctactcacattaaccaatagctcactcttttacttagcccctgactagcctctctgcttctgatgccactccactatagtcaattctcagcagagtagccattttaaaatttaaatcagagcttggcacttctctgttcaaagcagcccagtgatttttctctttcaatgagagtaaaagctaaaggtcttatgaatgcctacaatacataatccggtcagccacattctgtcctctcttactctattctgatgatactggcgttttttctattccacaaatccagaagacttccacaataaagggtgaaggcatttagcttgccatggaatgtttatctcctggatgcctactttccctcaacttcctcatctctttgttcaaaaatcatctcatcggagaggtcttccagggccaccctgtttaaaatggcaaaccctgccttctcttccaccattatcctcatctctcacacactcattatactcctatattaatttttctccacagttctaattacttttcaatatattatttatgtgacagtttatttgtttaattattgggtatcttctgtcactaggtacaaattccatgagggcatgaaattctaactggtttgctgactgttgtatctaagttgcccagaacaatacctggtacataatagatgctcagtaaatgtagttttaataaatgaatgaatgaatgaataaataaattcataccgctaccctcttcttatctggtctcagtttgtttgtgtcttagttctacctaagacagaagaaataaccaccattcatttccagtgacccttgcaaatggaagatgactatgatataaaatgtgaagtaaattgatattgccaatcagtgtcatcttccccttccaaccctcaagaagtcacctttggtaatgaaacttttctaacattggaatcagaaggataagacttaatatttaaaatgtttagttcaaaacctatttctcaagtacaaactatgtgccaggtcctgtgctatgcacaggaatacaaagatcaaaatgtttctttctatgtgtaaaaaaaaaccatgattacactaattattgcctaagactgtatcccaggaaaaaaaaaaaagaaacctatgatcataaaaactaccttggattttataaaaaagtctaaaaagggtagattggatggagaaaagtccagataataaacgtggaatttgaaactcagccatgaaccaatggtgaccctgatattttggtaagattaatttgtaatgtgggtaatctacatatgacaaattacctattgactacagctataattcttgcctagtatagagactccaaacacattcaggcattccgaagcaagtcaagttcataatactgatttgatttaaatgagtaatttatctttctataaatacatttggttcttgttctcagaactaatattctttataaggtattatatttctctaatagcattaaaatttgagaagtgtgtagtacatgtaaatagccgatacctcacccaagactactcaccagtcactggtaagaatgaaatgattttaaacatgttattattactatttttttgagacagagtctctctctgtcacccaggctggagtgcagtggcacgatctgggctcactgcaagctccgcctcccgggttcacgccattctcctgcctcagcctcctgagtagctgggattacaggcgcccaccaccacgcccggctaatttttttgtatttttagtagagacggggtttcaccgtgttagtcaggatggtcttgatctcctgaccttgtgatccgccggcctcagcctcccaaagtgctgggattacaggcgtgagccaccgcgcacagccaaacgttatttttagtatgctaactaactactaattttgagtagtgcttatattagagcactttaaaaatatacatgacacccttttctttctatttgcttcacaaataatgaactgactgaaagtatgaccaaggtatacatcttagaatgcagtctgtaaattggcttacggaaaattccgtatgtgtcttattaccacattcttctaatatgcatacattttgtgaagagtacctactattcaggatatggaagacttagcactttacattgttactagttacatagaatacatttcaagcatattaacactaacaagaagcccttgagtattgacaaagattaaatttctcattttacccaaatcagtattacaaattttcttttacttggaatgtctgaattagaaaagaaacaattatgtgtagccctgaaatttttaaacttgaatttgacaatttcaacattctagcgatttaaacattaacagtttcatctcctaaaatctgttggagtacaactccatattttctgatggttccattttacctcctcagggacagctcttatattaacaaagccttttctgaagacgatgaacacacggcgagctccacaacgtagagcagatgttgcacagtcaaaggcagtgtctccagctccaagtacaatcacgactccccgtatcgatggcaatggagagtgacaggcgcacattcctgaatgatgaaaggaaaaccccattttcaagtagagaaaccatttctgcatgacagctcaaaagatacttgtactcaaagcagtgtaaaattgcatcttgcagttttccaggatgaagtgtcactatcaaattattctgcttcattgaaagacagttttattcccattttaaaaatatgctcatatatgtaatttcatagtcagtatctttagtttcttttttcttctaggattcctacaacacattttgagaagtttaggtcataacagactggaatcaatcaattaaaactctcttcatcaaaattgtgctatctatctttaactcagcataattttccttttgctagaagaaaaaagtgatccttatgatctgtgttaacggtttgcaatatttcattataatacttttttatgtattaccttatataatttctaacacatacctctgttatatattttgttaactttgaatattaacgtgctgaataagtgtcctttatgtaactgaagaatttctgagaactattttcttgaaatagttcaaataaatctttctccctttcactgctttcctctggttttgtttgtgaaactgggcagtaaaagaaatatgactttctaagcatccatttctcaaggtcatctctattaagatttgctgtccatatgaagatccttgtaaaaaaagtaaaatgcaagtattccttatgtgttaggtagcagtgtataataagattaaataaaactgtttataagatcaattactataattttttaaatggtaccaagaatagaataaacctataatttcaataagtgtaatcattttgcttggaagattttgtatttgggacactctgtaattttcaaatacaagctaggtgcactatgaccttcctcagaaagggtttcagacatacaaacatccagttctactgagaggcagaaggtggagagggtatgcatctttagctgtaaacttctgaagaataatttaatatagaaagtttcttactgttttaagtcctgggagaagcataaaagtttgtatcatttctacatgtaattaatgtaggaatagctgtggctcagacctctttaaaaatatacatttgaaggatttagattatctgactttggataaaatattacaattttccccaaagacaatgactctggtcaggccaaaccaaggtacaaccttcattcaggtggttcttcttggggtgtataaagtgatagggtgtctatcaaagtattttattttaacatcataaaattactgtttaagagaagacagtcaatctttctgcctgtgtagatacaaatcatataagatatgtgacgattcatgccatttctttgaaaaacatcttccaatgtttgttaaggacttgcttaccttgaagcaatttttcatgatgtagtttagacatatatattacagtgaaaattccttacgatgatactttattggaagaatgaacaaacagatgattctggcaaactgttatacccggcctttttttttttaattttacatttgggtcttaggcaaggttgggtgtgagagctgaacaatgtgctgctgagcttgattttgatattaatttatcataaataaaatagcatactcactattaagcataaaagacaatatgttatacctgctttactgcctttggctacaagtggcaaaaagtctttggatgtataaaacccctggtcctgcgtcaggccttggaagatggcatctttattgggttctggcaaacctaagtaatcaaatttataaaatatcattagcaggaggaggggcttttcctattagatattaaaacaaaaaagaaaactttaatctttgaaataatgtcattcttagaggaaaacatctgtaagcaaatcaatataaaatgtacataatacagtctaacggatctcagagtatattatgtatatctttaatatataaccaagtacacatcgtaaatcacacattaatgtatacctataaatatatggaaacatatgtatatacacacataaacatatataacattacagggaaaatcaggttatattcttgcctcatatcataaataagtcagtttcagctacattaaagtactaaatataaaaaaagttaaaaatgggtacatatttatctaattcctgaataagtaaaatcatttcttttttaatgaaagaaaaaaattaaaggaaaaaacaatgtattttgccacaataattcaaccactgctaaatttaaaaaatataaatgaattaaaacgaaaattattaaccaagaagatgttttaataattaaatgtctttactgtataaattctccaaatcagtaaggaacatattagcttttcaatggaaacataaagaataataaaaattgggagaagaaaaaatataaatcacctataagcactaaaaatattaactccattaagtcattaaactgcaaattaaaagaataaaattgtaacttctctataaaaagaaaaatatttaagaaaattaaactatacaccaagggtagacatggaacttgtcatactctttcagtggaaatatacattggtgttcaatatctagaaaatagtcttaaatctatcttaagaaaatactgacacatgcaaataaaggtttaatgcacaaaaatgattaatacagaaagaggaaaataagatgagagagtaccagaatgtcaggtaaatgaagaaattagttttaccgtataaaagaaaaagacaacagaacgaatatttgagaaatatggtataagattgtaatcaaaatacagtcttaaatgaacctgcaggattcaaaactctgtatagtataattcaaattttgtaaaaaaatgtattaatataaaccatgtaatctaaacagagatcatttagagtggtggtattaaggatattccaatttttattatttccttattttccaaattttctacattgtacatatatcaactataaattagtaaattcttaccaaaactttgaaaggaaaataaatggcagactaaattttttccaaagtgtaaatgaagaaaatcttatagcagtcaccccatccaaggcaagtagagaaataattcatctcaattccataaatgcaggggaaaacatgtagttttattttattactaagactcattctaccaatgggtcattctagagaggcaggagtttattttacaatgaaatgaagggcaatggacatttgctggtagatacagagtaataagcatagccgaaggatgacttttgtcatatgagataaggtgggtgccatatctgatctgaaagctgaaggtttctgtgggttgcctgtaatcagcaataaaccaccattgtctcttcagattaaaccaaacatttttcttccccatccagcatcccctgaatctccttttccatagcatttgctcataaatgattttaaaagaacttttgctttcaaaatgatttccattatgtagtagcatagttaggggagccacctcacctgcctttgcctcagcttctctgtaaaggaaatggggataagactgtttcccccttttatgacataaaaaggtatattagtaacagaaacaattatataaatgggtggccgtttatgtgattcttttagaaaacctgggttggagggatggggttggtaaaaatagctgaatatgttcttgaaggctctctaatgacaaaatgatttcttctgaaacctgttaaaagaagactgaagttaggtctacatttgactattcaaaccaacatatacatatgctacatataattagcttttctttccagtttatttagccacaccccaggtcacacatagggcctcaaggtccacggagccctcctcctctacctgggtgacaggtcatcccttctggccagggacagtgcatctgaaggtctccatgtggatactttgatagtctatgctaatcatagtgctgtgggatgatcagaagcagggattttgtcactagacagactttggtatgagtccttcctctctcatttaccagttctgtggtattgtataagttcctgtgaatcctgtgaaggttagggttagatgtcaatttggctaggctataacacccgttagtcaatcaaacactaaggtaggtattgctgggaaagccttttgttgatgtgattaatatctacaaccacttgactttaaggagattgcctcaataatgtgggtgggccctatccaatcaattaatcaaaaggccttaagaacaaaattgtggtttccctgaggaaggagaaattctgtcttaagtctgcacaatcagctcctacttgggagttccagtctcctgtcctgcgctaaggagttggacttaccagctcccacaattaaatagcccaattccctaaaataagtcatctctatctacccatctgtccatcctactaattatgtttttctggagaaccctgaaattgattttccactacttcatttctaaaaacagagataaaaattctacttctctcatggatgtgagattttttaaaaatgttaaaaaaattacaaaattatgaaaatattaaaaatatatccatatggataaaccatatatataattgagagctggcacatcgtgaatactcattaaacattagctattaatattaagataggtttattctataatttatcaattatttcatacttcatattgcatggcaaggaaagaataaaagcttaaataaaaataaagtattaaaccttagcatatgtaaatcaagttccacaaagaaagaaaaatgaggcaaccttaagtgaaatatgaaagaaaatgaaacttgcaaatagtcatctatcaaaggaagacttctctgagagtaggtggcatattaataaataaggtatgtgtctatactaggatgatttcaaaatgacactgaaatgactttttaattcacctttcagtgtgaaaaagagagtttatgaataaagatgaattgacaaagatttgacaaacaaaacagttcagcgtagtagatatgtatagtctttgtctttcaaggaggccggatagtttgtttctttagaatagttattgaagtttttggtgttttagcatgcatttatacaaaggaacacctccttaagaattatttttaaatggtgattttcacgttctctgaaaaagaagggagggagggagggaaggagggagggagggaggaacgaaggaaggaaggaaggatcctgcttatgttacagaaaatttaaattaacttttattgactacagacactactctaaatgcctggcccccaggtgattattatataactcattttaattctcaaaataattgtatgaggcaactgatgttattatccacattttaaatatgaggaaattgaggcatatagggattaagtaactcgctgaaggatcacagaacatgtaagaagcagcgccaatttctaacgtggacactggttgtagagtctatgttatgagttcaaaatggctgcctttttcatgtttaaggttataactaggccaggttataatgtgaagctacataaccagtcctatctaaagtaatcattcaacatgtatgtattaagtttctctacaaggctgcagatatgcgtacctcacaggatgtgtctgcagccaggttccaatctagtgacagagaaaggactggctgcttctcttgtcagcatttttgttttgtgattattttctccagtacaatccctttctgaaatgttttccttcttaagtgaattcctcttgggtatatcctggttatttttcactatttgatattctttgaaatgtgtatccttgcattgttgccaaagcacctccctctggaacaactacagaataaataacagcagtatatatagtaaattctttccttgtgctcacataaagttttgcacaacttcagttaacatgaacaagatattagatgttctgttacatattaaaatctaggaagtaataagagaaaaaaaaaagcttttaaggctttgctttcatagctatggtagggcatgtttaagaattactcagattctataatgtttgcttgtgttacttcaccaagccacttgtttagtgttaactgaatgatgcaagcatttgtgtgatgcttcctgtccttgaaaggattcatctgaatgacagctaagccatcatgagaaagacagtcatctttggagatagactcacaaatcccaggtgtgaagaagatagcacagaccacagagaaactacctcaggtccctggccaaaggctgtggctcacagaaatgggtgatgctggccagtcacggtggctcctgcctgtaatcccagcactttgtgaggccaaggtgggtggatcacttgaggtcaggaattcgagatcagcctgaccaacatgacaaaaacccatctccacaaaaaaaaaaaaaaaaaaaaaaaaaaaaaaaaaaaattagccgggcgtgctggctcatgcctgtaatcccagctattccagaggctgaggcacaagaatcgctgcacctgggaggcagaggttgcagtgagctgagatcgcaccactgcactccaggctgggtgacagagtgagactctgtctcaaaaaaacaaaaacaaaaacaaaaacaaatggacaatgctctagtatactgaactctacaggaacaccaattcttattatttcacacaggtgctttttcaataagactttggtagacaaataaaacaacactgattgtcactactctcaagttttctggatgagatcagcaaaatgtagctgatggcaaataccgtaagtttttcaccttccaaagtacttttgtatgtgagatctcacatgttatgttactcagtccttattttctaatgctggcttgggaaatggtgctgcattagggacagtattaaaatatacagattaaacatgtatttatggaataaaccaggctaacttccccctctgtcttagtaaaagaaaaatccatgtaacaacttttgtctttatttttgtttattaaatcttataaaatatcttaaggccgactgacctatttgtataattatttgtaaacagtatactggataggactgaaaactctgaagtcagacttcctgcattaaaattctagttctagcacttactagctattatgaccttggccaaataaattatactttctgggcaacagcttcctcatcacaggactgttgggagaattaacacgaaaaacaggtatataaagctctttgcacagatgtgaaataaatgtttcctttaattttctttgcttccttaaagcctttgtttgacttaatgaaatgatacgtttgagtacatataagttaaatgatcatctaatccatgatatacacagtttatattattacatatttaagtggtcagtattggataggtagtatcacagtccacgaaacttagcatctttggctaaaatgaaaggatgtagccacataagagtattattctaacttcattcattctatagactacaatgaactccagctacatgtgcatcaaaacaaggaaagtattaacagcaagataaagtccactcctgctcaaagtgtcattcaaattggagcattaagaacaaaatcatgtctcagacagcattgacctagggtctaaagaactgggttctaatctcattatttccattttctaactgtaattgaataaaattgcttaatcctgtggctttcaaactccttgattttagaatgcagacaaccctgcttactatacagggttctttggaaaattaggtagaaaagtgcacataaagcatgctggtaaatctaaaataacattaaaatgtaagtcattattactgtctttggtaaaatataaaaactatgggggaaaaaggcttacatgataaagagattcataataaacactttcaaataaagaagatattgcaaactaatcataagccatttgggtggctgtatacaggatgtgtaaaagtaggtagaaaatcataaatatatgcatctatgtatatatatgtttatatatgtattagagaagataagctattcctgattcaagcccaagcagttgagattacaatatggaagtaaaatattcctttcaagtgtctaactaagcatgtcgcagttccacaatggattataaagtgtttcatctgtcacttaaagatcactcaaaggatttatgtcttacttctaagggacaatagtgccatatgggttatcattctaggatctatatattgatgagaaagagaatagatcaatgatggcctattgtggttcttttctcaataaaactccccattttcttcccgatgtgctgctgtaaatgcgtttagtactgagtgttcagacagaatgcagaaaaaaatggagtgattcaatataacacatatgaaattagatcaccatgcatcacaataatattcatttcattgatttttgaaatccccattaaacatctgtttcatataactgctgtctatactctttctctaaatgtgaccacacacattaattgtgtgtatcacacaattggttagagaataacaagaacatttttaaaaatgttatgaatggagacaccatttaaatagtatttttttccattacacaagattctttttgtacaccagcacataacaataagtccagaaccaagtggattactgagtattattatatcattttgaaaatctgatacatgctgaatttctctttgtatttaatgtataaaacagtacaattttaaaaagcactagaaaagagaataaaataatcaaataatttttatgaagttatagtatttcaattggcttctatacttcatgtagaaaacacacaaattctatcgtgccaatgtaattacttcacctaacttcatgttagaacttatatcagacttcaatttagaatatctacaggtgagaaaggatgtgaacatattctttataacaaagcaatgaatgtattaagaagtacaagtacacatatgaaatgaattgaatttgagtggttgaaattcttatagaggattttttatctgtaataaatgtccagtgatttaatacaaacacaatgagaatatgggttcaccatgcatttttggtctcatactttttacttcctttatacatttggaaaaaatacatagattttattttgtttaacaaaattatggctttctttatggagatggataaaatatccttgagtatattgtacttttataacagatcatgtctatattaggatctgttgcatcttttcttctatctataggacattatgacacaatgagaacaacaaaccctttggacaaaaaaaagaagtacctttttcttcattattattttataatattgcaatttgcttataattagtagaagttattgcaataattgaaattatactttaatataagcatttggtttagttgaaacatttctagaaaagatgttaatgtaatttcatatttcagccataaatttatcctcattactctgctttatggtattatttattaaagtatactttgtctcttgagccttttctcttctccttttctttatttccctcccttctattttctctgtttctttttctcatttggcttttgctataaaacaatttccttaaattttaatccccgcattgtgaagtaagggtaagcaaaaatctcaaacaatacgcctcaggcaaagattttttttcttaatgattggagttcttagatagtgttaggaaattactgtttaggactgtgtaagtacactatatcccaaagtaaagaaatcattaataataaaatactaaaaaggaacagttatattacaaaataaatcttccaggcttacaaagaaaacaaatttgcaacagccacctgctgtggagatgaggcagtaatctcaacagcaggaaataaaaggaaagagaggagaaaaatacaaaagcacagacattaaaaaagtaattaaaacacttatctccatcgacatacataacggaaaaaaaccctcaaccaaccacctaaaaacatactctattgaactgcacagtaggaaacagcattaaagctgccaccataaacacacattccgtagaaggaagaagacccctttaaaaatgtaatatcaaaagtattactaaagtgttaatcaccagtaaatgtaactcacattcattgtattgtattagttactttctggaaggcgtttttaaaaattgtacttttacattttttactcaagtaaattcttaaacacaggcactgataacccctttatcagtaattgttctagcaaattatacaatcatattgtgagactgaaacattctgtatttgaaaaactttatgtaataattgttaacatatcatgcatcttgataatggcatttaaacagtttcctttgaagtaaactagcctttgctatagtactggaaaaaaatgaggtgaaacacaatgtatgagttagggtcatggattaaaacggaaatgaaagctaagaatcgttctgaattactcatgtatgctctggccttcagagctctgcaaagtgaaacaatgcaagactgaggaagcaagtggcaggctttaaaataaagaacatgtagcaaacgcgcttgtgactctcttagctgctggaatttgttttctacatctatgtgattttctccaggcatatatgtgaaacgatggagagctgctcagttcagaaggataagatctctctaatgagctcttggctctgttacttatatagctataaatccaagcataaataattaaactttaagcctcagtttcctcatctttaaaatgagaagctacaaaaccgcatctccttatagaactgttatgtggacaagtaagcataaaatagctctgtcatactgaaataattttataggtagaaaatgtaattcacaaacatagaaatttgtcgtgctaccatataattattttatctggtgataatattcatcgatcagtgttatttcattttaattctgcattttcttctttaaatgataaacttctgtgcaaatttattttattttactctaagtcattactgtaatttcataagttttccaaaaaaattactgttctcaatagatttttacaagaaatatgttagatattagaaaatatgaaatcattttcatgcataaatatacttggaatatatttagtattactgtcatattgctgagacttaaaatcacagtacttttctaggaattcagaaaattccacaagaaaatcaccttctaaagggcattcttgatggatgcgcttggtcaacaattccagaaacatgtttgacctttttgcacctcagtttcttcatccataaaataggtaaatcatctagaaatggagttctgggccttgtctgtgttttttacagactccaagactatattaaaacagagtaccttttagaagtatgcattttattgtgtacagagggctcacacttttcatgacattctcctaggatcctgtgactcaaaaataattaaagaatcacatttccccactctagcattaaatcaattacactataccatatccaaatgtcttttcaagtgtacagactatggctgaaaatgccaaatgcactgcgattttccacatctaacaatcactacatacctgttcataaaagaaagaatatctgtttataaaagaagttgtaagaatattgggtccagtgtaagcggaagcaacagtttttaatatcagacatccttatgttcatatcgatatgtgatatggtttgactgtatccccacccaaatctcatcttgaattgtaatctctgtaatccccattaattctcacatgttgtgggagggacctggtgggaggtaactgaatcatgggggtgatttcccccatgctgttctcatgatagtgagtgagttctcatgagatctgatggttttataagcatctgtgatttcccctgctggcactcactccgtcctgctaccctgtgagtaaggtgcttgcttctcctttgccttctgccatactgtaagtttcctgaggcctccccagcaatgtgaaactgtgagtcaattaaacctctatcctttataaattatccagtcttgggtatttcttcatagcagcgtgagaaccaactaatatactacttcactataaatactagctgtttaaccttgcataatcacagttatttaaattttaagtctcagtctcaactataaaatctgctctgctgggatattaaatgagataatatatctcaatagtatgataattgcttagcatactgactggcatatggaaaatgttaacagatgaactgatcttgatgtacttaaagcttaaaaaatctattattttcatatgcatacctttcttgatattttttcttccttgatatttaacacaattattatataaaacaccataaaaacaactttaacaacaatgaaaactatggacactttaaaacattcagtcccaattgaaatttccttgagtattggtgattaagcatacaaaacttggcagtttcattgtataatcattatatatctagttctgaaatttttgttgcataaaattattttaaaatagtctatcatattcaacttttggatctggaaaccagcttgatgttttaagaatcatgaggacaatcagttggaaatacaaatcctaggtattaatttaaccacttattcattaatatttactgaatgcctactacgtgctaaacaccatattaggtgatgaagatacatagatgagtacctactatgtactaaacaccatattaggtgctgggaatatatagataaatagcttctggggtagtaggaagaaggacatgtaataaaaaaatttagaatagagcaagacacctgctatgagagaaggatgcataggttaccacaggagcagttacaaaggcacttcacctggactgcagacaacattctaaagctgagtcttaaaagattaatgtttccagtcatagaaaaagggggagtataagcttcatatacaagggcatgatggggtatgagttcaatctgacaacaactggggtatgatgaggggagtagataggaggagacaggaagaagcaaaatgcgaaatttgacaaataggcagggtccaaactatgaggggtcattcaagtcacaccaggatgtttggattttacactgaggaaacattttaggaaatgatataatcagctttgtacattagcaaggacaaattggtagtagtatatagaaataatttgcagaaaataagaatggaagaaggtggatataaggggatactgcataaatccagataagaaaggaaaacttctcttcttcttcttaaccaggattactagtaacctccactaacatggcattgcagggggtatccatagcttagtataaacacagcttaccctcctggggcaacaatttcactcaaagataagtaacttaaattatagtgttcatattacgacaaatgtagagagactgaaaaatgagatgcaaattttgaatgaaattttaatacttcaaagacattctatatatggcattcaaaactgtgcctccagattccctagaggtatgttttcattctcttctcctattacagtaacttaaatgagaaaaaatagcacttatactaagatactgacagtggggatgcagaagaataaaaatataatctcaatatatttaggcattaacttcataggatttggtcccttgtggttataaatggcaaggtcaaagctgagtctcagctttctgttgtatctcaatagcctatacgtccttctctcatagcacatgtcttgctccattctaatttttttttattacatgtccttcttctactgcactgtgattcagtatagtggaagaggggcagattctaagggaagagtgttgttcctttttggacatatttaatggagtgtggaacaaaaatctgaagctcaggagggaaatcccgtctagataaacagatttgaaaattgttagcaaaaaaaatggtgctgggagtcagagatgctaatgagcattaatccagggagagcgtatacaataatcagaagagaaggccaagaggggagcataagataacacacataccttaaggaaggaaagagaaaaggaagctaaaggagatattgaagaaggaccaatcagtcaggaggaggggtaggaaaaagcggcatgctggaagtcaaaaaaagagaggtatcagctcaaactttcttgttatcacagaagaaaactggatgcaaaaatttaaaacattatacagcgcataacactatgtacactgtaaagcacaaacagtgttcaaaagaacacttttgattttaggagtcatctttcttgatttttcagtacaatacatggccactagcctacaattaattttagaaataatataaacaaaaaagatttattgaaagagaatattaaacagaacaaaagcaacaaaacacaaatacatatattgtaactattagaatctatttaaatgagccaactcagaagaagaaaggggaaaactctataatagccacatggggaagtattctagtggcaatgttggacaagtatgaaaagaatgaattggccagaaggagaatacatcacatgaaatcccaggaatcagtacaatggagaatatattcgcactggagcactttctcaagaagtaaaaattaagtcagtaatggcaactgcacatcagttacattctgagtaaataatataaaagggacataacttaatttgtgtaatatttgtttgattaaaaactacatttagaaaatattctcttacaatcttaaataaatacatcaaaactaaagccctgaacaatggaggtgttgtttttctactagtgggtttggaaatcccacagaagggtacattcacgtctggttcaccctaccacagattttctgacctctgaaaccaaaaccaaataaagactcctagacagtagaaatatatgggtaacgtagcgacacctaggtttgctctcggtttccctacctactagctttgtgatgtatggcaaattagcttacttccctgtgccttagtttcctcacctgtgaaatgaaatgtttagtgcttcctcacctgacctaagtgctcttgaattatgaagcatgtagacagatatgagaaatttaataataatgaaaattattttcattttaattggagcacattaaaatgtacattaatatgcatttaatataaatttaataatacacatataaatgtatattaatgtgcaattggcaaacagtcatgttttgatttatcccactactaggtgaagaatctatagcaacagttcatggtggattaattagggagatcaaatagaaattctcagttgctgtttagaaactatttaagttcactgtaaactatataatacataccaattcacgaattatactaacatctgaaccactctaatgatagtatagagagcatacattttgacagaatcaataaaaatctcacatttttaaagtcaatgtaaaataatgaattacattccaaatgcctttggtttaataaactgagcagtctgctttgatactttcttttcagtttctgaataggtaatttctatgatgacatatggttttagggccatttttaatcatttgtaaatacgtttatattttttaaagaaggcatattctaatgctaagccatgtgattcatcctctaagaccaggctgtataaagggccactaccggcaatgaagtctagttcaatcagtttacattccagccacaatctagactcttttgaaaccctaacttgctgttttgtcaatgtattctacagaagataaagaaaaagagagagaatctaattcagaaggtctttcaccactaactgtcttaaatataggctcaacattatacaagctcagtaataataaatattttaaaactttgcatttgtaaagtgatttattacttaaaaatatttcttatatacttgagccccacaaaaacactatggactaggtatccttatgctcatttacagatgacaaactgaggttcaaggcagtaaaaaaagctttctataatctcacagacaagtggcaaagacagatttaaaatagcaaaaactgttaaatacatcgtttcttccatcatttcataaaatatactttagggcagcatttaatctttattgttagagagagaaaaaggaagcttaacctagtctgaaaatttggcatacaatgctatgtggtgcttgaatgttaatatagctattttattcataagaaagaaaaaaatatgctttaaagattagtaggtaattacttacctatcatcccacctacactacattttggaatgattttaggtaagccacacccacttaaacttaaatggcgtcttgtaaaagtatcttctaagcactactcatttgtttaaagcacagatctacaatgacaaaaatcaattcattttgagaaagaggtaataattaaagtgttatttttcttctttcactgcaagtcatttggcctatgttaaatcaactatcaaattttcattcattatttctacatgaaggattctgccagctcaaaaaagtataaatcttcatttgacaaatttaaactataactgtcccagatgttatcaggcctcatagttcttatcccttaaaaacagcaaaatattgtcaagtcacaccaccccccataccctcagataacccctggaatcaataatatttgtaacttgtaagtgcacggttaaggagaacagaaggcaagtgctgtcctcgttaaccacattgagctgtgataccacagccgactcccttgtgtgacctgtgatcaattttaatctcctgaccaagaataaaagagtgcagactcctgattctggattcatcttgaaaggagattatagatttgcatgtttgcagtgggaatgaaagatttaattcaactggcatttcaggaaagaacacatctaaactatcattcctcctcatttaccctcactgcttccaggtcctctattgacagaactaaatactgaaaactgtgtacgcgatgggttaaaaagcaaagctatcttcgtggacatatgatcaaataactacagaaacagactccatagtgatttcagtacatgatttcagatggaatcagatttttgtatctcagatttcagatttctctataaagattacaattttttgcccaacttcttcatgtgaaaatcctatttttaagcaattaaagaattcattgtttgctcaaatcatgattagctgcttacaaaatacatatatccaagtacattgatacatctggggagctttaaaatgcaaagtaaccgtgatgtcagaaagaggaaagacattaccagttttagtttcatatctctatttgtaactatatatcggtgtgtttgtgtgtgtgtatatatatatgtgtgtgtgtgtgtctgtgtacgtatgtacaaacatacatatgataatagatgtattcatccattttcacactgctgataaagacatacaggagacagggcaatttacaaaagaaagagacttattggacttatagtaccatgtggctgggaaggcctcacaatcatgccagaaggcaaggaggagcaagtcacatcttacatggaaggcagcaggcaaaaagagagcctgtgcagagaaactcttgcttttaaaaccatcagatttggtgagacccatttactatcacgagaacaacacaggaaagacctgcccccatgattcaatcatttcccaccaggttcctcccacaacacatgggaattatgggagctataagatgagagttgggtggggacagagaatttcatttgggtgataaaccgtatcagtgagtttatacaaaaatgcacaaatcttatttttctatagagagaaaaaataaaatatcttattgttgaaaatcaagtaaatataaggtgttctaggaggttacaggggcaatccatgcaactgcaatttgaaaattctataattagtattaaataactttttctatacatcagataacatttccaattccacatcatcacagcagttttcaaacattcacaatgcatcacgtactgtgctagacaaatccgagccagaacctaagtttgagtcctgactctgctactttccagcaagttagcttaccatcttttactacagattttttcatctgcaaaacaagaataagatccttaatagcactgagattaggattttttgtaatgattaaatgagataatataagcaaacctagaagtagtgctcgtggtacttaatagttactacacaggtgttagttgtagtaaaacgtattctgattcattcattcattctttcataaacattcatcactccccgtgttgcaaggactgcgttaggaaatattctcataactttattgttaacataaccttcaagcattagtttatgactagaagatgcatgagtggctcatgtgtaatctgggacataatgacaaatatttaggatgtatcctatttccacagatccccttatgccctgtattgatattaagtggtattaaaagtagagagggcaaaatagaccaacttaatatggtgttgcatttttaaattcagcatattaatgcaatatactattgtctctgtggagtttcatttcacacgataaaagaaccaggaggcatctgatcaataaatagaaaatcaagttatatgttcctgttagggtggtctaacaaggattaatctcagaaatgttggtgcatgcctaatgctgtggcttttaatcttttcacacaagtgggtctaaaatacttgctattagcactaatgtaaaaaaaaattaatactttacatatggctatccactgtactcaaatgaaggggttaatggtaaaacaagcctttaaagatgtaaatgattcctcccatgtggctgcaaaatagcttaagtgtttgccatctaaaattattaacatatagaaacattattatctctgcagttaatatgcacctcactgaaaatctcatggatgcaacaattaaggaaggcaccatccttaatgaagttataagacatatatcatttattaagcagcaaataatatctttaattttggctttaatatatctttaattttagctttaatgattatatgcaaaatgtcttccaaaacctcaggacaaattataccatagcagttgggcttgtttcttcaatccctcatcctctatgctgcccccagtgctgagcaagagttgtcatttacctgaggcttcctttctatgagcatgtgcttctctgaaatactgagataatcaaggccaggacaacactacatggatgttttttcattaagagtttatatctaattttgaaattttcttactgattattatagagttttgaataatctagaatgaatgttatccatcacatttttattactaccctaaaatgctaaatagtagcataaaaatattgaaaccaagttgggcagacatgtcttttctctctctttccctttctctctttccttttttctgcccttcccttgattccttccttccttcaataaatatttattaagcagccttcctgtaacaggcattgttctctaggcaagttatctaaatttgtttaaatcatatactaattgaatgtaaagtctatttgtacagtcaaaagataattttggtggttaatagtcaattgagtttaagtctgggaaccctctttcctaaggaaaatatttcctttatcacactctttgttcagtgtgctcataaaaatcaatcataactctctgaaaatgatgagaaaaaaagagtggacatgtcactaaaatctttaataaattttttactcttctgcatcctcatatttatcatctgttttacataaactattgggtggtttcactcacaaaaagtccttaaatgcgacatctagaaatctggggcatactgagtgtgctggtgagactttccgaaacacctgttttcaacgcatgatctgccaatatgtgtttaaatttgttcatttgttcaatatatatttactaattaaaattataaatggaaagagctagagcatgaatatagcgtttaagtaataaaatgaatcctaatgtacagatttttaggcacaaaggacatgacagaaataagataaatagacaacaatgggtatgattatgtattagcaaacatcaataattagtaaaggcacaagtagaaaggataatgtcatagtggcagtagctacagagatcataaaagtagcagttctaccatgttattttcctttgtgcatacatacaatattataacagtctttgaatttcctttactagctcatccttttatctaattatctggctcacgaagagccagggggagggatggatcttacttgtaatctcagcaatttctctcattgagttgatattcaagtaactgaaaaattttatatagcagctaccgtagttccacacatggtattgggatatggtgatttaaaacttaattaatatttttaaatgaggcaaatcttcaaagtttattaaaaattttttaaagttttatgacagggtgtatcaaacagaatccctacaaaaaataaatgtcacacttaaattaggataacccgagattttatttactaaagaataattataaagatataggtaaggtgttaaggtactacaagagttagagacttgagctagaagaattagtttaatatcaatgtttctgatgaataatttaaatacttttactctgtgttttcagtagatcaagtgttgccttaatagatattatgtgaatgatatttataagactgagttgatttcccccacaagtttgacaggataaaatcacacataaatacttttaataaaaccatagtagactagagataaaaggcatgtcaaggacaattagcccctagaaggggcttaacaagtccaaaattttatagctaattattcacagagatgaggcctaaatccagttagctaattctaagttccacttcattttcattagcaatggagggaagcatcacgactactcactaatataaatcaactatacatcctccccacccatcaagatgcacacttttcaatatgtattttaaaatctttaagtatgaatgtacaggattatttaatgttacaggttgaagagacattggataccatgaaatatcattgtctcattttagcactgaggaaactgcagtctagaaaattttacaattcttagtgactaaaatctagttaacagcaaagttaaggcttacagatcttctaattcaaaaatcaatgctctttccacaatcaaagccgcctcttttctctgccttatttattccttaagactgtaggcttttaaaatccagggcaatatctagtttttcatatatgcctaaaagatctagcttactcttaaactatgcaatactatttgaatactagtgctaactatgattaaagttagcacacatttggaaacttgcataacactgctaaggtctctaaccatgagtaagacacaattcttgtttacaaaaataaaaattcataaacccatatatccagttgtccaactgcttactgaacatcttccactggttgggctagtaacacaacaaattcaagatgtccaaaatgcgattcttcattttcttctccaaatgttctattattcacactttctgtctttttgaactatgagatgatcattgattcaaaatatattcatagagcacttactatgagctagacactatgctgggtgtcgggaatctatgctgaccaacagtggggtgattctgaccttcatgtaaaacatgacaaaataattggtaagtacaaactacataccagctatgcagattaccaagtaacaaacagaaccatcctacacaactccctctccatcaaacttcatttctacaatcaccaaatcctattcttttcacttaataatctttcaaattaatctcctcagtctcactaatattgcttaggcccttatcttttctatcctggctgacaaaaaaataacctcccaaactgatcttcctgcttctttcctctctgttggtatcattccccatcatgctggcagataagtttttctaaaatgaaaaattcgagggactccccagtgtttcactccttagcaaggaatataaggcccttcattatttgaaccttagtctcatctcccccaaccccttcagcaattacacttcatttctgataaaccaatttgaattctgtcctatagtgcactgaatacaacattccccttcattacccctgagttaagattccctctgactggcatgcccttccttccctcctttgcctggcttccatttaccttgatccttatgaagcatatgatacgttaactcctctgagaagactgacagaccactgtcactccctaccccaaacagaaatagcagattcctaccatgtgttcctcctcttcattatccttacacccagggtttgagtctattttattggtatttacactgcactctaataaatgatttttttttttgtctgggaactctttacggagtttctgctttgttcttctcggcattctttctgcctaggacatactaggtattcaattaatgttagtctaatgaaggaatggtaaattcagttttcatttgttcattttttatttattgtcacacttttctcagcatcataaaagaaaggttccacacataagtgagtaaatcatccctttctttttaaatatccaaggatcaaaatgtaatttaggataatgagattgaaaattattccaagtcaagaataaaattcttattcaaaatattatctttttgagacagataggattacattaaaagaccagagagaccacacggagatgctggatacttacctattgttcacttaattattcatgcaaactacttggatgttttactaaaaccaagatttgcaagcatattaatattataaacccaagaatcacaaatattaaaaaccgtctctaaccatgtagctcaaattacttaagtgcttagataaccgtgataacacaaaaaatagagacctagttcatacaaaaaagaagaaatatatatcctaggtgaatgacttgtacaatatgaaacacagcaattataatttttaatttcaattgtttatgttatgtacaaaaagaaaacttgaagaatgaatatttcactattgcattaaaattcctaagattattagagtagtgatttctcctaaaattaaggctatgaaagttttatttctttttttttgagacggagtctccctctgttgccgggctggagtgcagtggtgggatctcagctcactgcaacctccgcctcccgggttcaagtgattctactgcaagaccatcctggccaacatggtgaaaacccatccctactaaaaatacaaaaattagctgggcatggtggtgcacacatgcagtccaagctgctaggaaaattctctttctttcttttgtaaatgatccaaggatctaattcccacatattcagatggggcataagtatgaagaaaacacacatacaaacacctacgcatacacacacacaaacacacagttcgtgtctacaacctccaaacgttctttatcagaaccacaagactgttctaaaatgtctatacaaaaacactcaactatccatgcctaaataaaggtaattggctagggactactgatttcaggcaaatatatttttacaagagttacaaaacactaagcaacagtggctgtgtcagactagtcagcctgtcctactcatatttgtaagttagtaatttaaaaagctatttggcttaaataaaattatatttacattggaattcttagaactttagctttgctggatctttggcttctggtggtctctaggtccagtgaaaaacaccaacattgagagtaagttcagggtgaggataaaacatctcctatgaactagggatacctacaaaatatttgcagggagattctatctctgagagaggtgctgtggaggggttgggggtgtctgctgacaggcactaggtggagtgcatacctgggaaacaagacttgtcaaatcattgctaccaagcaaggtctgcacatctgcagcatcagcaccatgtgagaaatgcagaaactcagactccacccctctgagtcagagatggatgcacatctccaggtgattcctacacgcattaaagtttaagaactattaaaccatgagttatcacctcgaaataaggagaaacttttatgaaaagaaggaaaaagtctcaagctgccttctcttttaaaactctctcagtttgccacttgggtccccaaaatgtaagtcataccagggtcagatctgctgtaggtctgataactatataagaaaccaaatgggcaagtatgtagagaaataatttttatatggtacagtagacccctttaagtgttgtcacctgaaaggtataaaaatcattgccctgccttgctttttgtcaaatttcaatgataaggacattaaagctttgccttagtactgttctagatcagtgtttctcagactctccatggcaagggactagtcttctttcattccaatccttttcaattattttttaagaaaacaaaaataaattactagaaacagaaattgacaaaaaaaatcacaggcatagcatgtcctgacattttattacttgattcattagacatgtaattattctgtcaaggattttttttctttttttttttttttctagatggagtctggctctgtcacacatgctggagtgcagtggcatgatctcggttcactgcaacctccgcctcccgggttcaagcaagtctcctgcctcagcctcttgagcaactgggattacaggcatgtgccaccatgcccggttaatttttttgtatactctgtcaagtttctataaaagtttctaaatacagtgtgtgggcttatctcattacagaccagtaataaccagttcagagtccggcgccagtctatggctacacaaccagcagcattgctatagatgacacagaatttgaatttaggtagatgatacagaatttgaattcaggtagccacacttcagaaataaacgtaggattttaatccaggcaatcaggcttcaaaaccaacagtttcaaccaagccaccatcacagattaatgaagggcacggggttccttgcccatagcttaatatggagttttggtgagctcaccacataaaatcgaaggcagtgtagatagaagaaataataatgcaccagaaacatccaggatgcaatcttgtgtctcatttctgcagtaacagtaagtaatcttggtgaagatgtttttatttatcttcattcctttttatgatttttgtttctatttgatgtggatatccaccagactgtaaatggggataatatatcacacaaccaggttgttataaggattatatactttggtaaaattttgttgttttatttcatacagattggtaaaatttacaaaatcttacattctagaaaagtgtagtcaattgtttagtttcaaatcaattaggtaatcataaaatattttcctttcttttaggattgctagagatgcctaataacattatttctactttaaacaatttgtactaaattatatttaagtatcttatttatatcaacctgacaactactagcttatgatcaaaatggaatgctggttgacaggacaaaataccatgttctgtttgattcgcttgtctttagcatgtagtaatatatagagataacaagttagcaactttccatgaaattggacttaagcatacgtttgtacttaattgttcagaatgtcatatgagaatcctgaaggaataatctgcttttctttcaaatgtattgcctatattaaatccgcatccacccttttatcaatgcaagggaaacaccggttacaaagttaatgttaacgaccattgcttctatttttataatactgactagcataaaaattcaagtaatcatgcttcttataactttgaaaaatgttagttttttccttgctcttggtatcttttgtgattttaccattacacaaactatctaatttcacttagtttctaggaaatttgaaggtaactttttaaaatggatatatttaatatgaaaacattattttctgggcttaaggccttaaagtattgccagtggcatttgtgcctatactgtttgacagctttttctcatgttgaaaaatagatttgaggaagttaaatcaaattcaaacatctgtgattgccatgactgattctaaatacaaaaaagctgaaagctgtaagaaccgtttttagccattctttttcatttaattttaaagttcggcaaaatctcccagtataagtgaaaaaaaaaaaaaacataggcactttggaattattagcctgggttacactcagattccagtgagatttggctgcaatcactattccaattgatacacagggcattcatcttaatgttctgccatttactggtgttcccatacccattttgaaggcatttacattttctttttgtccttttaaaaaaaatttttttgagacagtgtcactttgttgaccaggttagagtgcagtggcatgatcgtagcacacactataacctcaaattcctgagcttaagcaatcctccagcctcagcctccctcctaagtgggactatcggcacatgccaccacactccactatatatttatttatttgtagagataaaggtctccctatgtttctcaggctggtctcaaactcctggcctcaattgatcctccccgcttggcttcccaaagtgttaggattacaagtgtgagccaaggcacccactctcacatttagatttcttactggcaacatctcataggttattaaccatctgccctcttaaaattaactttttaaacatagttggccaaaatttatttcagtgaagtttcagataaattacaatttctggatatctggacaggaatccacatttaccttttatattgttcataattttataaattctattcgtatatgctctttcattcttcactgtcccaaaatgtaaaagtccaatcttcttagccttccttcatacttctgcccctatctaatcattcttttagcaacttctggttccattttgataatcattttttaatttaaaaaatcagcttcctacttgtacatggattacagctttatttaacaattcgataattagataatgctttcatcctcttaagagatttatcatgaaataaaaaagtttagcatttcattcaaactcagctatctaacaatcagcatatttgtacatatactgtacaagcctgtctaattttataatgatggccatgtcagcactgcaagaggctgtaatgccttttgaatatcaaaagaaatttagatttgattgagtatattaactattttggagactcatcaatagcatataggacctactataaattcatctttattctaggtcctttcagtagtacagaaacatgctaagtatctggcacttttgtatcattttaaacataatgaattggaatggtggtatgaattaataattttaatgaatgtaaataagaattgaataattaagtaaactgatagtagattatgggagtcaggtgttttcactgttgtattgggaggttaaatgtaaataagaagaaaaggatagagagaggctacaatggtctacgtggtgatgaattagagtggaagacatcagtatatacacatgtttcatttaatacagatacatatggttaaagaaatatgtatgtattagcattttattcaaaaatcagctatctaataattaacatatttgtacataaataatataagtctaattttgtactgatgtccacatacatgtatatgcataggttagtatacacatatatattcccttacccatcagctgggagggcctaacaagcaataacatcacagtagcaatgagcacacttagctcccagatcttgatttctaataccattatccaataaaagaaatcagggcccccttggagaaacacctgattctaggacttaggaaggaaatatacaagataagcctagatcatcttgtagggccagaaattaagtgctaaaacacaaacacacactaatgcatgcacatacacacatacacacgcacagatgtagatatattaaagggacacaggagtaaactaaaagaactcccaatggacacagccagaacaatttgagcaacaaaacaaagtgatattagtttacagcaaaaagtaaaaaataaatatccacgagtccatcatacttatataaataaatgactgaataaataaatgggcagaatagacaaattcccatgcagatgaatcccaaatgatttatgtagatactctattctcaaggaagtggagcataattccccactcattaggtgtggcctgctcatagtggctttcttccaaagaacatgatatgcaaagagtcataaaagagtaattttttagtggagaaacctgacatacactatgttagtcatgaaatcaaggttaacattaatcatgacaaagcttattgatagtatataaaataaggtgatttaaataaccctttacctctgtggtcttctgcccaaaaacccataaccccagtttaatcatgagaaaaaacacatataaatgtcatttgaggaacattctaaaaaaatacttgactagtaatcctcacagctgtcaaggtcatcaaaaataaggaaagtctgaaaaaaccattgcaaccaaaaaaaagcataagaagacatggccactaaatataacttgggatcttggatagactctaggtaaaaccgaccctgggtaaaaactaaggaaatctagcaaatgtgtggaccttagttaataataacgtattaattctggttcattaattgtaacaaaaacatactatactaatgtaaggtgctaacaagagaggaaactgaatgtggactccagcgattctgtattgtctctaaagtaactctgtaaatctaaaactgttctaaaataaaaaagtttatttaaaaagataccgaggaataaaagactaagttgcatgaagtatgagtttctatacaagactgtatataattagatgttattttatgcagtttccagtgtggtgaaagtgaagaagaaaggcaggcaaacaagatctgaaggaatcaggaaatagtttcatgaaaagaatggcgtttacacagaatcaggagagctaagatttgcatatgtgaagttgagaagggagtatcatgatactgaagggcaaaacagatgcaaagacttcaggcaaaaattatttaaaaccacttctcaagaaagtgggtatgagataggactctggtcattctagtttccatcaagctgggcaatgttgaaagtgaatggagttagtccaaggatattggcaatgaccagtgactcaagaagcaaaggaatgctctcaagaatcatgaccaaagactgtgaagcagagaggtaagaattaggtgcaaactgaggggtgtcccccacaaaaaagcaagatgaagaaagcagtctgaataacaaaggcaagccagtaaagattcctcatgaatttccccacaaaggagaaaacacataatcttactcataaagctagagcaggctgttaaatgttctcttatggaaagtaaaaaggatgttcagtcttcagcaaacataattcactgcagaataacaggaaataaatttgggaacacagtgttcaattgttaccaaggcctcagggagtcaggcatagtgatagaaacattttaatgagggggtttggatcaaagtcataatataatgaaaataactactgacaaaaggaatctacaggttcagtgcaatccccatgaaaattccaactttaattttcatagaaatagagaaaacattaccaaaacacatatggaaccattgaaaaaccctgaatagccaatgcaatcatgagcaaaaagaacaaaactggaggtatcacattacctgatttcaaactatacaacaaagctagagtaattaaaacagaaaggtattcgccaaaaaaaaatagacacatcaaccaagggaacagagtagagcatccagaaataaacccatgcatatatgatcaactgatttttgacaaaggtgccaagaataagcaatgggtaaaggatagtctcattgaaaagtactattgggaaaactggatttccacatgtagaagaacaaaatttgaccttgcaccatataaaaaaccaactcaaaatgtactaaatactgaaacataaaaccagaaactctaaaattgccagaagaaaggataggagaaaagctacatgacattggtctgggaaatgatgttttggatttgatcccaaaagcacaggcaacaaaagcaaaaatagagaaatgggatttgatcaaactaaaagacttctgcattaccaaggaagcaattaacagtgtgtagagacaacttacagatcaagagaaaatatttgaaagctgtacctcagataaggagttaatatccaaaatacttaagaaactaaactcaacagcagtaaaacaaaaatcccaattaaaaatgggcaagggatctaaatagacatttctcaaaagatgacatacaaatggcctagaatatatgaaaattatcctcaatatcactaatcactagggaaatacaaattaaaacaatgaaatatcatctcaaacctgtcagaataacttttattaaaaagatgaaagataacaagtgttagcaaggatgtggagaaaagaaaacactcttgttagtgagaatgtaaattagtagagccactatagaaagcagaaaggcagttcctcgaaaaactggaaatacaattaccatgtgatccagaaatcccacttctgggtatttacccaaaagatttgaaatcagtttgttgaagacatgtctgcacccccatgtttattacagcactattcacaatagctaaactttagaatcaaactaagtatctatcaacagataaatggataaagaaaatgtatatatacagtatgaaatactattcggacttaaaaaagggaaattttattatttgtaacaacatgggtggaattggagaacattacactaagtgaaacaagtcaagcatagaaatacaagtactgcatgttctcacttggatgtcgaatctgaaacaattaaactcatagatgcaaagaggagaatggtggttacagagcttgtgtgttggggaatggggtgatgatggtcaaagggtaaaatctcagaccataagtgtgtgcttttttcttttttttgagttatactgcacagcacagtgaatatagttaataacagaatactgtacatttcaaaattcctaagatattaagttcatatgttcttaccacaaaaaagttaagatttgaggtgatggggatgttaactagcttgatttaattgtaccacatactatttgcaatattataacatcatcttatgcctcataaatgtatacaattataactgtcaatttataataaacttttataaatcaagaaaagaactattgagaaataattctaattggaaggattacatgtaagaagaatttctgaacaagagtctgcctttaaaagaaaacactgttgtttataagcatctggattagagtagtatcagaggcaatagaataactggatgtaaaatgatgacagaatgactatagatgatatatcaatgggtaactgttgtgaactgagtagtatcccctcaaattgatatgctgaagtcctaactccaaatacctgacaatgcatctgtatttggagataagatcttcaaagaaagaattaaaattatggtcattagttagagtgggccctaattcaacatgactggtgccctaaaaacaggaggaaattaggacataggcatatacagaggtgacagcatgtaaacacacagggaggagatggtcatctacaatgccaaggagagacacctcagaggaaaaaccaactctgctgccaccgtgaactcagacttcctgcctccagaactgtgagaaaataaatttctgttttaagccaccctgtctgtgatactttgttatggcagccctggcaatctaatacgatgataaaacactcagttttattttttgaagctttgcaaccttatacaataattgtgacatcactgacatagactggacaaatgaaagaaaaggtcacgtgggctttggcagatgatgaatctgtcaatacaaataaataattgttcttttcgggtcatttcaaatatcaagggtaggaaagcttgtcctcttggacctactagactatgggcaaagtgaggtcagagaccacttctttcttaattgttcactctatccgtgatgcctgaaatacagcattaaatacttaactatttgttaaatgaataaactcgtatttcccacggtgccaagtccagagtctcttgcattttgtcagcgtttcattaatgtttgctaaatcaatgggaaaaaaatgtcttaagctctaatctaagttgcaactattctgaaatgtcaatgatattaacataaatgagaaaatcattaatataaacagaaaattcatataaatattcagttacttcaactatttcttttttagaagattttattctcaatttaaattggaagtaaatatttccaatgactacgactgtttactacaaagacaagaaaaaaacaaacaaacaacaacataaaaaaacatacaatgacttcccatttcctccaaaaggaggcaagctcctctgcctaactgaaaattggttcacattttgcctcaagtttctactcccatctatagtttctgaatgtgatatatacatttcacaaacattggtcttctaaaacaatgttaaatcaatatcagttattatttgcctgattatcataggtgggaaagataaagtcttagtatgtcttccttccgcattagcctgaccattataaaaataaacgacatagtaaggaaagagaatggaggggaactttaatttctgaaatacatattacatgctaagtattttctcagtgacttaaattcccaaagcatctcagtaaaatatattagtagtctttctttcttttttttccacaagggaactaactagagcttaaatagactgaaatacctttccatggtgtcttagttccggcttctatgtcaaagtgccatagactgcgtgacttataaacagcagaaactcatgtctcatagttctaggagctggaaatctcagatcagtgtgtcagcatgtctggatctggtgcagggcctcttcaggcccagctccttgaggctccttttatgagggcactaatccagttcatgagggctccactctcaggtcctcatcacttcccaaagaccccacctcctaataccattacaacaagggttgggatttcaacatacacatttagggagacataaacagtccataacacaaggtaaaacatctgctgagatgcagatccaggatttggattcaaatcctacataatttaacttacaacatattgcctccaggattaatgtcattttatatgtaaatattaccaacaataatttaagaaacattatttctagaaacagaaaagttttcaattatctcttccaagtaagaactgatgctaccgcctaatccccagtgttccattgtgcactgagagcacgaggaagccagcctgtggcaactcactctgtttcaggtattttccctatatcaccctcctgctctgcaattccccaggttttctaagaaccaaaaaatgtatgcttctttttcatttcttgttaacaaagaacaagacactgtattaggatgcctttatcttacccacttatgctatcatctgccatagggctagcaacttgtaaaattcctcaatttccaccttgcttttaatagaaaatactgctctaaataacaccaactctcttctctccaagtattctatcttgaaacatttatccagcctagatgacctagaggagttgaacatcattagcagattatcatctgatataacattactaatagtattatatattaatattatataaaacacatatacatatacaaaaaataacattataatactattaggttcaggaaggcaaaattataaagggccttttgagccatgctaaagactttagatgctatccttaaaaagaccagtttgaaagtgagttgtaactatctgctagcaaaaagacaattgcatggacaaagataatgatagtaggaatgaaagggcaggttcctatttcagagacattgaggcacagactcttcatgatatgaaaactgcctggatgttgggggaaagggaaagggtcttccaaatcttgaccactttcatggaccaaatcctcctctgataagtacttgtttcctagctctattaattctattgcccaggctctccaataccctccatctatattctagggaccagatggactttttgctgtaaggacctatttctaaattcttcccatgtgtcctcatcattcctccctataccttgatttcaaggcaactcaaactttgaataatacgtatcacattcctagacaccactcagtatacacagtgatttttcttattgtgtatgggaaagagaaaatattctcagacattaacagttaaattatcatttgtaaatcagctagtgataagagaagatgcctttggcatcatatatattttgcctgctgttttaggtcctgccatcaagcatgtagtaatattttcaaacaattctatcaaataacagttgattatagaaaattcagtacaacttagaaatcttgccaataataataatgatagtaatattacctcttaatttttatgagaagggtcatgatttttgaaatgatagccaagtccaacttagacttacaaaatactttatatatgcatacatgcaaaaaaaaagtggctagaagaaaaattcagcaccacctcttcattatatgcaaatagaattagtaaatacgaatgtactacgtactagtaatatgcatgtatatatgtatgtaaatatgaatgtatgaccatgctgttttatagcctatgtactatctgtgcaaaagaggacagtggttatttgctcagactttagaactagataccttgagttcaaatcccagcctctacatgctaaataaaagaacccagactcataatgatggggctttagggataactcatatgatttaacatgtgcagcaggactaggtgagtccctggcaattagtaaacaatcacacaagttggatgtttttatggctccttttaatgattaacattaaaaataagtcatttatttgattttctgttttcctcctaccccatatctaatctatcagtaaatcctatcggtctcacttctaaatggcatgcggattctgatgaattcttaccacttacattgttaccactctcttagcttgggttcttccagaagcagagcctgagtcaagaaatcaagtggaagtatttatttgggagataatcccaggaaacaccaataggagggtgggcaagtgaaacaggaaacaaaataaagcatgtgttaaaaagtcatgctaaaaattctaggagccaatgtaggacacacacctcaaagctatcctaccccagtggtcaggcagttggtgcatgaagggggcatcattcatcgtttgaaggctgctcacagaggcactagttcttttaacacatcctcctccaatgttgtcatctcttttgcccccttacttagttagatatagccatattttatcagaatacagccaacataactgacactctcacttcttgcagttaactcaaaggtccctccacagacaggccatttctgataatcctatttaaaatagtgtctctccaaaaacaaaaaaaaacaaacaaaaacaaaaatgcataaaatgctagaaatctttgccatatatcaatatattcagcaaattctacgagtggattttagaaattaggatttagacaatgctatgatctatgcaatcattttaattttattcacctatgtaatgggggtaatgaaatttatactgggggctgtgagaattgaataaaataatacaaataaccactaacctattacccatttctaaaatatcataatttcaaaacattgtataaatagaatcataaagtatgtaaccttttagaatcagatttttccactcagtcttattgtctggataatcatctaagttgtcacgtatatcaataatttgttcctttttaatgctaactagtactaatatgatatatattatgacagtttgtttaaccattagtcagtgaagaacgtctatgctgtttatagtttttggctattacggataaagccactatatacagtcaaaaaaaaaagaaatataaagcactatataaatataatacaaatgtattattcttacattggacattttttatattttgccctaaagttttctgtgcaatttgttttatttcatttcccattttcctaaccagttacttttgttttgtttttacctccaaaactcctttaagtactttatgtgcctcatcatctctcagtgtttaatttggtgttgctctatttctccatgccttctctctaatgctgtttctagctccctccacatccccctcttggggtgcctgctccttcctctgagcactctgccagtgttgtctttcctgcagctcgaagctaacaagaccctgaactgctgcttctctaggacctcagagcttagtgttttgtcagcttcaagctgttttggagaaagtgttggcttatttctcagctgtagcattgacttagcaagtctttcttctaaacttgtaaataattcatttcaggtcaagttttgctaccagaaacttttcccagtaaataacaagtttctttatctccagtaagaaagtatggttttgtggtaatagtggtgagcaacttattaataaaagataagttctataataggaagggataagccttccactttggtacaactcttattttgctactattttttgatagggagcaaagtaaagaattatagtggtaacacaacttcctgccctttacaaagcccatcaataggaagtattatcaaaagctttgagagataagccaaacctcaaaaggatactaatactcctttgtcttgatttgtttcattccaggtcctctaataacttaaataattgaagaaatggaggtagttgaaacaacaaaaacataagcacgtaacaggcttctgagagcaagcttactgattttcatttgctggaaccacgccaaatgtgggctatggcgtctcaacaggatttccagtcacttcaaactgtcattgtctgagctgccccagtgactggattgagatcaggagtttcaagcattctgtttggccactgcaagccaaaaggagtgatggctgcaaggcataaaagggtacagactctctctgactagcaaaattgaaagcccagccagccacaatcaggctggcttaaagcatagtttattttctcttgtcaatctcagcaaaccctatttgttgttggcgtttcaacgagcaagacttattaagggtgaaatgtcaatcttgggccttgctctaccttgtcccaggtcagtaggcaaccaaagtggtcattctagcaagtagcattttgcaatcataagtgcttatgtgaacccaatctgagaaatgatttatgttgacaaaagagtaagagagcaaatgtataaagcaaaaaagagatggacaaaagagaaaaagtgcttcaaaggaactaagccagaggaatttcatatataaaaatatatatgaattaattttatatgctttactcaggaaaagacacacatacataccacaaaaatgtaagaataattgaaaatagagtcttcttgaaacatatttaggaatttgaacaaatgtctgttctttaaagttacgggagtgggtagagctttatgacactgtgtggggatatgggggatagaggagtcagagaaaccataacattaaacagatgcataaaaataatattagagtattttatggatgacacagttatagtttttaaaaatgatttttaaagacccctttgaaattgagatttgaattatacataaatatagccacaggacttctaaaattctataccaccgttcgattgtaatctaaaagggatgccaaaagtgcataagcagaagcccatgtaacttcttcacagtaaaaattactaatataacagggactgaaatgaaaagagctggcaatgcattttccccccagcatatcaagcaggttttcataaggaagctgtggtcatcaatcactacctcattaccagcccgtcatctgggcttaggctaaatgtattctggctggctgccatactaaatgttcaatgaaacatccttaaggctctctacaagttcagctgaagtcgcacatgctatacatcaaagaggaacattagcgttatcatagcttaataaatagtgccattccagcgatgtaatcctgtgttctagagctatctaccatccccagtattctactgcttaagtaaacaatctttctgtctcctgtgaggtttatttaatgataaatacatgtagagataattagtcatactactactgatatacaaatgtacttctaaacttgctgaaacctggacatgaatgagagtaacaaatattttaagacacacaatacatttacaaaatctgtcttggaatattaatcatacatgtacattgctattcatcaatgatattttgactctcattggaaaagttttaagccaaataatgaccccaatcttacttctgacttccccaagttcaactgattgaaatgttgtgcaaataagcaaccatttccttattgaaatggtcaacaaggacctcagttaaaacaatggtctcaggatttttaatatatttacaggtgtcactaccttcatttgtataaactatcctcagataaaaagactaaaagatgggttttttaaaagacgaaaattagacaaaattgttttagatcactcaacatttttacaattgctggtcaatcttagattggtctttagagcctaaagatagagccaacattcacattactaaataaaatgtccctggcttctctccaagtttcagaaacacacgtaatcttagcacaaaaaaaatggggcatacttttcaaactgtatcaaatttgcccaggccacatggctttctttagttttcctgctaatcacatgctattgattaaaagccaaaaaaataatatttgagagacctgaaaggtgaacctaaaatgtgaagtaaaccatgtttataagaattttgggtcaagataggatatgacaacaataagttatattcaataagaaagaaaaagacttagggtcaaatatgagataaagattattttggaccacgaaatgagacagaaatataaagtagcaagcaatcttaaggcccctataatgtaaagggaactaaaagcgtcatggggatctagaaccaggttttccctgaaagcctgggcctagggtagtattaagctgccaaagataagtggccaaaactgttgccaacacactgactgcaattttgactttattttaaaatgggaacctagagagagtgggagggcatagacacagcctcttcactattaatcaaaccaaatcatcaacgattttagacatcactgtgggaagaagccccacaacacattattaagatgttgggaaaaaaaaccaaaaaacttttcttgtatcctcataggttctgtcaagggggcctgcaaattaaactaacaaaagctaggtaagagaaaaggtctaaaatttttattaatatttacatggataggaattcacagaaaacaagtgaaattcaagtggttagattcaggggcttatatgccttttaaaagggggcattaggcttcaagggatgattaactcatggggaagtggctagacaatatatgggggaattaatggaatagtcgggttatattagtaaggtttattcgtgcaaactcgtttcagcgttgactccccatttgcagtgataagagttgttcttcctttcttggtgccaggctagggagggagagccttcacaaaggaaaatttatgccctgcttttagacagataaggggaaagaagataactcttcctgcatcttctgcttctcaactgggcttcagctcgaaaatcatccttatgccaaagtagaatattttgcagtagattctcattgaagacctgataagaactagagtcctgaaggaacaggtgaagaaactgctaaaccactaaataggaaggacagtttatagatgaggagagagaagaaagtaaagccaacatgaatttacaaattcctattaaaaataagcctgaaaacccaaactcaaatcctgtaaaagattctaatgctaagaacaaaaaccaagtaagtcaataagtgaatcatgaattcacagaatttaaattaattttaaggaacaccaacaaaaactttgaaataagtatgtcaatgcttaaaatggaaactgacacactggcttttatcaaaatgaagcatcaatttatgacacaaaaagaaaaataattaaatataaaacaacagatttgaagaaaataactaatacataacaatagaaaacatatataatcatcaaaataaaaataactaaaaagataattcttactctgaagatgtcaaagcagtaattagtgatgataccaagaaattcatccacaaggtagaggaaaaagccatgaataagtaggtggaagatacaaaatataacaacagatgtcttataagcaccaaagaataaaatagaaagagaaacactatttgaaaaaattgtaggtgagcattgtgcagtatttgacactggtggccacagtaggcatacacgtttctgcaaggcatatagaatagcatcagaacaaagcctattcactgtctggatatagtaaaactgacaatatcaggagttttagggacaaagagaagcccctcaggaccaaatctaatcttatccatctagttgcaattgcttgaaattcctttaactagagacaaagcctttcaatctatagctagagataaagggcttaaaatgcaaataaccagggagaaaaaaaatgtgttcagtccatgttctgtttacttaaatggagtgttgaaaacagtgaggagacacagaggtgccattgagagtgatgcctctgaagagaaacgctggagtggcactgcctcaggcccaggctagcttgatccttggctccagagtttaaaaggcactgaccatagaggacactgctcttctttggctgtaccttaggataaggaattatgtagggaccgatatatatgcccacctcaagcccgcaccttccttcctcccatttaattgtgggaattccattcccaaaaggctgaacctgtttccagggcctttgtgaggcacagtctattccttagtgttccatccctagagtgacgtgtctacataccaagagctaggggtggccagggtgcagttcttgggatgggagaggaatgtactgcctacttctccctcagtggctccgccatgggattatgtgttaacgatgtaattggcacccacagtttaagaccaccagtgtggttcttgcctaaataatgaatttacttacaaattgcactgaaattattctctagctattaaatacatggatgcatttcttaatcaactagcatggaattcttcaagggcagggaatacgtctgctaaaattattcaactatcctcagtgtctatattgtacatgtagagtgtattcaaaaattaatgtcaaacaatttaaaaggaaagatactgacattctcattaactcaactcattatgtctaaagttgaagaaattgtcccgtcccaaaaactagatatttttctgttcctcataattgtttttatttgtttgcttctttgtttttgagacaggatcttactctgttgccctggctggaatgcagtggtgtgatcacggctcactgcagccttgagttcctaggcccaagcaatcttcccacctcagcctccccagtacctgggactataggcatgcatcaccatgcccagctaagttttgtattttattgtagagatggggtttcgccatattgctcaggctggtctcgaactcctggactcaagctatccacccaccttggcctcccaaagtgctgggattacaggcatgagccactgcacccagccatagtccctcataatttctattaaaaaaaaatcactaagccaggctcacttagcatcatttttggcttcattcccatctctcactccaagcatatagtagttactaagtcaatcatccaagtaataatatcaaagtaataataccaattaatgaagtcatactgttgatcctatttcatccctttttcccactttcatttccatttcaactggccccacctttctctaggtctctatttcttactcctagattacaatcatcacatctgagtcctaccgcttacagctgtgttaccctgggcaagtcacccgacctttccaatttcatgatctttataaataaaatatagataaaaatccaccaaatagaattgtgcaaaattaagtatgatttatttatgtttcttagtgcctgacaagaacacttttaggattacttgcatttgccatttttatatgaaagaggacatgggcaaatgaagacatataatatgtgaattatcatttttataattattatttaaaatcatcattaataacaaacttttgcttccccacttctctgagatcaacacagctttacaatgttattttctaccgaagagtcttgaatgcttccccagtaatgtctgaattctttaatctctgtaacaagtgaaaagttcttattcatattatcttaacactagaaatgagaagttcactcagtgaatgagggcattgtctctcccatgaaatgccttgacaaacctacccagggtcagtaagaaatcctgtgagcatggatggcaggcatacaatgttgcaaaatgccagggaccttgattcactgtgtgggaacccactcaggtccccagagttggtataagaaattaaattgaaggtatttgagattcaaccaatgcagaaaaaaacattgttggagctttcccaatttgactaaaagcagaaacttctgggaaatgaggctgccataaattccatcttctgggtggcttctactcccaggaagaagactaagagtacagctaccataaatcctctcttcaggagagtttcatggcatgaagaagaaggaaaaaccacacacacctcataaatgaacattatcacaaactttatctcccatttgttctcctcaaaaccaatttgtctttcctaaagaaacctacttgttattcccatagaagccttcccccactcccctactaagttgggtatattaggctttaactttaaccatttatccagctacctacttcttttgttagctcctttatgcatatgaataaaccttttttccttctgataatatcttttggcagtttattttatagaccccccagacactgaacataagagagtacaggaaaagttttccccccctcaacaacacaaaataccctaaggttggcaagcacccagaaaaccaggcaaaggactaaagagctttgccttagaccaggagacatatatattattttgctccaagacaaacaagaaagaagtgagaaaagagaaagggcagaaagaagacaacaaaggaaataggtgagatgtaatttcacgaagggaacaagtgtgatagccaacgaatattttaagaacagtgatgcctactctgctttctaattaatatttttattactttactatacatctcttttccaattcctttaaaatatttcaggaaaatactaaccttactgatggattttgtgcaaatctatactaaggatcattctgaaaggatggaatagagaacagataaaccaagaccttttgttgacaaggtctcttttgcttgaagggtgcgctaaatgcaatacgttgtgcccagcatcatttctctgaatttgcctgatgagcccttggtgttcactctaagcacatgtactgtatctcatgtaacattaaatattaatggtgttctcataaaacttgctctcttccttggccttgacaagtctagaacttgtgtttccaatttgttgagaccaaggaagagaacaagttttcatctggaaggcagaaggttttacagatgagaatcacatgcataacattttcaaaatgtacatacagtgagggtaaaaaccctcactgtcagctcagcataccaggatttggtcaagagaggcacacagacatatgtacattggcacatcccctgaagttatgctctcatttatttccacagagaactatgccctgggaagccatgcctgacagaataagacacagatgtttttgcacatgtgggtacttgtggcaaatcattatgtcacctaggagaagctactttctaaattaatggccatcaacaagcttaccaactctttattattgatcatatagactaagccattatgaaaattcaagaattaagttgaaagctcctggtattgagtgagagaaaatcttcatattggatgacttagtccattttgcattgctataaaggagtacctgagactgtgtaatttataaagaaaagaagtttatttgccaatgcaggctgtactaacatggcactcatatctgtttggcttctagtgaggcctcagtagacttacaatcgtggcagaagggagggggagctggtatgtcacacggtgagagagagagcaagagagaaaggaggaagtgtcgggctcttcttaaaaaccaggtctcatgtgaacttacagggtgagaactcactcaatgcaaggacaatgccaagctattcatgagggatctagtcccatgattcaaacacctcccactaagccccaactctaacaatgaggaccacatttcaacataagatttggatgggataaacatccaaaccatatcatttggagatggtatcataacggtttcaatatatatttttgaagctttaaaaacatatttttagccacagaacagtcctgcattgttacccatcagcagtgtagtaaggcaaatcttctttgtaggcagttgatgaggcagaagatatacagacactgggttgcattcaaccagcactacccatttgctaactgtaaggcacacagttttaaataatcttggtgtctctatatacaaaacagaaataagactattctcaggattgcaataatgacttaaaaatacattatagatgattggtatatatatgtaaacagttaataaattctattgcttactgttattgataatgccattattacaaaatatgtgtgtgtactaaattaaaaataatattctattaccttttgttttctaccgctccatggctcagacactgaaaaaaattattgtactctattcactattaactgttattttgtgtgtgtattttcagttgctttccttcatcttatatttttcttacttatataaattttggaaaaaaaatgtaagcactatgcatttttaaaagtataaataagagtttaatttactagaggtttttaaaaatctccttcctagtgataattaaggtgatgtgctatatcaaataatcaatggtctcattaaaaacaagaccccaatcttataaatagtctatgaagctgggtccttcagcgttataagggtgtgtgtatgtgaacttaatttcatataattggtaggtaaacaaagaaataagattttcagataaaacattgattccaattatctcattgttaattcaagaaactactatggaggctttaataccaatttttttaaaatacatggtcaaattagatcctcaaacgcatgtgtatgaacagatgacgcagaacatgcctattcaagacaacatggtttctgagtgacactgattaacaatcttgtgaaagctggcctttattctactcaacttaactgaaacaatggggcagaaatggtgtttttgccatatcacaaatatgaagttaattttcaaaacaaaagcaacccaaagttaatcagacatcagaaaatctatctgtctagtcttcatatataactgacaactcattaaaatgtttaaatacatactaatgaagtcaagttacgtagtgacttacagatttaaagggtacaaattcttcgatttgtttttaagaaaaaacttctaagaaaatggcattttccaaatccaattgttgcatttaagatttttttttattattgcttccagcttcttgtagaagcatttttacttacaaatttcttttattttcttttatttttatttattttttatttttgacggagtctctctctcaggctggagtgcaatggcaccatctcagctcactgcaaactccgcctcccaggttcaagcagttctcctgcctcagcctcctgcgtaactgggattagaggcacttgctaccatgaccagctaatttttgtatttttagtagaggtggggtttcaccatgttggtcaggctggtctcaaactcctgacttgaggtgatcctcccactgaagcctcccacagtgctgggattataggtgtgagccactgtgcccggcaatttatttactttctgttagattattagagtctgtaattgtaagttatgtaaccacaccatgaattaacaggcttgagggctttccctgaaagatgggcaaaaggtgggacagagcctgagttttccacaactgctactgccatgaagttcctgcccctttacacaagtggtccctcataaaaatttcccctgggtgaaaaaaaatggtcacttcaatagaaaagtcacagaggccaaaacagtgatagaagaaaagcatgactcatacttggccctgttgcttgaggcaccaagatatgacatttagtataagtaatttgtttattcttgcctgctatgattttaatgggtgggccttctagcataaaattcttctagcataaacttttcctcttcaatttgaaaagggagccataggctcccagtttttcttagatgaaggatatgactacctgtctggcacatggatggagtgtaaaagctatatggcactgctgagactgtcctcaggcttgcatgggggaacataccaaatgatcatttctttatacacagttgattagatgggggatgaacgcctaatctagttcctgatttctgacaaatccacccagatattgtacacagtgcgtagtgggcaatttggctgaaatctggtgcaaagtacaggactgagaacttcttttggagacatatataatgagcacatataaaggtgcagaggaaaggaaggggatggagatagaagaaacaaaaagtgacagatcagatataaaagactttctaaccaccaaataaagaaagattttacttctactcctgatattttccagttccgctttcatttcctacataatccatcacataaacagaaccaatgacaaaaagccacatgattatctcaatagatgcagaaagggctttcgataaaattcaacaccacttcatgctaaaaactctcaataacctaggtattgatggaacgtatctcaaaataataagagcagtttatgataaacctacagtcaatatcacactgaatgggcaaaagctggaaccattccctttgaaaaccagtagaagacaaggatgccctctctcaccactcctattcaacacagtattggaagttctggccagggcaatcaggcaagagaaagaaataaagggtattcaattaggaaaagaggaagtcaaattgtccctgtttgcagatgacatgattgtatatttagaaaaccccatcgtctcagcccaaaatctccttaagctgataagcaaattcagcaaagtctcaggatacaaaaatcaatgtgcaaaaatcacaagcattcttatacaccaataacagacaaaccaagagacaaatcatgagtgaactctcattcacaactgctacaaagagaataaaatacctaggaatacaaattacaaggggtgtgaaggacctcctcaaggagaactataaaccactgctcaaggaaatgagaggacacaatcaaatggaaaaacattccatgctcatggagaggaagaatcaatatggtgaaaatggccatagagcccaaagtttacagattcagtgcgatcctcatcaagctaccattgactttcttcatagaaaaaaaaattgttaaatttcatatggaactaaaaaagagtaagtatagccaagaaaacattaagcatgaagaacaaagctggaggcatcatgctacctgacttcaaactatactacagggctacagtaaccaaaacagcatggtactggtaccaacacagatatatagaccaatggaacagaacagaggcctcagaaataatgccacacatctacaaccatctgatctttgacaaacctgacaaaaacaagaaatggggaaaggattccttatttaataaatgttgttgggaaaactggctagccatatgcagaaaactgaaactggattccttccttacaccttttacaaaaattagctcaagatggaaatcatcattctcagtaaactatcgcaagaacaaaaaaccaaacaccgcatgttctcactcataggtgggaattgaacaatgagaacacatggacacaggaaggggaacatcacactctggggactgttgtggggtggggggaggggggagggatagctttaggagatatacctaatgctaaatgacgagttaatggctgcagcacaccagcatggcacatgtatacatatgtaactaacctgcacattgtgcacatgtaccctaaaacttgaagtataataataataaaattaaattaaattaaattaaattaaattaagttacattaaatttaaaagatggattaaagaccgaaatataaaatctaaaaccataaaaaccctagaagaaaacctaggcaataccattcaggacataggcatggacaaagacttcatgactaaaacaccaaaagcaatggcaacaaaacccaaaattgacaaatgggatctaattaaactaaagaacttctgcacagcaaaagaaactatcaccaatgaacaggtgacctacagaataggagaatttttttgtaatctatccatctgacaaagggctaatatccagaaactacaaggaacttaaacaaatttataagaaataagcaaacaaccccatcaaaaagtgggcaaaggataagaacagacacttctcaaaagaagacatttatgtggctaacaagcatatgaaaaaaagctcatcatccctggtcattacagtaatataaatcaaaatcacaatgagatactatctcatgccagttagaatggcaatcattaaaaagtcaggaaacaacagattctggagaggatgtggagaaataggaacacttttacactgttggtgggaatgtaaattagttcaaccattgtggatgacagtgtgacaattcctcaagtatcaagaactggaaataccatttgacccagcaatcccattactgggtatatacccaaaggatgataaatcattctactatagacacatgcacatgtatatttattgtggcactgtttacaatagcaaagacttgaaaccaacccaaatggccatcaatgatagactggataaagaaaatgtggcacatatacaccatggaatactatgcagccataaaaaaggatgagttcatgtcctttgcagggacatggatgaagctggaaaccatcattctcagcaaactaacacagtaacagaaaaccgaacactgcatgttctcactcataagtgggagttgaacaatgagaacacatggacgcagggaggggaacatcacacaccagggcctgtcaggggttggggggctaggggagggatagcattaggagaaatacctaatgtagatgagggattgatgggttcagcaaaccaccatggcacgtgtgtacctatgtaacaaacctgcacgttctgcacatgcaacctagaacttaaagtataataaaaaaaagaaaattgtatttttaaaatctgaaaaaaaaagaatcatcctttatttgagctcactgcaatggttttctacacagaagtcttctactgagaaccacagaaaacatctgtattgaatgctatgtctgtatatgggggaacttggaaaagaaaatttcaagcttttcaatctccaatgattaataaaaataaaactgtaattttatatatctaccaaaagatcatgttaaaaattcttgccatcgctttctgacccttggtttcaggtaactatatgttgcaaataatttgagtatatacatcagatggtaatacattataaagtgaattttccatttttgtttgtttgtttgttttgagacagagtctccatctattgccctgtctgaagtgcagtgtcacaatcttggctcactgcaacctccgcctcttggattccagagattctcctgcctcagcctcccaagtagctgggactccaggcgagcaccaccacacacagctagcttgttttttgttttttgtttttgttttttttttttgtatttttagtagaaacagggtatcaccacattggccaggctggtctcaaactcctgacctcatgatctgcccacctcagcctcccaaagtgctgggattacaggcatgagccaccgcacctggccaattttacatgtttttaatgtcaaatatttcacacatacattctggaataattaatatattcacatatgcaaagataagatataaaaatatacaccatgaaaagtgacccttcactgttgtctcctctatcttaagttttcttgggtagccttgtgtctataattttttaatgcatacacaagaaaaattttacttttttatgcaaattataatatatatggttttacatcaactttcttcccagtactgttccatcttagagatatttccccatcagtatttaaagatctttaatatttttaaaacttacagtattctattgcatgaatacgctgtaacttatttatcagttactacctagtttttcttgatggacatttaggttgtttccattactttgctattataaacagtagtgcagttaataagcttttagacacattgtttcatgtatgtaatttccaagaggtggaattgatggttttatataataattgtataggagtgtctatttccttgtaccctcgtcaacaatttgtcagtgtgatagataaaatggtaggtcagggagtgttgagttacacttcttttattatgtgtgaagttgagcatctcttcaaaagtttagaagtcattttaatttccttttttgtgaaatatattattttatcttagtgaatggatccaactccattacagaggatatcccagttatatcaatgccatgtaagaaataacttgtcttttctacactgatttcaaatgctactttttaaatattctaaatctctgtatgcatttgtgtctgtttctgtttttttaatctgttctgttaatatatgttttcatgatctaatgctatattattttaattcatgaggcttaatgatatgttaggtttataacaaaataatttaacttttgttgttcttataaatatggtctttccttactacatcttctgatgggttactgtttgcatatataaaagctgttgatctgtgtacaataattttgagccccaatcttactaaagtttttctctaacagtttcaccaagaacagtctccaaaaaacaatctttcctgagttctgagaaattacttgtagattctatatttgaagaaaatcttagctgaatatcaaatacttggctcacactttatttctctaaatatcttgtaagtttggtttcagtgttttctgttacagaatgatgctgtgaggagtgtaaagccagtctaatattttctcttcagtatgacttgatcattttccctatatgtccaaggaagttttattttgtaaaatacaaaagttttcctaggatatttctgtctaaagcatcccagggcaagtcttttcaaagtacaatttcaaacatttcatttcacacaaaaatattttttgtattatagtttcaaatacatattctgttccagtgcagtgcagaatcctcctgaagtactccaattatgcatatgttgaatctgctttgattgtttcctttggttattattttctctccctattctttacttttatctgtatcttctttttattttttttttcattttcctcctttccatatcagatgtcctctacagggctttgctatctttattcattcttatgctcctcccattgtgtctttattttagtgattatgttgtttgaacgcacatcttcttttatattttgtcaactcactttctatttcctattttttcttattttgttctgaggcttatgctttatggttttcaaaacactcatggtaatacaagattaagttttcttcttttaaataaaattcaaaatgttttgttattttctttatgttccattgcaattttttttggaaagtatgcttatctcttggtaaattaattgcctcttttccataaattttctgtagtatttttcttttaatgccatgagaatatcttattactcatcatgtaatgagctaactttgcttaattggttatttgcaggatgttcctgcagaggtggttatggtgagggacagagttctctcctttcttgctgccacagggataggacactacttgcaaatatggcttatttgtactggattacttgagtagtttcacctactctgtttttctgaacaaaatcaagttcagaaagctcttggttgctgttgtttcttcccctcaccagcattgctcatctcagttcccatacccatccatttaaagaagaacaaagtgcccttgtatctgataccattcctgggtttcccaagactctaaaatacttatttgcactttctcacctgtagttattgcctgatttcatcagctctggaagctcctaaattacatcagaatataccacttgtatttgttttctgatttcctaaaaaaatgcattttttgatatggctgttgactttaaggagaaatgggaactagcttactagaaaatataagtttaaatattttggtgtcctttccaccaataaaaatttaaatacacatatattcttaaattttaacatttatacattttcttataagtaatcttatatttggtggcccaaagtgatggggagatgagtacagagccaaatgtctatctgattagaaatgaaagataaattctcttgggttgaaataacatgtaggagatcatgaagaaaacaataataagaacaataacagaaccagtataatatacagtttttattctaatgtaataaatatttatccagcgtgagtgttttactaaaagcagacaactttaaatccaaaatcacatatgtttttgaagggaaatatatatacaatgtataataaaataatattgagcataatttcattcaaaaatattttatctttataatttctctgaatgagctaaaaagattatctctaattactgacttgttatcaaaccatattatatctgcatagtatctttgtataattgtataacttctgagaaaacagatatataaaattacttcatatttgaagtttttcctaataaaatattaagatcactaaactgtcaaggctgtatgataaccaaaattatgtccaaaaaggagctactaaaataaaaagttactaactgcagagtctcttctagtttttcccaactcatacatctgatattttgccaattactgatgactcaactctgccctttctctctcatccatcttcttaaattcattcctgctgctactaccaaatcagattttcattaactttcaccttggctacagccttacagaaacacagaaagttattattgaaaggaaccttgtagtcataataagcctactgaatgtcaagtctggatttaagtgcaagcattattaggtgatagtttgagtcaattgtcatagttttggtctggcaatcagaaaaccatactgatagcctcactataatcatggtaaggaatctagatagtgagactaaatatggattcaatcaagcagtcatcatctagaacatctaaccttagaaagtatgactatggaaatcactctggggcttagagtaaatgtctaagacattataagcaaactgacttaaaactaaggtaaaagtggacccagtcaggtagaccgtgttacttacaggcaatttggtgtttgtggatcatctcaatagatactatgtcatgtgtttgataggaagctaaatacttggggaataaacctggatttcctgttatatgattatggttaaaattagtattttgacaatgaggtttagaaatagttactaaaagaaaacactttattaaaaaaaaagagaaatcaagtaaaagtggaatcagaactaggaaagacactgatttctcctataaagacacgcagttttattcactattgaaaggtaagaatacattataataatagctaacacatgttaagcatttgttttatgccaggcattattctaagcattttcgctgtgtgaaatcatttaatcctctcagtcctgtgaggcaaattatatgattattcataattaactttaaaaaaatagaacaaagaattgttaagtaactttttaatcataatcacttggaatggaagactcttagaaactatgtataagcatacggctactgttacctcatttcagtcagagaagattccccttagaagatcctctatagaccctcagtgtcctatattgaatctaaattcgtattatatttgtagtaagtacacccagatcttaattttgttttacatatgttatatctacataattagtaagaagaacaaatctctatatgtcctttgatgttaagcatgttaggctacattaatatttaacatctaagcaaggagctctaaaaaactcctaaatcaagaaggtttatattttcctatgtttgcctacatattgcagtgtaattgaggaagcaatttttagtctttaattaattggaactgtaattattcagcctagagaagtaaatactaaaaatcaatttaataaagattttcagctacataaggagctctcaaggtgatcatgactatttccatttaaaaactggatttatctgatagcacaaaagatgagtgaaatattcctgacagtgagggttagcaaattttagaaaataaaaaggttgtagaaattctttttataaatgcgtttttaaatcttgttcatatttatcatcctacttatgatactatctgtacatgaataagttacttaaaatatgtttctttttctatcttgaatgattttgtggttggaaataacaattagtttgcttaaatctgctcatactacaattaatcatgtatttctctttgataataaaataatattttttcttcacattttagtgaagtcaaaacttggaaaacataaaatcttactggaactgtgttattgtcagaagaataccactgtgtttaacttaaatgataattaagactcgcatatttgaaagtttaatataagaaagggaagtaggaagttccaaaaagtaatgatgaaagacactcttatttttaagccatgaccattcctggaagaaaacagaaactgggacacaggcgaaacactgaggttccatagttggcaaagatttgtatgcctggatagattagaattcaatgtattacctcctgttcttattaacagccccccttgctatagcctcttaaaaggtttcccaactctactctgccatccaccgaggccgacagagtaattctttttccaaatgcaaatctgatcatttcacttcccaacctagctatctaccatctcctgccactgcttcttttctttgttctctcaaaactcagcttgcaggatccctcctccctccacttaggggatgttcccttagaatgcaccctcatagccccttacatttctgcttttcaaagtgtttcattatgtgatgtgttgtactgaatgtctgtctcccaaaggctaggagctcctctagaacaaggactctatcctctttactgtcatatttcaagtgcagctctttccctggcatagaacaggttctccattactccagtagaaaaaggagcaaaactgctaagaacaatgtttcctcttctaatcttgtaatgtattcaatcattcaacaaaacatttagtgaagatttagttttatgctaagacctaaggcaacaatggtcaaaagagatacctaaaccttgctccaattcagtttctaagttattaacaattacgcacacaatttgaaattttcaaattttaaaaaagacatgtttttcccatagattttagtttatgatggtgattatattttcctaaattctgttgatctggagaggagcttgctcataattacaacacccaacttcacaaaagggcattttagaggcaagttaaacaaacagatagaaacatctcataaaccacaaaagaaggaattagtagtccctagggcataactctaatatagattattccaagtttattttcacattctttatcattcctattatgaatattatcagtttacttgttccttgaaaaaaatttaaatcttatctgtttccacagtgaataattcaaggtgtgtatacacacacacacacacacacaggagagcttaaatattagtacttaagatagtaccattcccttcattatattctattatttgtcatataacatgtcacctaactaaaaattgttcaatcataaaatgatagattattcaaatgtctagccacaatagctgcagtgaaaagccttagctctgagtatttgatgagtgttcaattaagacctcaaaccttgtttctctttgggcaccgttattttaagtagctataatttattcatctttatacataaaacatgtacaattttaatagttgtatatgatacaaaatttgaacatttaaggatatgttacaccacattaagtttaacccacatttatgtcttggatgatagatgcaagaattccaactgaggcgattttatgaaccagctaaatgatttgtattcagaacagcattaaaaatccccatgacaaagtgtacttgaacaaaaataccctgcttgtgacacatcctttacaagtaatgtgttttcatttttcacatgttgcatctcatttattttattcaggcacacatacctaaatcggcaagatactgcaagcttccaatacctttgaaataataaatcacttcttgcagatgttttcacccgctgcaaggctgccgttcattaatcaaacattatcattttctatcagtgcccagtgttaaacagaaaaggcacttcattttgagttctgactttcatctttcattcactggttacaccctgaccccacaaaacttactgcttccattctggaaatgtgaaacctcctacagcgtaatagattttgcagcaaaaaatcctaaatggtattatattttctgaattcaatatgctttatcaggagctaaatcaaaccagattttaaaaatgccaaataaatgcagtcataataggcatttaaaattaggtacacaataataataaatttataacataagctctttttctatgaatatatttaatatctaacacatcaaattgctagaacaaagattcagagatatattttttaatttagcttaagctattaaaatcatttcagaagccaaagaaaggcaatttatctacctactataatttttaagcccacaaaaagaaaatggaacaaagtgagagacaactgtaaaatctttctcatttttttttattctctaagtaaataaataatagagaatgatcaatttataatacaagaaatcaagatgatcttacggatcatgagtcactatattcattctataaatagtcatataacctaaaaaaaggacaactgatttaatctagattgctttactgccttaaaaacagctcaagagtacagatgctgcaaaagagaattttagaaatcactttcattttctcttaaaaaattctcatgttattcatcctctttgactaacatctcctaacctataagaacataaagctaacattcacttaaaatctgacctgataatgaattcataaactagaaatggccacgcaattgaataaaaaggaaatagtttataaatattctgtttcatcattatgaattggtatcattactgattattcacaatctgtctcccattaaggtatagtgctaataactttacacatggatatggcccccttcccagtaaatttataataaacattatgtgaatttgtgcaggagaattttccagaaaaagatctgaagaattcagagtaaataagaaaagctaaaagcaaagcatattatcaagatttcattcaggtctcaacaaaacccacataattttaatttgagggcggaagggtgagggacatttctattgcagtattttatatggtgaagatcctgagcatggtaggcctaaggcagtttcctatgatatcaatcaagaaactcagatgctttttcactgtctctaggataaatctaaactctgtaaacttcttaacctcgggtatatgacccataattgtttatttgtctcctaccctcatgtcctatctactgttatttactctctgcctccctcagcatgcttcctaggcatatgccatcccataagtatcacagttttccaaatcgccctcttctttcaagtctccgtgttatggtggacaccactttatctgccagtgatgatcctgcttcaatttttctatctaacatactcccacccctccagattaaagactcaaccccctagatggtcatttatctatcttctctgtcctccctttgtacgtcactacaataatatttttccccttaaacacctatgagcatctctgggaagagagtatgcctaaattctttaccgaaggacaagtatagtgcatggacaaataatacctttcaaaaatctgacaaatcattaaatgaaagaatggaatcaggtaaaagtggcctttcatagtcagaatttcagtttgtttctttctcctttttttttttttttttattttgagacagtctttctctgttgccaggctggagtgcagtggtgccatctcagctcactgcaacctccgactcccgggttcaagcgattctcctgcctcagcctcccgagtagctgggattacaggcacgtgccaacacgtccagctcatttttgtatttttagtagagacagggtttcaccatgttggccaggatggtctctgtctcctgacctcgtgatctgcccgcctcggcctcccaaagtgctgggattacaggtgtgagacaccacgcccagccaaaatgtcaatttcttagttgtcttatattctgttgtctttgtattctcatgataatttttcttgtctttttatattttcatgagaccagtgtcccccttttccttctcttctattctccctaccttctcctctcacctttttatagggaagggtctgcaatatttttgtactaagtgttaaatgagtaataacgataaaattctatccttccagacacacatacataaacacacacacacatttaacaaaggataaacataaggtatggtccttatacgaaataataaggctttaattatgaaactgtgagtatagactgaagagtgatggagaaaaatcagaatcagatctctgttgaagtctgaactttgtatctagcagtgatcaatattgtgcgtgtgctctccatacatgtgcacaataacttatcaaggtgtctctacagtttataacccccaccttatcttagccaacccaacaatctcaaaaattaacgagttaagtaaagatgccattcacagaattgcacagggccaaatagattacagaatatgtagctataaatatacactgtcctgcttccataacgcatttgaaataatctaatatgatggatagataattacaatgattgagcactgaaattaaccctgagattttttgcattgaagtaaaatgaaattattagaaatcaatatctgatgaaagaaagcttactgactcattaggagccaaactattttcctatcactaaattctttaaggaattctatgacatcagccaatatataaagatttactgaccaatataatataatttttatagtgatttcacaaaagatacaagatttcattatgggaccctttaatattcataaaagttcagggagttataataaagtaatatatatttccatatattttcacgattatgtgaggtattctattgtatataatctttctgtatagaatctccaatacatattatttgacataagcagcaaaagcataccaatagaaagaataatttgatcactacattgttctatttgtcagaaatgtcctttataaaaataaagacatactattaaatggtaaataataattaaaaataacgtgaaaatagtcaataaaaatgactatggtattagtctgctttcatgctgccgataaacatatacctgagactgggtaatttataaagaaaaatggaatcgcagttccatgtggactgagctcgcagttccatgtggctggggaggcctcacaatcagcagcagatgaaaagtatgtcttacatggtggtggcaagagagaatgagaacaaagagaaaagggtttcccttataaaaccatcagatcttgtgagacttattcataaccacaagaacagtatggggaaaccgcctccatgattcaattatctcccaccccgtccctctcacaacatgtaggaattatgggaactacaattcaagatgaggtttgggtgaggacacagccaaaccatatcagctaccacaacagaaatagttttctaactgttgtgacctacttgaatatacacaagcatacttgacccttgcatttcctaagaaaaaaactttggcaattaatttagtgaagaggaattctgaaaatgaacaaaatcctctgggatcccacaatgaagtgtcatggatctgatttttaaaattactgcacagctcacacaaaagtatgtacatctttttccttagaggctaagacatggtctcttgaagcttagctctcctactctgttaagcctcaaatagagcgagacacatttgtgactgctgtttcagctctcagaagatgctttttgcaagttccttccactgctgcctgctgaaatacatccagcttcccagatccaaagtaatagaagtaatttcctatggagttaaatttgttttgttttgctttgcttttgcttaaacaagttgatttctaaaattcagcttggacaaggaaattaaaattttggtgacaacaataaaagttaaaatacttaaaaacagtctttttatagcagaagcaatcaaattagaataacaagcataggaatacacaaagcactgctgcagaagactctgcctccaccccgccccaaccaagggaaacaaaaactttaaaaactgtacacatttgatataaatttgaatgaactcatgttagcttgtgttgtgagccagttaacagaaatattgacgttaaaggttctttttgagtcatttagctttcactgttttgggagaaatcaggatgaaaagggttagcatgcctaggaaactaaaaagaaggacacactttactttttactttttaataatataactgctaaagaacatcattatttattacgtagaaataaaggcttagaagacaagagtgacttttcaaaatacctacatttcctgagctctaattttgtcatatttccatttttatttgtaaatctaaatgtaccattttccagtaactagcaatcttataattcacaacaacacatcttatgcaacaaataaccaagccaaactgtcatattctacctacggagcagttgttctggcagcccagcaagaagaaggagaataatgttctccacttgtagcatgcagaaattcactaatccccttcttttcacggaagatctttctgtcttgtgtcctctggtctagacattgggtttatcctctttactgaacaacagaattctcaagctactcaagatgaatgagggaatcaaggggtctagctactttttttaatacactcttcataaattccctattttttggccttgtcttcactcttatttccacagctacctggtactaccaatcttgaaaccttaagtaggttcagtagtacacattatgatacttctccagtctggttaaggatttagctttcttgggtctgctaagtccaacctcatgtagccatctgcttttcaacttccaaaatgttgtcatttctgctcctttctattctttttttccttctgggcttatgatttttgacaaatcctgttgctttcatttttgtgacaatccaggacaggatatagagatacacttgcatttggtctgccatttttaaatgaaatcctcattaaactaattttataaagaagaatttccatcgataaattgtatcatactttgtctcaatgcttaggaattttttatttttttttttttcaaaagactgactggatctatgagatctatttccaggtgtgactttgcttactataaatggtcaatattccaagaatgaacttgggcttgattcaaaactcaactgcaatttcttaactctgctgcatgattgtattttttttttttttttttttggatgcagtttcactttgtagcccaggctggagtgcagcagcatgatctcagctcaccacaacctctatctaccaggttcaagcgattctcctgccttagcctccacagtagctgggattacaggtgcaagccactgcacccagctaatattttgtatttttagtagagatggggtttcaccacgttggccaggctcgccttgaactctcaacctcaggtaatccacccacctcggcctcctaaagtgctaggattacaggcatgagccactgtgcccagcctgtattctttaggaccttcactgttcaattagcctgccagtaagcaaggattagggaaaacaaaatgagttatgactttctgtagatatttattcactaaaaattataaagaatattaaaatttgtatttttaaattaaatttccaaattctaaaacatgcagtcttgcccatcagctgcctcactcttatgacttataaagttgtcaatattttttatgggcaaatgtaatataaagcaaattattttttgacattgttgaatgatctcctctcaatcagtgaaaacacattctcttgccattactgactaagcaactggttttatttttaatacattgtgtgtaaatgaacaaccatccatcttcttgtagtcataaatatatctgataaaagatgattccctaacaaaggaaccacgggcgtctagaaataacagtttatgctgcaatttttatcttaataacggtatcagaaaactgataattcaacatcaataacgtgttccaattagaaatatatttattatataactagcagaaaatgttgaagactggtagtttctgaaattcttctcagagaccatgcactagaaacaatggaaccacagatttgctaattagaattattcctgaataatcattaaagcaaacagcagcttttgcgtttgaatttcacatgaaaattcaaacacttttgagaccaatagatagttgaaatagacctataggaacacaactactgaaattaaaaggtattcagttgcttgtttctgttcatgagtactagttttattctacagatagtacctacagtttgcagcaaataagccaaaacaacaagaaaatatcttgtttggttatactagaattcaatggctgttaatgctctattacacacttaaattagttttatgttttagttttataaattagtcttctctgcatatctaaatatatatttcctaatgaggtttaatattcaaggagataaatatgagaaaatgctttgaaaccaattataggaataatcttacataatctgcaaatgctgatcaaaatacatcatttctacaatgtcaatactgggaaaatatagctttattaggttgaaaataattattttgacttttatgataatggttagatttgattatatgtacatagggataaatacaacattgaaaacactaagccacataaatttaaaacatcgtgtaattcgaacagcttcttactagtggtttattttttaatgttctcattaaagttcctgatattaaattataaggaaaaaagacctaagaatttagacttaaataataattaattacttcagcatttgcccaagttcaatctctaatcatcactctcctgcactgtataacctctgtccagcccatctccacatgtccagtctcatcacttttaaattcatcatctacccagaaagcctacactgcataaaaccttttcatcacttttcgtattcagtagaataaatgcccaacttttctaacctactaacaagccctctatgactgtatgacttgcttcttgccttacacttcagcctaaagactaaaaaattggactgtcacagatccagaaacactagaggtttataatgctagttcactgaacacctggctctctggaaccatctttcagaaaaaaaccttctccctctaacttctcttttcctgttaactcctaatcatctttgcaactcagtaaagacaccacttcttctaggaagttttctatggctccctccctgacccaatacacatcctcacacttaaaagtcatcccaggaatgttggacctacccattgtgcgcccacaactctctgggaatctctctatcactacttatgttattaccatattttgttgtaattatgttactttacacccaatgaatctctgatctttgtgaagtcaagaaaaatgttttccccttcattgaatgcgtaataacaggtacctagacagaccatagtaaatgctggtagaatgaatatataaatttgatataattacatatgtccaaccaggctgcttataaattggcagtctggaaattcaagggaaagctttcaatgataatttttagattataaatacagtctgtacatttgtataagagtggtatcagctcaacatattcagtgatggatattatttgattatctgtattgctctgaacagttacagtttaaaaatatcaatccataatggggagtattttccatgccatgtatattgaactattgttctttaatacatggctaattaagtctttaacagaaatcagtactcacttcttccttcaactaaagttgaaagcttagcttaaaatgaattacttcattcctcaaaacagcaagttaaatttttcaacttgctattttattcatgtaatgctgtgaagtttacctgaaatttttaaaagtgcacatagtataagaactcaaaagtttttgaatgaatgctaaattacattgcccttcatcgagtcatacatacattttcttgctttcttttgtttcttcacattcaccttcatttcttcaatttccaccttactgtatatgagtattgtatattcatatggtcatctgattttgaaataaacccagtgcacatagcataatatgcttacaggtgaattcatcttcaactttcaactcagaaaatgccctatattctttccaatagtaatactctgtaatggcatggtggttggttctatcactatatttaagcaaaataaaagtagctgctaaggactaacaatttgctaaaatgctactgttcttgtatttaacaactaatatgcttgtcacaataatttactaatggggttatttaatgacctgataggattaacttcttttcaaagcaattaattacaacctgagtattatttatagctggataaaactggctcaaaccagctttgtgtgtttgttgattttatttatatatgcttgaaggggtgataattttgtaggtttcctagaatatccatttgataaataatcactaatttcattgtaaaaagtacaaaatatattacttttatcttaattataaacaataaaactaatgttcaataaaggtatcatccctagttgttccctctgttaaaataaaatgctttatttattctttgcttccttccaccccataaatgtaaactagtattaagacccatcataaatgtaaaattaattaacaatgtaatgtcccttgtatatacttctctactatgtcatacagtttcttcacactacttatcactttctgttctgtgtgttcctggagaggactcaaggttctttctctctctctcttcacccctccccaccaacctttagattctagtaaagccttcctactcaaaggagtaaataaaaccttactacttcactaagaagaggctaaagcaaagtgaactcacttggctgacatgttccaccttagaactttttctgtcttcactatttttgtgtcaatgggaaaaaaaatatcctttcaactttcaaaagcgaacatttctgcctatgttcttcttttctggtctcttcctgttttgctcactccccgcttaaatttaattatcatctcaaacatctgttttctactcacttctttatcttgccataaaatgtgtttatatttctatattaggaaaacaaaacccaactgacaaactctcacctcttcttctcccttaagccactgtatcatgatttacctctccataattattgtatgaggtaccatggaagtttgagaaaaccacaggtttgggtttctggttctgtcctattacatattagaggagaaataatttagcataatgccagttatgtttaaaaatatatgctcatttgatttaacatatagcatatatgtaggtatacatattagagttgtaatgaactcattattacaaattcatttgaagagggtaaacataaatcccaagatcaaagacttgcctacagtgttctctccacctccttccccctcattttcttgtgtgtataccaattagcctacaatggtagagaccatatgttcaattattcggcattatggaaacatatagaatcgaggaggactgatgttatgtttccataatgcataatgcatattttcctcccctactttaggagaatacaatatttaactgtgactatgggaaaaagttaattttagagacccatctagttgatacttgccaaaataagataatttttaaatgtgttaagacatatactacgctttgataaaataaaaaaaatatatagaaatccaggaacaaagctctatggaagaagcaaacttaaagtcaatcaaattacaataaatattgaaatttctcttgcagaataactttattggttagtaagaaaaagggaatgaatttacatatcacttttatgatgaacatgcatctatgaaataaatcttcatcagcttttgtaaaacaagctatatgttaattaatgttaaggaaatttgctttttaaaactccccaatctaatatttttaagtaaaagattttcttctcccattcatctctttttaaatatgtatatacatacatacacacgtgtatatacacatatacacacataatatcaagttttattttaaaaagtatatattttcacacataggaaatatttagtatttccaagtcaactttttttttttttttttttttttttacggagtctcgctccgtcgcccaggctggagtgcagtggcatgatcccggctccagctcactgcaacctccgcctcccaggttcacgccattctcctgtctcaatctccctagtagctgggactacaggcaccagccaccacatccggctaattttttgtatttttagtagagatggggtttcaccatgttagccaggatggtctctcgatctcctgacctcatgatccacccgcctcggcctcccaaaatgctgggattacaggtgtcagccaccgcacctggccccaagtcaactctttagcaggctcaatagtattcatgaataccagctgtgtacatcaaacagctgatattaaaacacagtgctcactttgggaggctgaggcgggcaaatgacgaggtccagagatcgagaccatcctggccaacatggagaaactccatctctactaaaaatacaaaaaaattagccaggcgtggtggcacgtgcctgtaatcccagctattcgggaagctgaggcaggagaatggctggaatccaggaggcagagtttgcagtgagctgagatcgcaccactgcactccagcctgggcgacagatcgagactctgtctcaaaacaaaaacaaaaacaaaaaagagtgctaacaaaagttagtcatcatgtggactaacctttttttgccctattatcatgaaaatccctctagccacacagattcatctaatatatgatctggtgaaaataaggatggggcaatggcaacaccaaaacacactatgaataaatcatgttgaaataatattcttagatacggaattagagcctattcatttcagtgtgtgtgaatatcacactctgtggaattggtagtcacacagtttcactgggctataattttttctcgttctgcatagggtggttatgaaaactaaatatgtaatctcgtcaatgccatggcatcttactgtgtgccaatttcagtgaaaaggtagtttatattatttctattactcccaacaatcatgaactataacatactgattgcatttaactagcttcaagattcatactagcaaatagcgaggagatactgccactagcatcatttgccacagccaaggataccaaatctacctctcctgcccacacttctcatattatttccccagaactaatcaggtacacctaagagcttcctggatatttccaccaggttgtcacaaggaatctcaaacgtaagaagtcaggaaagatctcataatctccccttattttattttattgggtaattgtcaccaccatccatttatttggtcaaaagaagtgttgaaaacatcccgacttgtacctatttcttagatctttaccctgccttctccttctgactcctgtccttcactaacagtatctaatcagtaaccaagactcattcattgtatttccttatgtttgtttcctgctctcagctcttgcagccctacctttggtcctcaattttctcttgcttgaattattccaatagccacaatgtaaaaatcacccagtgctggtcttgctcttctccaaaccattttcacagtgcgaccaaacctatctcactaatctcttacctctcacatcaaaatccttcattttccacagcacaaagtaaacactcaataactacagataactaaacacatttgcattgccatgtgaagtctcctgaatctggtcctggtttgtgtttgtccctatttgtcagcacacgtctctggaagtgaaaactctagcaagaatatagagctgttacatatgacattccctgtatctgggtgcactcctaatccctgccccagcatgtctcctgaattatccttttcctacagaggcttatagtctaggatgaatgaatagaaatatatacatgtaagtgagcaaaattttttggatgctcttatattgtgttatatattgtgggaaaaaaggaatagtcaaagtcacagattagaaaatatttacatgtctgtctcccccaaaactgtaagcctcttgataacaaggtcacattaatcacagatcaggaacttggtatttactgaatgagtaaatgaagttatataagcattaatgtgggtgaaatccttagcattattaaaattatgagaatgaagataatttattttattactactttaagcacatgactgttgatattttatcaatgataaagttggattctaaggaaacttataaatattagatttttcaaataggattttaaggtcatgagggcatatatatgtgtgtgtatgtgcatatatatgtgtgtatgtgtgtgtatatatatatagctataggtataaaactattcaaaacatatatatgtgtgtgtgtacatatatatgtatagctatgagtttagtactttaaactatagcttaaagtactatttcaaatagtattttaaggttgtgagggcataattaagtaaaacacacacaaatatacatgcatatattgtatatctacataatatatatataactatacattagttttataccttgggtataaaaactataagtcaaaagttttcttagtcactgccttattttgcttcctcttattagaggtcttagtagtccaaaacctttaacctctttagggaattttgcttctcatataactcgttgattttaggctgctttctgatcctacagaaacaagggtcttcgagtgaaaataactttaagataatgctgcctttatgaattttagtttttccttactctgccacctcaagcttccagttttcagaaaaaatgactataagttgtaaaaggctggaagctagaacacatgcacgcacacacacatacacaggggaaaagagagcatacttaaatatagtggaaagcagttgcagaaaaacataagattgctttaccactaaaagtctaacacatttcggtctctaccactgtaacagaaaacctcacagatggatcaatcactagagattaatactctgtcttttctaagccccatatgatctcgtattatcacccagaatgtttctgtcagaaattctagtaatatagctaccaaaaccacattagaatgggaaaaaaggcacaaacataacattgattcaacttgccctagagtactccattaaccaaatatttctacagtcaacaggagaggaaaacaaacatgcacacaaaatcccaataatgtatttacttgactgtgccagagtggtttgctttagaaaataatttgagtccatatacttaaaatgtttatattttagtaattacaaatagacattaatataataagtgatcatgcctcccataaaataacaatagtatttttcattatcaatcttttttcacattgttgtttttatttttgctttttctttttgtgtttttctaagtatcacaaaggccaatctgaatccagtttaaggcaaaaggaataaaaaattgaattagtcagtcttgaatttaataaatttttacaatagatcaaacagattttgaactaacatgttttgatccaccacaaaagaatgcatttctacctaatcacattatcttctaaatgaagaaaaatcacaaattctattcaatatccaggtatttttcttattcagtattcagatgagtctatctttaattaatttatcagtaatacttttcctatggtttttaacaaattttgctacataacaaatgtgtacttatttgttattcatagcaagatgatgaatatgcttgcataaaaagttaaggacatcttctaaaataattccactgtactgccctgagcaccttgaataaaaggaactatgctctggatggctttttgttatttcctggctgaagtcaataggtgctaattgttagaattcatcatgaagaatccagaggcagaacaataaagtgaaaaggaaaagttaaagaggttttatagaagtcctagcctagaggctaagataaatttttttgtatatgtatattttcttttttcttaagttatcaaaaattgatgtgaaaaataaaaccattcattaatagtgtttaagatatactttcagaaccatcagtcacttcacagaaactaatttcagttctcatttattccttctgtgatttattttattttattttattttcagaaccagaatctcactctgtcacctaggctggagttcagtggcacaatcacggctcattgcagccttgacctcctgggctcaagtgattctcccacttcagcctattgaataggtacatcccactctgcatggcgaattttttctttttgtagagataaggtcttgctatgttgcccaggctggtctggaactcttggcctcaggcgatcctcctgcctcaccctcccaaaatgctgggattacaggcatgaactaccctacctggccccttctgtgttttaattcttggttgtgtgtgtgtgttttttttctttgattacaaaatcaagtataaagttatttattgaagatgtactttaaaaggacaaaacactacactttagaaataaaaacagcagcttgtgttagtaatatttaaaaaaaataacacaagcatggtatcaggaaaacatatttttggatacacctttcaaataagctatttgctaaaacagtaattaaggagtgagaagcaaggttggtttctcaccatggggggtttcacaaaaattcagctattttaaagttctagtacaaaataatcagggatagctatctcttctgctacctatgttgttgttcttaaattccacaaacagatgcatgcatgcaaaacaagtcaggttctattagacaaaagttcacttgatttatatttcaactagatttccacttaaaatgttttttcttaaaacaagaagaaaatataagcaactaatgttcttaagtaattttttggtgcatcatctgctgagcaaatccgccctgctactcatttttttaaataaagttttattggcacatagccatattcatttgtttacatatactctaagactgctttcatactacaaatgtaaagagctgaatatctacaaaagagaccatacagcccacaacatacaaaatatttgatatctgttcatttatagacaaattttgtagacaactcactttattagttagaaatttaaatataagatattttgctatctcttaatagtcctctctataatttgccaattcaaaactggtcttcatgctgaatttggccctctatcttcatccctttggcatataatctaattgaggccctcaaaatatcaaaaaatgtgaatgccatttaatttttataggagaggttcttattttctaattcatcttgttgattaatcatatgtttatatacttaaaaattttttttatctatatattatcactgcaagtttctgttggtaacaagcaggctgcaaatgaaaagcaaatgaaaaatcattatatactacttacatccattaggatagctactatcaaaaaacacacaaaaacaaactagcaaatgttggcgatgatgtgaagaaactggaactttttttcactgttgatgaaatataaaatggtgtagctactttggaaacagtatgttggctcctcaaaaagttaaacagagttgccaaattatctagcaattccacatatggatgtgtggccaaaagagatgaaatcaaggactcaaagaaatatctgtataacctatgtttgtgggagcattattcccaatatccaaaagtcagaaaccatccaatgtccattgattgattaatgttaaacaaaatgtgatatatacataaaaaattattcagtcttaaaaaagaataaaattgtgacacatgctacaacatgaatgaaggttgagacattatgctaagtgaaataagccattcacacacaaaatatataatgtatgattccacccatactaggtacatagaatagtcaaattcatagatttgttgcttaataggtatagtttcagttttgcaagatgaaaagagttctgtggatgaatagtgctgatggttgcacaacgatgtgaatgtacttaatcccactattcacttaaagatgatgaaggtggtatattttatgctatgtgtacttaccacaatttttaaaaaagaattaatttaaaatattttttaagaaagcataaataaattttaaaaaatgattaaattctgccaacttaatgtattagccaagagtagggctttggtttcagagggacctcagttaaatccaggttctagtacttgagaaggttacttaatatctgttagacaccatttacataaatgtaaaatagagatatgaataataccaatccaaaattactttgtgagaattaaacatgactttgcacagaactcaataaatgtagctattctatttattatatttatatgcacaaagttcttatttttaaaatgcattaattacttttctaaatatataataacctctttaatttttctgtaacatataattgctagcacactgctaggtatattgcagaagcttaaaaatatgatcaaccaactttaaaatgtgatcaaccaacagtggcattaaaagagtaagagaagtggaaaaatacctgactgtgatacaatctccaaagacaaaagaagggctattttttcctgtaaaatggaaacttaaccagggagaaattaaatagcaatcagttttaaactacagtattctaggaatgataaatttattagtaaaatataaatgataaggctcaatagacaaaactaccaagtattttttttaaaaaaaggaaagaatagaaacacaaaataagactttaaagatccaaagcagcaattttccaattaaatattactttattctcataatggatgtattaatataatctttgactgattaacccaaataccaatatcttaatctccaaatttaacttatgaattaagagttggatgcacaacgtatctcagtaacaaaagcaaaatgaacatctgttaactttctgccatgtaagtttgtgtatggtgggggtgggtgtgaacagagcctctgatgtgtaatgttctttccatctgcacaccaggtggcactgcatggttaatcagaagatgacaacacacatcaagattccttacatattttgagataggaaagtaaataagtcaaaacgttgttttaaaaataaaactttcttagatgtccacagtattaatgcttaataatgcattttaagagtttatgtttctgacttcatattgtaatcattcttgcagtattgtttttcccataaattcctgacataacttataacagtactaagtaatatgagtttaagaaatagaaaagtaatataaccaaactagattgtatttgggaaggtgggaacaatatgactgttttggacacctcttaagccattcaaaggcaagatctgaagaaaaactgatttgatataaatttcaattgcattgcttctaaaatagatttacttaaaatatttaatgcagtcccttaaaagctttggtcttgctttagagtatacaggtgttaagcacttaaagtcaaaaaagctgtttaaatgacagagaaagagattattagatcactttaatcctgctaacgaaagatggcatagcttaactggaataaacaggaaataaggaacggataaaacataaattatcccccaaaatttcacatttctgtactttggtaagattgttctagaaagaaatatatatcatatatggaaatatgcctagtttcctccaacttgcatcaatccctgccatttccatgccattttccttttctcttactaacccctcttttcttctgtgtatgtcttcttcagttcaccaaactttacatagcagcgattcgtaagataagagctgtgtggtttgtagtgtgaaaatagctatccaacagtacatctcctagctctatttgaaaaccactgtgtactgtgcacatgaatacaatgtagtcttgaattctccacatttagcttcattgaattacagtgggcggaggggaagggttgtgtactgtgatgttccaaaagtcttcttgacaatatccactatctcagtaacttctaattttgttaagtatcctaaaatttatccttcaacatcaatattctacctttagaggacaatgcagacctatagtatgattaccaaacgtaaaacaaaacaaaacatcatgatgatcctaaggacaaatgtcatatgctgaagccctaatctcaaacatgatggtacttggagatggggcctttgggatgtaattagttttagttaaactcatgaaggtggggcccccatcatgggattagtgcccttatagaaagaagaaacgtcagaggtctttctctttccatgcggataaaccaaggaaaggccataggaacacacagggagaaggcagacatcttcaagccaggaagagggccttcaccagaacccagccatgctggcattctgatctcagacttctagcctccagaattgtgagaaaataaatgtttgttattgaagccacccagtctatgctattttggcatagcagcccagcaagactaagataatacccatagtatatgttcactaataaccccttccaggttcaaatgataattatctcccacaaaaaatgtaactggcagccataaatagcagttgaaagacaacatttttcttagttcagtaattttccaattctcttatcaacttcactttaagagttaattaaaccattggaaactactaaaagaaaattaatgcttaaacaatgaaaataccaaaaagaactgttttacttctctaatttaggtaactaccataagtaaaatatgtctttattccatgaaacatatatagaaaaatataataaaaattcctccatgtctccatccaaagaaatacaaagaagataaacacaaagaaggtaaatgcaaagaagataaaatattttaaaatataatttgtgttttataaaaggttttttaaaataaaaagaatataagctgtataatgttaaaataaccttagtgattaataaattatctccttttttacaataatacggaagacatcatgagttaatagggttaattagagttaataattaatcaatacttcaacagatatttattgatcatctacaacatgtaaagacttctacgagtagaaaaagccatgattttaaaaaacatttccttatatcatcatcttcatcacaaaacgctcattaaataccctagcgagtactaccattaaaaattaaccaaaaatacttaaagaaaatatctgatattcagcacagtaatgtaatacttgacataattataaggcatcaaagtaggaatgacttaagagtggctttgagtcattaatcagaactaatgaatatgtctttgcattttgtcaaaaacaaaaaaagataaaagaggatgcttggaaagatgcatgaattttaagcagtgaagtaatcaagtataatctcaaaatttctcaacaagttattacattgcttttcatttcttccattgtttcttttttttctttttccaattacttaacttcaaaaaactttattgatgttgtattatgtgttaagaaatgtgctgaaattatgcaattcaaggataaaaaccaacaccaactctcataaatgtttaatatactgtgtttgtgtgggtgacaggggagggatatatgcacacaaccaaaaatgacaaaaggaaaactatatactataaatgacatatatttcattatatatgaacacagaataaacttttcttttcttttcttttgtcttctttttttgtcttttctttttatttatttatttacgtatttatctattattttttttttttttttgagatggtgcctcactctgtcatccaggctggagtgcagtggaaccatctcacctcacggcaacctccccttcccacgctcatctcccataatcaaactatttaggaatcagtggcagtttggtgagcttggaatcagaacaagaagattcagaggtctctaaaatagacttctctgtctatcttacgacctgggctcaaagaactcccggtccattgattcaggtgccttaaaagagccactgtcaatattgctgatatttctgcaggttccttttcttcctcaatacttctaaagatgaccagcccccattgcctgcttctgcagattaatatgtgctttctatagatatgttaatatgatcaaagaataattgccctacatctattttatctccttctggggctttgcatgaactcattaagtaatgatttaatgaactctcagctggaattctatttccctcatttccaaaatcttgggagccattttacaattacaccgaagtacttacaagtgacagtagattaaacaatattacaaattaaaaaaagtagattggcaaaatactcaagacttgctttttgcttaaaattaagtcaggtttattttttaaaataatctattcatagttgtggatagtgactaaacaatttacatttttatctggggacagaagtaaagcaaatggtctaaaaacttaattgcattttcctctgaataaatagaaagtatacacaactatgtacaatttaaaaattcctgattaagaagccaattaagaataacttttatagagaataattctggctttgtgaaggcatgagagatttaactaaaggccactctgtagcaaatttaataccacaatctctcgatggattttttaaattataattatctgttatttgtctgttataatatttgggaatcttcacatttaaaaaaatattattttctgatggtaactaaaagaaaaccaatttgtgataacaatgagaaaaatgaggctaaatataaagactaattcttcttgagtatcagcttaccctcttcaagaatcttaagtgagatgctgaaatgtagacagagtcatgttggctttgagtcacaattgaagtatggatatttgcacttgttatttttttttttactttctttataaaactcactttccatgctttagttgccatttacttcttttctgttacctttgatagtcttaattttcttacccatcaaagagtgttaagaatatcgacatcaaggaccattttaagagttaaaaggatagatcatgttaagaattgagcctggaatattattcactgttactgctattattaccaatatcaccactgctaatatcactattcctacttggaatagtgtaataccaaaattataataatgtaaaatgtattccccctgggtttgggcaatgttataatactccaaaattgccaactttgttaagcaacctataaatttactttattttggaaaacagtcaaaagagttgcattttaaaatcaataactaaaaatacgtataaagttcctactatgtacccgccactttgctaggcaccaaacatctgtcaatgaagaaagcagacagaatctacagtctttaagaagcttaacttctagtggtggaaacaaacatgtaactagtgaattataataaagaaggtgaagaagtgctatactacagtaaaaagtccagtctgaacatagagagcaggaacacagagtttgtgtggggtggggggtgaggaagatgattcattaatccaggctaaagtatgaaggtagggagtagatcatcacaagtaaaataattgtatcaaatagaaaaaaagcatcgaagtcaagaacacaaatatgaaaacaaagatagctctaggtccatgtccaaaacttgaggttaaaaaacttcagataaggtaaaactaaaaacagttcagaatggctgaatcacataatttaataggagaagtgactagagacatagctgtgaccaaatcaagaagagccttgaaaaccttcgtggggacttttctttatctggaaggaaatatggagctatggaagagttttagtgaggaataatgatcagatctgatttcagcatgattactacttttgttgtgtgaacagtggtggccaaagagactggttgaggccatagcagtatcccagtggcattaagtgaggggagtggtggtagcaagaagtaagttcaaggaaaatcttttgggtggacacaagtaaagcacttggtgttgaaaaagactattcatctctacaacaccttcctgtagttcctgtttcgtagtgtctactgtgactattataattgatttcactgcattttccccttagccccttctttctcatgcattctaaaaacaaaaattcaaagaaagaaaaacttggcagaagaacatataaagtttgatcagttacctaaatgtgtcttactggatgttctttcccttgcatgcttgtttaacctttttggcactatcatgttttatgaggctatgagatgaaaactatcagaagatgaacaatcagaaagagaaaaataaatgggcttctttaaaacaaagacgaagggtccatctcttcagttatctataacagtgactcttaaacctggctctagaataaaattacccacagaactttaaaaaaaaaaaaaggaactatacccatgtccagcccgtctaccacactacgtcccactcctgaaattgtgcaatatggttgttctttttgaatgtcttatgatatttctgactcaatttaataccaacctaaacaacgaattcagatttctttattgttttttaaattcttagcacagtgtttgggacattgattgtagtaattcaatacttatttaactcactaatagctacttattgataggtgttgagtatactatgggaaaaaggtgtttagtccatcagagcccttacattgtatagcattggctatcaaactttaactagagccatatttaaaaaatacattttattttaatgcagtgtgaacgtgcaagcacacacatcaaacacacatacacacaggtgaaaaacatttttcacaaaataacacttgccctaaccatagccaacacactttgatatgttctattctattattttctggttatttttataaaataaaaaggaagaaacaatggttgtaacctattatgtcaatttcaataccaaacaaagagagccatccaatattttttaaaagccttgtatagtagatgttccaattctacgtctcaatattttcagtaacatgctgtccaggtgctctgatttcagtaaaaccaccaaaactttagagtctttaacaatgactcaattactgtgaagataacagactaattttgaataagacatagggctttatctcagtacttagaagaagctaaacttctcatggttcaagagacataagtctttagaagtaacaatgatgtacattcaatgagataatttccttggactgtggtagtattagagaaaactctaaaaatgagagacttttcatgagcaatatcatgcactatagttaaaatcaggaaacatgtgaacagacttgacttaatacaatgggcttaatgagctatcttcattatgtcatagttaattaaaaatattttttattttacacaatctaacgtagaataagatagtagttataaacacataagattaataactatggcatttccaactacagaaagagaaagtatctctttttttttttttttgtagacggagtcttgctctgtcaggaggctggagtgcagtggtgagatctcggctcactgcaacctccacctccccggttgaagcgattctcctgcttcagcctcccaagtagctgggattacaggtgcacaccaccacacccagctaatttttgtatttttagtagagacggggtttcaccatgttggccaggatggtctcgatctcttgacctcatgatccacccgcctcggcctcccaaagtgctgggattacaggtgtgagccaccacgcctggcctaccatctccatttttaaaaactacctatgtaaccaacatgtatgcaccaggtactaagagtgttttctttgctactaagtactttactgatctcctgtgtcaaatactaatgatgatgcacacctgtaacagagactttcatttctatcctctctcaatatctgtcatcccctttccctatgattctagacgtttgatggggattatgtccacccagcaaaaggcaatacttcccagcaccctctgctgttgccatgcttatatgatcaggtaacagacaatgagatgaaagaagaattgatttgtgtaacttccggctcataaatataagactgaaggagctgcttccctctttcccacttctattagcatgaatgtgaacatggtaactacccacagaccaaagacggaattcaggtttgaaaatggcttacattgttacatgagaaagaactaaacgtttatattgttttaccctctattgttttctgaaactgcccaaatgtatatcctaaataatatggaattcctattctacatttcctcctacaaaatcagtgagaaagggtagataaaataagtgagtaatgtttaattacaatatggaagcaaggttaatgaacaaaaacatgtaaggttgtgtggctgtccaagtaaccgccagttatatggtaatacaaaggtcataaattcccaaatcgacactcatgagtgtcaaataaacatttcctagagaatacggctacttgtcttccacagactgaagcttttctttttgacatgatgaaatttttctcgtatatgtttcatacaaaatactgaaatagagcataactgcattcctcacatcactacaccaaaatgtcaaagattcacttctcagcatgaaaatgcacagcacataaatatgaaaggactctacattctaaatgctgtattcacacctcagtgcagagtcaaatggagacaactgtattgtgaaccagtatagcattatcaaataatatacttaaggggacttaatagtataaaattaaattaaaaagctgaaacactattgattatttcagttagaaggtgtttcgtggttataactactcagagtgataaacaatttaattattccacatttttggaataatttgcttatgtaattaatttggatatttcaatgtattggttattttattggtccatattccttcagtacaaagattctttgtagatgaagttcttacagatacatgtattaataattgtattagtatatactcaaataatggaaaacatatcttttagtacattggtgaatttcaaatagttatttgataacattattagtattgcagacctaaagcctgatgaaatttttcacttattactgaccaagcatttttgatcatgtgtttattgagagtaattggaacttacagacacctgcccaatttctttacattaaattatcaatacaaatgtaatgttgaaaagtaaagctaaagtcaaatatagtatgcctaaaaatagaacccagggaaaatatcagatcttgcctccttcctacttttgatatacacaataaatataatattgtaattaagatcatacagacagatactaatgacaatggcacccaaaattttctgaaaggaaggaggttcagttgagacatttaggagctagaagacagtgtaaatttatattgctttccataattttttgcctaaataaaggggctgacaggcatggtcttagaaatggcattttgataagaaaagtttagtagacaaagaagcattaatgatgactgcacttcagaaaggcaatgaaaaaggacagctgcaaaacaaacattactcagtgtgtgatcacttaaagagatattatttcgaacttcatattctgagtgtgaactgccgaagagacagacaaagtaaaatacaggacgatgagtttatattaaaaatgagtaacaatttaacacagtggtccccaacctttttggcaccaaggaccagtttcatggaagaaaatttttccatggaccgggttggagaaagaggatggtatcaggatgaaactgttccacctcagataatcaggcattagttacagattctcataaggagcatgcaacttagatccttcgcatgcccagttcacaatagagtttgcactcctatgataatttaatgccattagattctaatctaatctaatgctgatctgacaggatgcagagctcaggcagtaatgctcgcttgcccactattcacctcctgctgtgtgaccaggttcctaacagtatagtactagttcgtggccccgagtttggggaccccgatttaacatactccatttatatgccgtaattgcccatagtacaaatcatatcagagaatgaatatgacattcatgaggcaaagactaagtcaagccaacttacttgttctctctggtctctcagtaaacactaagtggaagaaaaatgttagaaaactcattctccataacatatttaggcaaaatatgagaaaacagtatacagtgagtgcctcaggagtaatacactgtctatgggactttcagaacactgatgaaacatttaaaaaattcaaccaaataagaaaagtctttagaaaattttggaaaatgaatagcaaagggaacgagccaactccatcctttatgatcactttaatcaattgtttttatcataaaaagaaagctacagcctctagacagattctgagtttctggtggtatgacttgaaaatattttcttcctagagattctcactggtgatgatggtgtggtgaaagaatgggaagataaacatcttgccgaaatctctccataattaaggtgaaacagcactcctacttataaaatagaaatttagttacttggccaatcatttctatctgttattccctgaacaaatataactttcatcacgaaaatgtctgaaggcagtcattcttctggatattgctaggaaataaaaaaatacattataaataaatatatttaagagtaaactactcacctattccaatgaaagcagctttgtagcctttttctttcaaagtgctaagagtcatttcattcactgaaaggcttttaccgcaaattatctataagaaacaatattttgcataagaaaatttggcatatgattaattaaaatcttaatatttaacatcaaaaagaatgaaaagtcagccaaaaattctatgagattccatataaaatgtgacaacatttttgtcttttagtatataggtttacatacacaaaatagtatataaatagaacaggaacatgttctattaagggctaaatgcagaagaaaagccagtgtcattaaaaccatcagtaaacttccatagcttgcataatatgttcaaagcacgatgtggggcatttaaataataagacgataaataagacacatttccagcatcaatgtacagtcaagtaggggcaaaagatatacacaaataaatgtaacataaaacaagctatgatcaccacatgtgtatgagagttcagaggctggggagattcattttagctaagcttagaaggttgagaatacagagaagtgggatttcaatagggcctttaaaaggaaaagacaggattttgataacggacagtgtcaagggaaaatgaataaagtcaggaagcagagggtagtcacccctagtaaaagtcacaatgcttggtcagttcccagacatgagataattttcacttctggaacctgctgaccagggaggtgtcagggtccctaggaagaaagaccctgaaacatccctacaagtaagtactgtgattcccctagtcctttcccaaaggaaactatggtcatttatccaagcaactaagccctggaaaaaggggaatgatcagacatttcaaggactattaagcactggttcttcagtaatactgatacttggaaacataagagtgggtacttacagggtgaggtaaaaaatggagcctgactgaagtctagttcacagtgggcccactgaaaccacaactcagttagtgatcgttctcctagtctctaagagcataattgaaattgttacatttgtcaattgaagtaatccctacattgggtctctggtctgtgaagtaagagctataaaagctatcatagttgggaaggccacatgaaaatatctgaaaatccagccaagagactaaatcaaagataatatcctatcctgggtgcaatgggatggggagagatgttagtggtccctgtcatatccccatttaatccaccagcctgtcccctgccaacaccagagaatttctggaggatgactataaatgtctgcaggcttaactaaagagtagtcctgattgcagtttctgttacagatgtggtattattgctagagaagttttataaggccacacatagactgcatgtggccattgatttggcaaatgcatactccttccactccaattacagaaggagatcagaaatagttcagagtcacagagtatagataagaatattcatttacagttttgccttagggatatgtcaactcttttcagtaataatatatgtaatctgaagcgatctggacatcccacagaacgtcacagtgattcattaccttgacgacatcaggcagatcagacagcatgaaaaagaggtggtgaatatgctggaaactgttaagatatctgcactccagtgggtggaagatgaactctataatcagggactggcctcttgagtgaagtttagagatccagttatcaagtatgtgccagtaagtccccttgaaagtaaaagacaaatagagctgcatctcacatttcctgccatatagaaggaagcacaatgcctggtaggtttctttgtgttctgaaggcaaaatgttcctaaaaacaaagcccttaagctgagtcatagaagaagagcaatgtatacccatgaactggtaattacagctacactgaatagtgcacctaagtgtaaagctctcttctaagtactgcatatactgactcatttaatccccacagcagccccatgaagtgttatcagtattttcattttacagataatgatactaaaggacaagagagcttacataacctttattgcagtcaaatacatagtctaatttcagagccaacatgcataattgctgtgctcttgtgcctcttgaggttagagggcagagctggcaccatcctcaaggacaaagaacagcatattatacgtgaagacctactaaaaaggttgtgtttcaagaatataaagtgcaaagcaagcaatggagcaagaagttggagaggagaatatgactggaactggatcatagagggcaatgttttgtcttcctaaaatagtaattctgtttttatattggcagatatggtaactgtcagaaagtttataataaggggacaaccaaggtgagattaataacgaatattcagaactctggaatgtatcaaaaaacattaaactggaacattaattaaatatgtattattcaaagcattttatagtaagtaatagtattactattagaattagtagaattcgatgctattaaaatcatctaatagtgaggctttagaactttaatttattctaacttttaaataatacatattttattgaaaaagaaaaataatttcgctgtttgttttatgaatcaaatacccttcataccaatatataataaaggttagacataaaagaaaacaccaggtccaaacattctaatagaatattagcaaactgagtaagtatgccattttcaaagttgagcactggaatgccatgccaatgaattaattggtggaggtgattctcaaaatacttaatcttaggtttactttattcagtgcctctgcaggaagattcaagaagacctcccatcctttttgaggtgggtatttgtgggagaaggcacaatagtttagtttaatagtagctttttgtgatttatcaaagaggaataaagacatcccaattcttccaccacagcagagtgaaaatgtctttgattttgtaatatataagaaagatgctcattctgtatttatacagtctgattctactctaatacacaatagtgtgcaaatggggatagaaaacagttgagttttcctttcatgtatggaaagctgcaaagatgagtatcttgatcttggtgtgaatctactgggatggagaccagcaagacttgactttaccatgaacagacattgtgggaaagatggaggatggtcatcactgggcagcagatccctggtagaaatgaggacaaagccataacaagaacattccaagcagtgacaggcacaaggcttccttcctttttgtgaatgggaacctattcaaatttccctttcctaaaagcctgaggccccaaatatttgccatgcaagaaataatctattcttagaaagaattagaagaaagattccttgacaacaaaagtaaagctttgcttacattatgctttgggaaattgaaatgaaatgtgtgttaactaaaactggaattgcaagacaactacagctatcaggaacatcatgttggctgataagctatgaaatctcaatgttatttgttaaatatatatgatgctagaaaaatcatattacgggcattttgtttggtgtttttgtttctttattccttgtacttttacatatgtaatatttccatcttgattttcttagatatacattctaccttcctctaatgactttagtaacatattattagatatttcctacctaaattcggaatacaaattcaatctatttcaagttcagtgtaatagtcactactttattccagcagttctgaatgtcatataccctgagccaaagttccatctaatagtctcttagggatttgatgaaaactttctttatatactataatatgtattcatatacatagtaacatttattatgcaggataaaggctgacaacttttttgtggagtataaatcttcaaataaaataggtgatgcccattatttttaaaaatcaaataaaaacatacatactcttcacagttgtctaatagaaaatttggttaaatagaccaaatatttccagatgctctaagatagaaaataaaatgaagaaattttgaaagtatttagctatctttagaaatgaaaattatttattagctattagtgtacatgtttccttgtgggagagaaataatatgattttatatttattttctaatactatctcataatcacagatattattggttcaaataaccatagtgaaaacaagatgttataagaggttattaagaaaaaggtaatacctctattagatatttcatctaaaactacgaagcagaagaaatgtatagaaattacaaattaaggtaatcaattagaattctatcagaatactttgggaaatgacaaatatacatattttaaatatgcaaaaatgcaatatcttcattcatattttatacttttaactttgaaaaattaggatataaagaccatgaaacaaaaatatgtatttctatttaaattctgagttgcattacaaaaaaaggtataaataaacatcagctaagaagccatttctcctaaagggaatacccaattttattacactataaatgatcctttggtgtaaaatcaattgagagtatgcttgataaatttaaaaaatgcaaatatggctaataaagtgaaaaaataatgaattatatcacaagaatacagaagcaaatgaaaatactatcctacataactgttgtctacacgggggaaaaaaacctactttctgaagaaaaataaaaataataaaataatgaaaacacatggatgctgacaaagatttttctgaaactaataactttaaatgttttcattattcaatctataaaatgaaaatgaagtaagtttacaactcaagattttacagcaaataacaaataagttccactctgatcttgcttatttcttgtcttctgctagctttgtggatatttttctcttgcttgtctagttcttttagttgttatggtagggtgtcaatgtgagacctttctagctttctgaagtggcatttagcgctgtaaatttccctcttaacactgctttagcagcatcccagagattctggtacattgtctctttgttctcactggtttcaaagaacttcctgagttctgccttaatttcattgtttacccaggagtcatacaggagcaagttgttcaatttccaattgcgtggttctgagtgagtttcttaatcttgagttctaatttgattgtgctgtggcctaagagactgttagttattatttcagttgttttgcatttgctgaggagtgttttacttccaattatgtgatcgatttgagagtaagtgccatataactccaagagcggaactgaaggagatagagacacgaaaaatccttcaaaaaaatgaatgaatccgggagctggttttttgaaaaaaaaatatatatatatatacacacacaccaataggtagactaatgaagaaaaaagagaagaatcaaatagaaacaataaaaaatgataaaggggatatcaccactgaacccacagaaatacaaacaagcatcgaagaatattataaacatttctatgcaaataaactagaaagtctagaagaaatggataaattcctggacacatacaccctcccaaggctgaacaaggaagaagttgaatccctgaatagaccaataacaagttctgaaattgaagcagtaataaatagcctaccaaccaaaaaaagctcagggccagatggatttacagctgaattctaccagaattacaaatagaagctggtaccatttcttctgaaactatttcaaacaattgaaaacaagggacttctccctaactcattttatcaggccagcatcatcctgataccaaaacctggcagagatacaacaaaaagagaaaacttcaggccaatatccctgatgaacattgatgcaaaaatcctcaataaaatgctggcaaatgaaattcagcagcatataaaaagcttatccatcacaatcaagttggcttcatccctaggtgcaaggctggttcaacatatgcaaattaataaatgtaactcatcacataaagagaaataaagaaaaaaacacatgattatctcaatagatgcagaaaagtcctttgataaaattcaatatcctttcctgttaaaaaattctcaataaactaggtattgatgaacatacctcaaaataataaaagccatttacaataaacccacagccaatatcataccaaatgggcaaaagctggaagcattccccttgaaaactggcataagacaaggatatcctctctcaccactccatttcaacacagtattggaagctctggccagggcaatcaggcaaaagacagaaataaagagtattcaaataggaaaagaggaagtcgaactgcctgtttgcagatgacatgatcccatatctagaaagccccattgatcagcccaataggttaagttgataagcaacttctgcaaagtctcaggatacaaagtcagcgtgcaaaaaccactagcattcctatacaccaacaataagcagagaaccaaatcatgaatgaactcccattcacaactgctacaaagagaataaaatacctagaaatacaactaacaaggaaagtgaaaaacctcttcaagaagaactacaaatcactgctcaaagaaatcagagagggcacaaacaaaaggaaaaatactccatgctcatgaataagaataattaatatgacaataggcatcctgcccgaagcaatttatacattcaatgctattcccattaaactaccattgacattcctcacagagttagaaaaaactactttaaaattcatatggaaccaaaaaagagcccatatagccaagacaatcctaagccaaaagaacaaaactggaggcatcatgctacccgacttcaaactatactataaggctgcagtaaccaaaacagcatggtactggaaaaaaataaacacatagaccaatggaacagaacagagatctcagaaataagaccacacaatacaaccatctggtctttgacaaacctgacaaaaacaagcaatggggaaaggattccctatttaataaatggtgctgggaaagctggctagccatatgcagaaaattgaaactagaccccttccttacaccttatacaaaaattaactcaagatggattaaagacttacatataggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtagcgggagcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaaaaaaaaaaaaaaaagacttacatataaaacccaaaactataaaactctagaagaaaatctaggaaataccattcaggacataggcacgggcaaagatttcatcatgaaaacatcaaaagcacctgcacaaaagcaaaaattgacagatgagatttaattaaacaaaagagcttctgcacagcaaaagaaactatcatcagagtgaagaggcaacctacagaatgggagaaaatttttggaatctatccatctgacaaaggtctaatgtccagaatctacaaggaacttaaacaaatttacaagaaaaaaaccaaccccattaaaaagtggacaaaggaggccaggcacggtggctcatgtctgtaatcccagcaatttgggaggctaaggcaagcgggtcacttgagatcaggagttcaaaaccagcctggccaacatggtaaaatcccatctgtaacacaaataaaaaaattagccacgtgtggtggcagccacctataatcccagctacttgggacactcgggcaggaaaacagcttgaacccaggaggtagaggttgaagtgagccaagatagtgccactgcactccagcctgggtaacagagctagactccatcctccatctcaaacaaacaaacaaacaaacaaaaaacttacgtaaaggacatgaacagacatttctcaaaatgagacatttatgtggccaacaaacaaacatgaaaaaaagctcaaaatcattcaatcattggagaaatgcaaatcaaacccacaatgagataccatttcacaccagtcagaatggtgattattaaaaagtcaagaaacaacagatgctggcgaggctgtggagaaatataaatgcttttacactgttagtggaatataaattagttcaaccatgtggaaaacagtgtggcaattcctcaaagacatagaaccagaaatactatttgacccaacaatcccatttttgggtatatgcccaaaggaatatagatcattctgttataaagatacatgcaggtgtatgttcactgcagcattattcacaatagcaaagacatggaatcaaccaaaatgcccatcaataatatagtggataaagaaaatgtggtacatatacaccatggactactatgcagccattaaaaaaattagatcatgtcctttgcagggacatggacagagctggaagccattatcctcagaaaactaacacagaaatggaaaaccaaacactgcatgatctcacttacaagtggaagctgaacaatgagaatacatggacacagggaggggaacaacacacactggggccagttgagtggggcagggacagggagagaatcaggataattagctaatgcatgtgaggcttaatacctaggtgatgtgttgataggtgcagcaaaccaccatgtcacacgtttacctatgtaacaaatctacgcatcctgcacgtgcatcctggaacgtaaaataaaataaaataaaactaaatttaaaaaagagactaacaaataagaatagcaggggaaagcattaataaatatatagtcagcaattaatgaataagaaaacaaaactttgataactgtttattttaaagaaaatattaactggataggaaaacacaaaggaaatttagagatgcaagagcaaatataatcacaggcacagatgacatatttttattgtatactgaaatagtagacttaaatttttgctaataaattcaaaaacctcaatgaagcagaaatttttctagaaatatattggcaaaattgatacgagaataaaatcagtggaaaaaacttatagacgatatgaagaaaaatggtcatagttctatttcataagagggtttggagaagatgacaacttccaaatttagtaaaaaagatgtctcaagataatattcttaccaatgagaaaataataaaatgcttagaagtttaattttataaggctaatataactctattatcaaaaattcacaaaacaacaaataaaaataaagcaaaacaaaacaaaaagtctttgcacatttaaaacttgtaatggtaacaacattatttgactgttccctgcgatatttctggttttaatatccattacataaataaatgaatgcacaagaaaaattttaaaaatactaaccaattgaatctgaattacatgtacagaaataaacatgatgccaaaattgataaattttagaaattcaatgattagtataattcaacatataaactcaacgtaagtatttacaaaggggaattgaaaaatttaacacacttttgattaactttttaaattaataaaatgtattaatgtaagactagaaaaatatttattcaatatgattaaaaatcccatttcagagacaagaaaaagaattccatgtattatacctctttttttttttaacatactagatattgaaattgtggaagaaaaatatgaataatgtacaaataacaaacaaaattatctttattctcttgtaacatgatatttgactttaaaaaattaatcttagaactaacaaggactgattggctaataagataaattgaaattaaaatattcaataggaaatgcagctaaaaaaagatagttgggagtgaagataaagaaactgaactgggttctggatataatcaggttatgttatttggatgataatacgcttattaaactactaagtatacaggactggagttcaaaagaaggatggctctacatggttctagtcctggcatactacttggcaaaaataagttctgaacaattatttgttgagtaaatgaaataaacctctttgggaagtaaaagagaaagtagaagaataaacaagataatgctaggtcatgaaagtcaaaatacatacatacatatataagagaactcttacatcatatgctacacgggagtcaaacagtatgaacccacaaaaatagttcatttcattgccaggaaattatttttgactttaaaatatatattagttgagagagacaaacagaaggcaaattataaaaagaacctccgtgatgacttttcaaaaggaggtaatgagcacagaccactttgtcaaaatgtacccacttatggctaaagttcgtaaatcataaaagctgcaagagtatctcatcaaaggatacaaatcctcaaagtgaaaaggaatctcactgctatctttcctcagaattgtatatacagtttattgtttacaaagcaaatttgaaaacatcatttccttcacatcttaaaacagcttgagagatggacaagacagtactgttagctttctctttaatttaggttccattttttttcctcaataatgtaacagattcacagtttaaaattcaaatgtacaaaatgttgaaaaaattgtcccacaccttctcaaaggcaatctgttctatcagattcttatatctttctgagatattctttgcatatgtaaacaaatatttttatattttgttcaaatattagtagcatactttttatttgagcagattttgaacaacgttctagatattaatagactttgccaaagatatctgacaaaattaaaaagtggcatgactatagctaagatatatttcttggcactcagtatattgcctactactgcaccttgatgagttttcaaataagagtaatgggtatgctctaatttatgcaatatatctggtcctgtgaaaactgaatgcaattttgcaattttatataagataaatggagaaataaagcctaatttcttttttcattttttattaatatataataattttacatatttatggggtgatacatgcatagaaagtgtaatgatcaaatcaggataattaggatattcatcacctcaaacatttcccatgtctttgtgttgggaacattcatcttcaattcagaataccgaatctaatagttggaaatttcaataatcatttccatatttgatgagatttagagaagaacttgtattcaaaatgaaagacatttaaaaacttttcagaatgtacttctgtaaaataatcacctctaaattatctattttgaacactgtaattttgaacattaagttttataaagttgcccaaatctatactatgtgtttttattcccagacatcttgtttagtcattatgtgtgaatgtttcatcacccggccactgtcaattaaaacgtaattataaatataaaccacaaaatatttttttgagtgttttctcttttattgattcattttaagttttactggtaaatgcaaaaggtatgagtagtttgttaatcacttttcaaagtatcttctgcatatacttacagcatgtattatgtaaatcacagtacattattaatctattgtgttatatctattatgaaaaattaacatttttgaaacaaaaatagcaatatgttcaagtgaagagctagaatataatgctcttaacagaaaagaagaggaatatttaaagctatatgctgaaaataacgatgtgtcaaattttcaaccatctcgaaaagaataacacaatatttatttaacaaaataataaaaaatacgaagctgttgctttctatcccactgatttactgcttgtgttgagaaaggattatcacattcacactactgacatgatgaatataacaaataaaataaatctccataagaaattatgttccaaattgtgaaatactaatgtttcagagtgcacacaacttgcatgaaaaaacatgattaaagaaaccaaatccttctattagctgcactgaacccctaaagcaatttaggaatttgtttcttacagacaattaatcacatgcaggcatgccagatgagaactattgattgcccttttccaggctagtggcattcagacagtagacagacaaatgccctaagcaaggggaagcatctttctgcttctgcctgatgtagcttttaattgttctttcctaaaatgcatgacatttgctgttaatctttagtgtagagcttactcctttctttttgagcagtacacagataggtgtttttttcatttacctttacaccaaggtccttcattagctcaatctcaaaattcactacatcatacggcagccggaactgaggaatttcagaagtactgaaaagaaaggagaaagaaaaacaggcatcagtagaaaaatgaccaatctttgaccaatcttaaaaaaaggtaacatgtctttatggattagtagaaaataaatatctcttccaaggatatttatatatcacacaagatatgcatgaggacatctacattcttattgatataaacatgttacgtggagtgaagatacagtagaaactgatataaaaataactaaattacagcaacagaaaatgataaatataaaactggccaaaagcaatttcaatacttttaagttcaataaagtatttggttgatttatttaataataattctataaattcctaagataaaaaatcttaaaatctattaataaagctagatggagatatagattttaatatatgtatacacatatatatatacactaacattcatatacatagtctataaatgtacttctagcttgttgatatgcaaatgtgtaactgtattaccatactgtttagaatattacaaaatcagttccatgtgatctatagaacattttagtcttctgtgaaagcaatgagtattccaaaagttcagtcattaaaaaacaattctattgtatattaatgcctattgcctgcatttaaaaaaaaaatgaggcctatggcactattatttgagtagtataatagagtattaaaagtaagctaaaaacactttccagtgttttgttaacaattaaaaaagctatgtatgtccatgaatacacagcaatccattcattcattcatttgctgaatcattcattcacctactcattaaaagtgaatagtgccaggcacagtgtttacgaagtgccagctaagtgtaagctgcaatgatttgatggtgaatttcaccaaattctcactgttaataagttctttttctgatcagggaaggatacacaaaagataattacatttagaatgtggtacgcacaatgagagaagtatatccattatatctttaatgtgtatatatacataaaatagcaatcatattttatatattatagagattaatttggaaaataaataattgttgaagatgaatcttctggatcatcaattgaaaaatctcccaaagtacagccttttcattgtttgatgacttaagaacttgattatgcaattaatttttatatatcaatcagcaagacatcatgctcaatgctatagaaaatgcaaggtatccgcggtggctcacgcctgtaattccagcactttgggaggccgaggccagcggatcacgaggtcaggagatcaagaccatcctggctaacacggtgaaaccccgtctctactaaaaatacaaaaaaattagccaggcatagtggcgggcacctgtagtcccagctacttggaaggctgaggcaggagaatagtgtgaacccgggaggtggagcttgcagtgagccaagatcatgccactgcactccagcctgggcgacagagccagactccgtctcaaaaaaaaaaaaaaaaaaaaaaaaaaaccaaaaaagaaaatgcaaggtatcaaacaccataaaatcaaagctgtacactaaaggagcttccctctagttaggaatacaagatgatgtttaagaatgaattcaggcatagggcagggataaaaatctcttaagccaacttgtgaactccagccacattacctcaaggtaacaagaatgtgccagaatgctctgggcaccaagaaggttttcccttcaaagtctaagtagaaagattcttaacaactatggactgtatgtggacacaaacagacacacagacttgatagacatggggctgcatgagagggagattaaatatggactaaaactgggcactgatgcagatcctcaaaaggttgaacaggaaagcaaaagcaatggactatgaacaaagaattccagccaaataaaccaactacaacaagatgagaatcttaaatacatccagacacattgtgaagccgagaaccttccaatgagtcaggcctactcttggatttttatgggatgttaagtagaagcacatggaataaaaggaaaaaaaatggtgtgagtgcaagtcaatggttctgacttaagaaaaaaactctgaaaggcatgttataaaaagcagggacaacttttctgttggtcagaaaaaaataaaggaaggaacacctaacctagcaggaagacacctgagaaaggaggaaggggcagccaccacccttggcagtataactttgaatgcagatgcaggcaccagagaaaatggaagccaggctgctggagttcagcaactctgcttaaaaccccatgctgctctggaaccattgtcaccaacacttagcacagtgttaaacgaataagtgtgagagaatccatttcccagcatctcctgaagcaaatcagagaaatatgaaatactgagaaatgttagatttggttacagtcaagtaggtagggggtaggtggaaattactgattgtgaaaaatgtgacgtttttatattcactaatggatgaagtcagcaaatagacgaaacacatacacacatacatcagcagaacaacatgacaaatgtaaaatactaaatgtgaacaagtgtttcaaaggagggaaggcttattgtgggatgagataagtgggtaggggaaatgtcttaggactttaaaatatcatcagtgtatgatggcttccacatttttcttcttaaattccagacttttatgttcacttgggtgtctaatgggtaactcatatttatcatgcctaacagtaagctttggttcttgcatcccaacactggtcctcagacaaccccattttatgagttgctcaggacctaaactccatcatcacacactattccctttccagccccacaccaagcccagatgcaggcagtaaagtaaaaaggtgtgttctttttagacaatttaaaaaccattataaaacttactaaagtgagtctgttttgtcttattttcatgagctagcaattctaaataatatcactaatatcctaaacaatgtcctctgccaaaataaaaaaaattctctggtgagtctaaattctaaacaatagccatagttgctattgagttttagtaatatatatgtaagctttcaatgatcccatttttattaccaactctttaataaacattgtgttctacaggaaagttaacttgcagaactacagttaaatagaggccatcagcaactgctgattcagctacaggcattcctcattccaattccccataggcgacatatgcctccactcttgtgatactacagattccaatatgtgaaaagttgatttggaatagataaaatgatagcacatgaagcaatattaattacttcaattctgtcattttgtatgatcacatggaatttttgtgtttaaaattgaaaatagctatatccttcacattaaaataatgttttaatcattttttgttttacaggaataaattaaaaaataattattactggttattgtgtgattcttattcaatcttattgtatagaccagaggatagcatgttaaaaaaatctattctgagtatctagtatgctaggtataccactaatccatcattttttaaaaacttcctccttgcatttatcctcacttaacatattctatatttggtttattgttcgtttattgtctgtctccccacgactaaaatatagggcccatgagaaggcactttgccttgtttacttttatgctctaaatagagccagaaataatgaccagcacatagttaagtgatcgatatatatatatactgaaggaaggaagggagggaaggagaaaggggaaaatacaggtaggtatcaggtcgtggaagggtttttatgccaggacagatcctttatctctgaggttaggaggagttgttgaaagatttcaagtggaagagtgatagaatcagatttgaaactaaaggaagaatgaatttgaaaaaacaaatcaggaagccaagataactgcttggaagctactgcagtggtaaagaaagtgagaggtggccgggcgcagtggctcacgcctgtaatcccagccctttgggaggccaaggtgggtagatcgcttgaggtcaggagttcaaaaccagcctggccaacatgatgaaatcccatctttattaaaaatacaaaaattagccaggcatggtggtgcatgcctgtagtcccagctacttgggaggcggaggcagaagaatcacttgaatcccggaggtggaggttgcagtgagccaagatctcgccactgcactccagacttggtgacagagccagactctttcaaaaaaaaaagaaagaaaaaagaaaagaaaaaaagaaaaaaaaaaggaaactgagaggtaaaggatatcagaggacatttttttagagtgttcataaagtggaattgccaggatattaaagagtagcccagataatccccattttggtgatgccatcctctgagatggtaaactcaggaagagaagcaacattgatcattgatatgaagtttatacggagatgtctaggatttgaatgtataaatctgttgcttagaatagagaaagaggtcagggcagatatggatttttaagaaatttgcatgtaggtgataattgaaaccatgagagtaaatgagattattctgaagactgcatggtgagaaaggagataaaaggacagaagacagaatttaataggaatgattattttccaagtttgttgtgcttaggaaaacaaacttttcttctatctgtgctcctgtaacaatctaaggctttgaaaaaaaaaaatttcttgtaatcgtaagtcctttagtatagtcagtggaaagtcagacaacatgaaaaaaatctttcttctattttcatgtttctttcatgtgatgaaatatatctataacaactttccgttctttttaaagcacaattctcatactctgacagaggtatgcttcagtttattactatagagataatagacttaaatttgtaatacatcacacattctcaaaatatttcctattgctataactagttcacctagacctcatttctctttattgtcaatcaacaagaaaaacaataggcctaatgaaaacaatataaaatttgaaagaggtaaagcaaagggcagcattggcctcactatcctaacaataacatcataatccttatatattaatttataagagaaaaatcagaatgtatatatgtacaaacattcttgaaaatctattagcactattttgtttatctttgttataatatcaagcccttttaaccctgttaaactcgtgtcctaaaaacagaagccactgttagaggaaagcaaaactactgattattttataaatttgttgcaacattaaaaataattgatgtgttcaatgcaatggagattaaatcctagatatttttcactgactccagtgatttcttaaaaagtggttgtgatactaattcaccagagataaaagaatctgtttggatgcaaaggagaaggaaagataaaacttgacattacctctttaagcaattgatttcaaatacaaagctaatttaatcttttttagccactttcaagatacaagagaatgagaggcagccgtaagtagaaaataaagtaacaggaaagttttgtggctataattccggctaaattccagcatcagtttttataatcctgtaacagtgacacagaatgcctgtaccatgggacagtacaaaggagattgattaaatatttcatattgtctctacatactgaaaagattcaaaggcaaaagaaagaatttaacaactttaaaagaaaaaccaccatgtttggtctggatccagagaactctgtctcactaaaaaaatgttcagcaaataaatttaaaaaaaacaagtttagtactaatttatatgaattacaaatgcctatcctgcatttgagttaaaaaagagataggctaacaacagtaatctaccaaaattggcaatacatagtaagttacaaatagggttggttccattttaggccttttgtgaaaatgcaatcaagtggcaaacagatttttcctagtttaccagggtacacaattaagttcatattttaaaaattgactcagatattcactgatgtgtataactgaaaacaacatacaatgcttatacatatattgttaatagattatgttttttctaattaataaagctgtggtaaataccattaaaatgatattctaaatctttccagagaaataatatataggacattttactttccagaaaaataaattcataaaatacatgtaatctcttggaattcatagtagtggaacatcagtacagaagaataattatttcttaacaatcaggttatttatgtttcatgcccacactaaagggtcttcctaaaatgtgatatttttgcttgatgattcagtcaaataagattatattaatgatagcttatacatcaatatttatgttaataaatatatcaacatatttatatcaatgatacaaataattgataattgataattttatattatcttgggcttagcatattgttgtttgagtaatattgaaatttatacatttattaacatatattcactggtgccaaaaaacataagaaacttcacaaattttagtaacaaatttgattaaatttatcctctgtgattattgggtatgattaatttatttgttacacatagggcagtagccacaacaaatttaaatgttaagcatagaaacagatattccaaatggatacattttgtaatccatgatttttttgataatatacatagagaaaataaaaatcaattgagtaatattattcagttaccatccaaattctttattttgtataaaatgttttaagcaatatctattccctaattgtaataaattttatttctttatgataatgaaatatgtgtcccgtatagagttctgtttattttcaatatatattcccatttccatgtataaattttcatgggaataatatgatcatgtgattttaaaaatgtatatttaaatacatttctagtacatgctgacaaaattttaatcaaaagtaagacttaagaaattttaaactgaaaatatgtaagacaacatatctatgtagacaacacaatgaatagtccaatattccatggatctaggttttccacatcactaatatccaggattttcagttatatctccattaaaagaaatattcacagggctaaaatcatttttcatatgattggttcttataatcaaaaaataatttgcagagatttctcttaaattcacagaactagagagaaaattttttaaataaatattgcttcaagccaactgcaaattttaaagtgaataatgtaatcaaaacttgaacatttggaaaaagaacatttaaaataccatctgtgagcctgaagttcctatatgattatgaaccaacaatattcataattgttttgctccatcatttctgacactataaacatgaaataaatgtaggcattaccttaaaccaccaacatattcttgtttttcaaatatagtgatgtcagagtaccccaatcgagccaaaaaggaagcacaacttatacttgcaggcccagcaccaaaaagagcaatctttgcagaataggcttcagacattttttctgggggaggcagcgaaggatttctgatctgtgggatactcattgctttgaatacctacggggaaatcaattgtcatggttaaaattttgaaactagcttacatcctcaaacatatttttaatgtttcaaacgaattcttgttttaaatagcaatgagcagtacattttcagtattaatatggtatacttacaacttttattgtgtcaagtagatgaggagttatggctaactttcagtctttcctttctagagtcatgcctcctctaggaaacactcatggggcacattccctactcccacctagagggtacattaagtgcctctcctctaagctcctacagcataatctgtatgtctctaacataaccatctgtggtatgtgttatgatgtcagtcagtagaatgaatgttagttccctgaatcagaaaacatgtcacatgtaaacacattacccttgcattataggagttagcattgcgatggcacacggtagacatttaataaataatttcttgaattctgcttttgattatgacagattaactttgggagaataatgatttaaaaaaatagttgaaacattcaagaactactgacgcaggcatcttggaagggctaacatctcagaggaaagtaagaacaaagttaagtgaccagaagtcacttttcccctgagggatttgcgacttcttaccaaagggaggaaggctaagcatcttgaagagaaccacagctcagaaaagagatgttggcagtcttttgaaaccagagagacacagagttttggaaatgtaggaggccattaacctagagcaaaataaagtacagaagagtgagattaattcttaaagtgcatatgacaaaaacctaaagatctaaacagaaaaccctatggtccaggaaaaacaaaaactggagtgactaaataagaaagagccctagtacacacctcagtgtacggctgaagcttctggagggctacactctacaagtagggcaaatgaggggtaaatagccaacctagccttgagtcaactcagccctggatttaaatgacagtgatcagtcctcactgttatctatgtaccaaacgatagaatgcactttctgtgaataataagtcaaccacagtttctacaaattttttataaaatgcctgggtttttatttttaaaagtccaagcctgcaagaaaaataaacctaaaaaaattgaaagagatacatacataatctcgtaagtgtggttatcaaaaataaattttagaataactatgattgatatgttcaaaaatatgtaagaagaatgtaaacttcattaaaagctggaatttgttaaaaataaaaaattaaatttactaagtacatttagtaaaacatatttagcaaaaaaaataactagctaatgtggaaggagggagtgggattttaaaaacacattattaaaatgtattaattaaaattattataaataggtggtagagggtaggaaacaaagaaacaaatggtaagatggtaaatataaatgtcaacatgagaaattatattaaatgtaaatggactaaaattccaattaaaagacaaaagttatggaagataaatgccttaaatataagagcacagatagataagtgtaaagttaaagactagaaaaagttatacaaagcaaacactaaccaaaagaaagctggtacatatatatattatatatatatatgaaatatatatataccaatattagaaatattacactttaaggcaagatgcattactaaacttaaagaacatttcatagcaaggaaatggtcaatctttcaacaagattttaaaatacaattttaaatatataaagcaaaattgatagaactaaaagtaaaataaataaatcactataatctcattattctactctcatgaaaacttgactaccaatagaagtggccaatgaataaatccatattataggtaagttatttatgctatccaatggattggctcacacagttgcttgcatttaataggtcaaagcagtaactttctctcctggaaacccagacagagatcaatagatataaatgtaagttttcttaagaatgaggaataaaggtgacaggactttacattttcttaacctcatcccacatataccacaaactattgtaaataaagtcaaaacacataaggaacatccaaacaatcttattttaaaaaattgaagagggtattatcaacaagtattatagggtcaatttctaagcatgagatgaaaggtcctcataaatggtctcataatattttgtcattttcattctaatactttgtcacttttactggtttacttatctgtttcctctcttagaccataaaatatttaagggaagacaacatctttgaattcaccttttaatattcagtgtttttatacataagggggaatatatgttaactaatgagtttaaattggtaataaaataatttcttattcccagctacaatttgtataatttacaaattattaatatgtgttcctgctcttccctgtgctatccaaacagtacagattttcttaaatattgtttttgaatcaacatatactgttatcttttattcctttctaagcaatgtgaacaaggaactaaattctggtagttttatatgatcattaattaaaatgtagttaaaatatattttatatttccccaaagaaaggtttcacatacttttcataaatatatattttattagatcattaattaaaatatagttaaaatatattttttatatttccccaaagaaagatttcacatacttttcataaagagatacttaaaacatatgtttaacgtgatcaaggatctctgatcagggaacagagatatagctaattttatttagggattaaataaatgctaatttctttcatatttagttgaataattttagctttgtgaactaataattaaatatttaactttcccatgttaaaatctgctaacatttacaaataacattgtgttttaacaaatcttaaatgaagacatttatgatgtatttaaaagtatcatttattgctgacatcttttacaatggaagcagatttaaatgtactaaggctacagcattcattataatatgaagttacagtgtcataaccaaatggaatataatttgtgctcagcattcactcataagcaagaaataggttagttctgaaacgcctagcatatctgaacaaattctagctaatggcatgcaaataataaagtagcaattaccaaataatacacaatatgtatgtattttcacctaaaatattttaatatttttgaataaaaatttaagccttcttttaaaaaaattatgagatgcaaacattgaattattttaaaaaatgtttacagaatccctattaagtacccaacacagagttaaagactcttaaaaagtgtttgaagaaatgaaagcaagcacactcctcagtacacatagcatatgtgcacatactagaatgtaaattgttagcccgatttgctcaaccccgtgcactgcagcttaagagttgttcaatacatactcattacattgcttggctcaatacactaatctatcaattggtatccctttgcctgctctgttctggaattttttctttacaactttttattgcactaggttttccccgagtttaacaggagtttggattaaccttgatgcaatttttaaggaagtaaataattgaaccacatttttgtgaatttcagcacaacagatggtatatttttagaagtatggcattgaaacgagactcttggggttgagtcttgacttccatcattctcatgatgtatagaattgaacaagtcctttaacatttctatgcctcagtctccttaataaggtgggattaataaaatatatttcatagagatgctttgaggatttaatgagctaattatatgtggaaagtgctttaggaaactgcctgcccatatagcaaatgttatctacttctcatttcacctagtgttcaaattccatgagacagaatgtatctaaactcatagtgtccaagacggaatccactagccacatttgattaagttcaaattaaaattaaaattaaataaaattaaaaatgcaaagacctcagtagcactaattatatttcaagtgctcaataactacatgtggctagtggataatacatcgaacacatccatcactgcaaaaattaaaatttcaaacatataatgcaatagatataaataatctcatgagcatagttaatgggaaataaataatttagaggcagtgagtttgtagtatttgttatagttatttttaatatgatttttatgactacatgttcatatactttaatttttcaaaattactgtgtttcacaacctgtttacaaaattcctaaaaatttaatcagcactagagctggtcctggctggcttcagcacactattgcacctcggcaatacatgagggctcattcaatgtttttttagccactaatattcttctaccatcaaccctaaattctgaaatacataagttacactttccaacttaatagagatctgaaggcataagtggccctctatccctttaaaacatcagcaactaactcttttttaactgaaatacaagtaatggattatttcatatatacacaatatacttccatgaatgtagcctgattatgacaaaatgagggcaaatggataaaaagccaaataaatagctccaaaaatattttgtgggtgaatggggggtagtgatttgtatttaagtatattatgaaactatgaaaattgaaatcaattataaatctagagttggcattatatgaaaaatgtaaattaaaataactaatattgtaacactttaaactgccaatgaatagattgtgtaagttaaaaaaaagagggttaacttaattttgttaaatttaaaaataaaagtttacaaaagttagttaaaacaaattacaaaatttaaaatgtccataaatacgaagaatatttttcaaaaataatatttttcattccttttattaaactacatcagtcttcagagaagtgcaacataaaattacaaacaaattatacataaaagatattattaggtccagttacttacagtatcaaattcctaagagattttttcttagaatatagttccctattgtttcataatgtaacaaaaatattataaaataatttggctctttcggtgagaaagacccctctttttttcgttaaagcaaatgtcagttgtccatcaactgactaatattctatgatttaatttttaagttgaagggtcaactgccgaaacaatgtaataaatgaaataaacttgttaatatcagaagagagtgactgaagtatttaaagatgaatgaaaagtatacttaatatgtatttccccacaataataaggtggccaatatttattgaaatatatcctatgtgccaggctttatgttaaatctctatcatttagtcttcaaccctcctttatggaggtacaattatcagatccatttcctaggtaagaaacctgtggtcaggttcacatacaaaagattttatcttaaggctacttgactccaaagcctgaactctttttttttttaaattatactttaagttttaaggtacatgtgcacaacgtgcaggtttgttacatatgtatacatgtgccatgttggtgtgctgcacccattaactcgtcatctagcattaggtatatctcctaatgctatccctccccgctccccccaaccaacaacagtccccggtgtgtggtgttccccttcctgtgtccatgtgttctcattgttcaattcccacctatgagtgagaacatgcagtgtttggtttttttgtccttgcgatagtttgctgaaaatgatggttttcagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttccagttctagatccctgaggaatcgccacaccgacttccacaatggttgaactagtttacagtcccaccaacagtgtaaaagtgttcctatttgtccacatcttctccagcacctgttgtttcctgactttttaatgatcgccattctaactggtgtgagatggtatctcattgtggttttgatttgcatttctctgatggccagtgatgatgagcattttttcatgtgttttttggccgcataaatgtcttcttttgagaagtgtctgttcatatccttcgcccactttttgatgggttttttttcttgtaaatttgttttttaacgattacattttcacagtaatcgctaaaaaattcactatatttctctaatttttcaataagaaatgtataactgaaaaaattatatgaatttgtcattcctaacccacttagaatatgttatattttaatatattaaattcatacattctgataaaatagattttgatatattctagccactctactaacaaaaatagctggttattataattaataaattaactttacaaaccaagaattgttcatgaagcatttaaaaaacactgaactacatcatctggtttcccaccatgctatcctgccacccgagaactaaggtagttggtgcattaagagaactgcctccctattatcaacatcctctccatagtggtacatttgagtacatttattacaactggtgcaccttcaatgggtttgcacaaatttattatgaaaatagcatcataggactacagcatcatacacaatagtttctttcactgtcctaaaaatcttcttaatctccatatgcatccctctctcaccttctccccagcaatcactggtctttttagtgcctccatagttttgccttttctagaatgccatacagttgaaatcatacaatatacagccttttcagattggcttctttcatttagtaacatatatttaagttttctctgtgtctctccatggcttgatagctcctctctttttaatcctgaataatattgcaatatctgtatgtaccatagtttatttatgcatccacttactgaaggatatctcaaaaattttggtgattatgaataaagctgctataaatatccatgtgcaggtttgcatgttaacgtaagttttcaactctttggggtaaattgccagatcatatgataagagtatgtttaattttgcaagatactgtcaaactgtcttccaaattggctgtaccattttgcatttccaccagggaagaataaagttcctatttctcctaatcctgtcagcatttggtgatatcagtgttctgcattttggctgtttggtctcctctgaatgtttgtgtctacgcccccatttcattcaattcgtatgttgaaaactaaccacaaatgttagaaaggtggggtttttaaaaagtcattaggtcatgacttaggaggtgattaggtcatgaggagccctcctcaattagattagttcccttaaaaacaaccccaggagaaataccttgcccctgtcacatgtaagacaggcacagtaaaaagcctttacctatgaccagaaagcagcttatgagcatatattttttttattatactttaagttttagggtacatgtgcacattgtgcaggtcagttacatacgtatacatgtgccgtgctggtgcgctgcacccactaactcgtcatctagcattaggtatatctcccagtgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgggaattcccagcatccagaaccaagagaaataatttttgttgtttataagccatccagtttatggtattttgttgtagcaaactgagcagactaagcattctaatagtatagtggtatcccgttgttgtttcatgttgcatttccctgatgatacatatgaggcatctattcagatgcttattttccatctgtatatctttcttggtgagatatctgctaaggtctttgtatcattttttaaatgggttgttttcatattgttgggttgtaagagacttttggacattttgcataacagttctttatgaagtatgtcttttgcaaatattttctcccagcctgtggcttgtcttttcattttctttcaagacagtttcctgcagagtagaagttttaattttgtttctgtgtttgttttgagatgagagtctcactatgctccccaggctggtctcaaactcctgcattcaagcaaacctccctcagccttctgagtagccaggactacaggtacatgccaccacacccagctcagaattttttatatttgatgaagtctatcttatcaataatttattttataaatcttgcctttgattttgtacctaaaaagtcattgtctaaccgaaggtcatctacatggtctcccatgttatcttcaaagagttctgtagttttgtattttacattgaggtttatgatccatctttaattaatttttaatgggtgtaaggtttgtttctagattcacttttttacatatggaagtagggtggtataaatatcattcgttgaaaggactatcccttctccattatattgcctttgctcttttgtcaaagataagttggctatatttacgtgtgtctatttctgggctctctattctgttccagtgatctattgtctattattttaacaatatcacactgtcttgattactgcagctttacagtaagtcttaaaatcaggtagtccgagtcctccaactttgttgttctatattatgttggttaatcttttgcctctctatataaactttagaatcagtttgtcaatatctataaaatagtttcctgagattttgatttgggattgtactgaatctatagatctaattgggaagacctgacatcttgaaaatactaagtcttctatttggaaacccggaatatgtctctatttatttagctttttttatttatttcatcacagtttcatagtttttctcatatacatattatacctatttcattagatttatatctaagtatttcgtttttaaggatgcaaatgtaaatggtatacttttaatttcaaattctaatcatttattgctattgtaaaggaaagtggctgacttttgtttattaatcttatatccttttttgccaaaattgtgtattagttccaggagtttttctgttgattctttggaattttctacatagacaattctgccacctgctaacaaagacagttttatttcttccttctctgtatacatttcctttccttttcttgtcttataaattgcatttgtattctttttaaggtgttcccttccctacaaatattgtatcacttggactattttaagattattttaataggcactcaacaagattttgatgaatttcaaaattcctggccttcagtgatatgcttaaacaaagtagtaaaagtcaccaaggaaaacagttctaccttagtgataatgaagaattatctgcaagtgaatatccttttttaaattttactttttaatatttttactttgtaagtacatggtatatatttttttaattttactttttaaattttttaatattgtgggtacatagtacattcttgaggaacatttttaatattaattttcttgtgtattcatcctgtgatttctcatctttcattcatctagaaagtgcatgtatttcaccactccaaattgactttaccagcattttctccataattttcacattactttgaagaaagggagagattatattgatatttaaaatggaaagattgcaatgcagagaggagccacaggattttcccccaagtctcctcaccttctggagacagaaatagtataattttctaatcattatatagtgttctataaatgaaaaaagacaaagcattgtaaataaaagtatatttaccaattcaaatttgagggtaactcttgcttgttttaacccttcttgctaagagtatataatgaaaataaacataaatgtttgatagctgtaattattcctcaattactctgtttgttctaattaaccaaacaatagcaaatatataccatagggaagtcatgagaagtaaaatactcttggaaattttagaacatctctactagttgaaggatgaattgtaacagtatgattgtattctacatacctcacaagaggattatactcttgcaagtgtttaccttgatttcattatcaaataaaaataatttctggtaatttctaaaggaatgttatttcatcagtgtaggtctaagataaatcttaataaaaataatacatcagtttttcttttgctcgtttcagtttcttgagttacttaattagtgggatgaatgtctcgttaccttttgaatgcctgaatgaagaaattgctatttgtgcatccaaaagtaagtttcctgaaattacataccttctaggagatgcttctatgtaattttctttgttgtttgtttccttttgtaagacaagtcaaaggaaatactgagtacatactaatcactgcattcattctttgaaaagaaatatacttgggcttcttgacaaatagttttcttcataacaattagaccaggaacaccaaaagtgagtactgtgtttcaaatgtattaaaaatgataaaaacttcatgtaatgtcaaatttttatttatcaaaattattactgtattagtaattctcaaagatttttttccataattttcatattattaaaatagacattgagagaaacaactggcaggttaaaaatactgtgttagctgaaatcagaatattctttcattcaatttccttttcaatttggtaggtattgtttaggtacctcctatgtcctagacaccagtatgaaaaaaaacatagactctccagtaactagctccctggataatagagcactcacatgtcctaaatatttttaataaactatattactatgtagcctgtctggaacagggttaattttcacaaacgttgctctcagagtatttgagaaggtaaacccacctgaaagagaaattgacacctaagccaaaccttaaaaacaacaataaaaaaaacatatatatattagacagtacttcacctttttaaataccaacactgaaaattaaaagagtaatgattacttcagcaatttattgtgaagattagagtcaatggtgataacttcttgtgatgaatgccttttccttacaaggcactctctggggaacttaatatttatatctccaatcctaaaaatcttcgactttaggtatgattgttcattttctatacaaaggaactgactcataagattatagtctgtgttattatgactaaacaaaggttatattggatatttgataaaccaattgaatagagtggttaaaactgaccaaatatagatgaaaacgttaagtgtttatagtttagttataagaaacttatccaaaatcatatgctcaggacacttacattagcccacagataggcaaaataatctaccacaaagcctgttataagataaagtactgaatatttcatgtaatttatcgcatacagtactgaaagttaaaaataaagtaggtgaatgagtatttgaagtaagttttctactaaatgtgcatcacttttacaccattttaaagtcaaaaaatcctaagttgaatcattgtaagtcagggactataagtcactgttttttagtacatggtcagttttgataaatgttctgcaagtgcatgaaaatgatgcattcgttctatgttaggctcagaaaagtatagatttcttaaatcaatccaataaactttatacaaataaaccttacaaattttgagtaaatttatgttgtcatgtgtataaatgtttatgaatattacatcttttaagagttttttattattatttttatcttccaaaacacgtccttgtcaatattataaaacttttttttacatctttatttttaaaactcaaaataagttataattactctgggatcaatatttaattatattcacaaccatatttttacacattgtttcttttatctttctttccacatttgtttccttccttctaaagaataactcttagtagatgcagatgagaaatctaaggtcagagtaattgtcatttggttttccagtaatttgttttccctttatcttgaagttctgattctcattatccttagtattgcacaatattaccacaaccctgtgtctaggtgaagacctttcatctttcctttcttctggaaaattttccaccataactgctttaaggctcctcctgtgccaatctctgtctctctactttaggagctccccttacatgtgtattggagtcttagaagcttctgaacttctctattaaacttttcatttattcgtatctctttattgtgctctggttgaatactcagatcatatttttactttttatttctttagttctgcaatttatgcctctatccagcccaaaactgaccttttctattgagattgtcattatagtgtaaatttacagtcaactattttttatattaaactcaccgttgatttttttattttatctccttttaggatattattttatacatattaattttaaaggcctgattataatattatttgtgtttcattaggataaagtcaggtaccatcaggtaagtctttaaattatcactaatagattatctttcctaacatagtttctacctttttgtttctcatttacgttgagtgaattttattctctttcggggcactccccctatggctttgtatcaggtgtgtgtggccttcaatcaacaatactcctatccctctctcccactgcagaaccaagtttcttaaagtccagggctccagtccaaggtgattagaggcatcacagaaccaaatcactgtaccatagacacatgcccacaatacctgctgtacagctttctctacttttttctgcagctttctataagcctcagctctgtacagcagttgcacctattttttattaaactttctatgaggtggagctgagtccagtcctctaccatgcaagatgtttttggcacttaagtttatcttagaccactccccagcagaagttagcagagaataacctagtccccatgtttttataccatttctggcccaaaaggtatttatatttctttttcagttcacctcttaattttttttctactttcattaaattttacttatcatcattatttgaagataaatgggtggcttaaatgttaacttacagcatcatgccttttacaagtgattcatgttgatacaataatattgctttatactaccctatattatgagtcatcaaatatttttatgaaagtatatacatttttaagttgttgaagcttaaaccaacgaatcctttaaaactgtaaattggcaacgaaatagtataaatttacatttatttttaaaaactaatgtagaaaaaagtaaccgcaaataattttaaccatgcgatttcgttaaatttcaaagttattgcccccaaatcacggtagcttatttttaagtcctagatattaagatacagttttaaaacaaactaaaatattgtaataaaaatcatctagcaattcatctggccccacagttctattataaatcattgtgccagtaaggaatattttaatagatttctaaagatttttggagaagaatgtcagatatttagtgaattctatcaagacattattcttttctattaatcactgcattaagagtaaaaggagagacacaaatcaaatcttcaaagatgttacttgtatttgcattccagacagacacattttaccagggtaaaaaatatttatcttattagtgcttaatgcatatttttcatctatatcttacttctctcagaaataattcacctttgtgtttgagggttgggtattggttaaagacattcacaaataattgaatagtactattttaaatagaagtagtatagagaaatcccatttaaagtgataaaactttgggataatagggcaagtgtgatatatcattaatctaacaaatatagtttaatctatatcctatttataaatgacctgcaaaaagttattagctatatatattagtaatttttcattatcatgataatttatcttagttatagattacaaaatgaactgatagattttattgatcagtttgtcaaactgtatcataaatgtgctaggtttattcctaaatttatttgtataccagctttcacaaaatcatacttaggcattccaaaataaaataaaactgcagataaacacttaacgcttcaaggctcctcgtcacatagaccccccctttttatttatttattttttgagatggagtctcgctctgtcgccaggctggtgtgtagtggcgcaatctcggctcattgcaacctctgcctccaggttcaagtgattctcctgcctcagcctcttgagtagctgggactaaaggtgcacaccaccacagctggctaattttttttatttttagtagagatggggttttaccatgttggccaagatggtcttgatttgaccttgtgatccgcctgcctcggcctcccaaaatgctaggattaaaggcatgacccaccacgcctggcccatatagaccccttctaaggccttgtatttaaatttttcagtagtgctgtaatgtaatttctaaagaaggaacccaacattttgttatctgaagccccataaaacttaagattcattcctggctacagaagttaaaaaagaaaagacaaaaaaaaaaaaaaaaaaacaactaagccgtatgtgttggtcttacccaacctatttcaatgtagtagcttcatatctaacagaaaaacaaggacttgtgaggtatggtgaccaagtatatttggctagcctagaagatgcaacagatactgctgtggccttacagccagaaaaccagggtttacattgagcgcctctgtctttgactagtaacattacctggggcaagtaagagtttgtgaaataatgaaaattaaaccactagctttgtattccagatttgcctctcactacatgtgaggttgtggaagttaattaatttcctggagtttcctgttactcatatgtaaaatggaaataataacattatttggagagttattctgaggattaatcaagctctaaataaagtactcaacattgtgcaggacactgggagtttatttaacattagctgtgattttgtaatcactttgattcttagtttccttatgtccaaaatgggaaaaaaattacctggtttgcatgccctcaagcgttgtttatcagcatttttgagtgagatattacaaaaatgcactgaagcactatgcaaagtacaatataactgcattttctccttgcctgatacttttctttgcactaaggtctaatcacctccaaaaccatgtgacaaaaattaatgaagattggacaataagtccaaggatgccaatgtaaacctatatgtctcattacatttactacattatttcaattgttggctttatttcctgagaaactacaatgttccctaggacttgtagtaaagaagcagtctacaacaacacacagtgctgatcaatgcccaatcaatgttagtttgattaactgaatccttacctagtgggctcttactacactgggtattcacataagccagtttgcctggggtggtgttagtttactcctgctgtactggactgattattaataatgtcctgatcattatctaacctatctcggtcatttgatcatcttacttataaagcaatcaacataatacacagctagagtatttccaacctcacttttcagtttatgcacaaatactcatctttttgatgactgtttttaatacggggcttgcacttaatatttctgtctccactcttctatttgatagatgaaatttatcacagaaatacattatttcagagcacacctgcaatactctattgttcattagaatacatatgtctatgttctcctaaaatagagttgtagaatacaaaagtttaagaatttcagtgactgccataaccaaggtgaagatatggtagaagtaatatttgctctattaaaacaatcatatactaatttgagtgaacaagttccttctccattcccaattcttcaaaactgtttattatcgtttttaagcaaaacataaatgttgatgtaatttaaataattgttaaatgttctctaatgtagtctcataacacttgacatttttaattgtattagtgtatatttaccagactaatttaactcaaactgtgtctacccttgataaaatatagaaataaatgtttacagtcccttggaatatatagtatattctttctttaacccttaagaaatatcccatcatcatgttattaaggcataagaatagttaacaaaattctgaaaatggtaaatcaagaataaaacaccccatcatatataaaaatataaaactgtagcaattaatacattttgtgtcagtgaatggatgcataaatagaccaatgtaaaaaaaatagagctccaaaccctgccaaaaaaacaaaagcagacaaattcatacatatgatcttactgtataaaatcagagttattacaaatcagtgtggaaacaacaaactacacaataaatggaattgagttaactggctttctgtagagaatccagggtgggtgtgttatatccctagatccctccatcaccacacatatgacacaatgtacaaagaataaactttttaaaaaaagatgaggaagatgaatggtcaataaacagatgagaaagtttctaaacttcaacattcatttgagaattccacattctttgtacaattatttcttaggaaacataaaacatagaccatattcatcaatgaatcagagtgcttgacttgggaagggaatatcatggcctttagcattttatctataatatatgttcaatctaaagcaaataaaacaaaatacattttatcaattacatgaaaaaattcaattttttattttttatttttaattattattaatacatattagtgtcaaatgtgtatggtgtacatgtgatgttttgatagatgcatacaatgtgtaatgatcaagtcagggtaacttgagatatccaacacttcaagcatttgtcatttatttgtgttaatgaaaaatccaattcaattccagatagttaatgggtatgaaaatacacttacatggaataagatctactgttcagtagcacaatagtgtaactgtagttaattatttattgtatatttcaaagtatttattgcattactgcaaatagtatatgctgatacgacaaggattgagtaaagtcaaatgagaggtgatagtttagaaacctgctgagagacaaaaagtaaaataaaaaaaatgtttaaaaacataaaaaaggaaaatctacagatacctcttttctgaatgagtcacctgatttcatctacaattgcttgtcagttccattctcttttttggcttaaaaccacagaaatttcttacatttttaaatatttcaatagtttttggggaacaggtgactttttgttacactggtaagttctttagtagtgatttctgagactttggtgcacccatcacccaagtagtgtacactgtacccaatgggttgtctcatccctcatcctcccacccaccatttctcttccccctaagtccacaaagtctattgtatcattcttatgcttttgtgtcctcacaagtcagctcccacttatgagtgagaacatatgatgtttggcttccattcctgagttacttcatttagaaaaatggtctccaactccatctacattgcagcgaatgccattattttgctcctttttatggctgagtagtattccatggtgtgtgtgtgcatgtgtgtgtgtgtgtgtttgtatcacattttcattatccaaccattgactgatgtgtatttgggctggtttcacatttttgcaattgtgaattgtgttgctataaacatgtgtgatcaagtatctttttcatataatgacttcttttcctctgggtagatacgcagtagtaggattgctggatccaacgttagatcaacttttagtgctttaagaaatttccacactgttttccatagtggttgtactagtttacttcccaccagcaatgtgaaagtattcccttttcaacacatccatgccaacatctattattttttgatttttaaattatgatcgttcttgcaggagtaaggtggtagtgcattctggttttaatttgcatttccctgatgactggtgatgttgagtattttttcacatttttggtggccatttgtatatcttattttgagaattgtctatttgtgtccttagcctactttttgatgggattttttttttctcgctgatttgtttgagtttcttgtagattctgggtattagtacaataaaagtataaaatctaaatataagtaaagtgctaagaggtatatatcataagatggtatatttcacagatatcagaaaaatcttataaaatgtttttgtgaaataaattttatatttagatgtcaatatcataatccagtatattcctgaaaattcagaattgaggtggtaattttaagtataaattttccagctctcattcattttgacacacaaatcctggaagactgggattttttaattttaatatttctaaattgcctccataattttttaatcagtagaagagaactgatttgacatgcagctaattttctatgtaaaatcgttttttttcaaactttaggcaatgggtagaaagatgcattctcatttccttctgcttttccaacaattcattaattaaatttcagaggcaatgagagtctaggtggtctattaaatgtaaataatatataattctttcaaaattccaataaatacacaaatattttcaaaataaaattttcaagggttatatttgtgcagagaaattcaaaaaccatcatgtgactgataaaatctatactaaactattatttcccagttattttattgaaacaatgtcatgataggattaaaatattactagggaaaaaaagtgcctcctagagtgagtcacaatcaccccggtagcctgtttactacatgaacacaccagtgtgtgaaggaaggtggctttttcacactgcaaatgtggaaacagcaaaaggctgaataggaatgacaacacaagatccacccccaaccctgccaaaaaaaaaaaaaaaaaaaaaaaagcagctggcctcctgattctacataaggctatgcatcatgtgatttattccttttccactatggtccctccaaatcacatgctcatgttaaactggagaagaataaggtatgtacctaaccaataatggcagactactgagttggtattttaaaaatcacttataagtcacaggaaaaacaattttgaaaaataccatactattgtaatctgctttcctaacctttgcttaatttggttgaaaaaatagatttgtatttctttaaaggtcaaaaaacaatcattgttttatcaaacaatcaaaatataaaattatttgcatcatattacacttcaacttaaatactcatgtcaatagtagtttgaaagaataacatttcgcattttgtacttttttccgtgaatatcagtgaaaacggagttactcgttttgttgtttttttaacttcctaataactttgacagttgggtaaatttaagtaaaccacacactgacctagggaatacaggactttctaaaatcaggcaccctaatcggccaacccaaaaaaaaggacaaaaagcttttctcagtagttcccacgaggacatttttaatttataatttgatattgaaattacaattatacaaactataattggaatgaaataagcagatacattcctattctaaattccttgattcacttaaaatgcatctactgcagtcctaatctatgcataactcttcattaggtgatacttatggcaagacctaagtgtgaccactctcaaattttagtaagtttctaataaattctgttctgaaggcacatgtctctgtcttaaatagactctgctctgggaatgagtggtagaaccaagtaagagttcccagagggacagtgttcccagagaaaagaattaaaaccatgtgagagtttccagaggaataatgtatttccctgtctctctctctctttctctctctctctctcacacacacacacacacacacacaaacacacacacctctcatgaccagatcaattactaatgatatcattttaattcattttgttttaaaatgctgtgttagttgatatacatactatgtgacctttcacttactgcatctgtgaaagcttgccctggtttaatgaagaggcaatgggtccccaaagaaaagtgaggaggaattcaagtgaatcttctccatcaactaaggattttcacaggtagtaaagatcatacttcgtagtggtcaggtaagcctaatgcaattttgaatttggtaagaaaagaaattaaatcccagaatttattgcaacaatccacaacctcgaattgtttttattttcttattcccaggagctcttctttagaattaacctgtcagaaagcaggaagggaataaccctgatttattactaagagcaaagtgagacttaagcttgaggaatattatgggaagggtcccaaaatgaaagaacacattgtgtttatgctgacaaaaccagatcagtaagtcattaactaaaaatctaggttgacgggcacttaatttgaccttctagccaactagtctccaaagattataaaatcttactatacccttcatataagctgatcatttaaatgatacatgggaattaacctgcttgttgactccaaataggagacgtcagagagcccaagagtgtctgaagaatcaaagtctttacaaatgattcattaaagagaaagccaggatcaaagtctatgggataaacagaaaaaaaagtgctctcattttatttccttatacattttttacccaaataaaagacctgcttccaatctataagttcacaaaatctaatgacattattaatgtggttaaataacattacttagtttcagggtttttgaaaattctctaacattattactcaaagaatacaatgaaatatgctgtatttcaagctttaaagattaaggagagcttcagggaaaataatctgttacagaagatagtcttttcataagagggtctccttgccatacttccacataaagttaatgaataagttctattttcggatcatctaatttatataatttcagtcaaagtattttaataacctgctgggattgcaactaatttgacatatggttttatacacttcctttttgtagctaagctgctgaataaaaataaagtttgttgtacaaaacatacttgagctgtgtgtcacactaaaaatgttgggtatcaacagagcaccaaggattaaagttattttaagatatttgtgcatggtgatggtagtggggggatgtcacgtgtatatcatacatacctcagtagcaaattgctgcaatccaccaatattaatgggtccctcttcagtggcatataaattgcatccacctacacaaagatcagaggttggacataccattccacaagtcagaccaagtgggttgtcagaaaatatcatcttagcagctccataatagttctgcaaaattaatacaaaataaaattttactacttaaaaatatactttaaacagccaaattacgacaaacattatttcttctactaggtaatcagattgaagataatgatgtgtataagatgcataggtttcaatactactatcaggaaccatcaattaaaacttagcagagtatttgacacataggaatattcaatgcacagtatgttgataaatgaataactaatcaattttggaaaactgaagtttaaaatataataaatgttctgtaaatggttttcatttacaagtcatctaactatatcttgtcaaaaattattcatttcactttttaacaaatgaaaattagatggcattgtttgaacaaactcaaaacctaaactttaaaacaacaaaaaatggttatactcaggttatcctccatttaactaaattaaaagcagccagagctttcattatttttggaacatattattttctgaaaaaagaatgaataataagctgaatatttgggagaatgttttcctctaatcaaaaggaagaattgcatctgaccagtactcctgaaaacaatcaagtacatcaaaaacaagaaaagtctggcaaattttaacagacaagagaagcctaaggacacatgacaaataaatgtattgtggtgatttttatgatatactggaacagaaaaaaaagtaaaaattaagaaaatctgaataaactagggactttagctaataatcatatatcaatattatttcattaactgcaacaaatgtaccatactaatgtagggtgttaataataggggtaattatgagtgcatatggaaactctctgtactactgtcacaatttttccataaatctaaaactgctctaaaatacattttaagaatagagctgatagaatgcacttaacaatataaacatattgcatttatttttcctttggcttttatttgtaataattttgaaggtctttgaaagcacagacgttgcttccatgaaaagcctcagacataagtacagattcctagtgattacagaatactgatgataacaaaaaggaacaatgacatttactatttattgactctttaatatatccccagcactttaaaagacttttatttactcttagcaccaattattttatttactgttatcatctctcactatataggatgtccattgctcgatcaaaaattcctagatgcaagaagagacaggaccaaacgcctgataataataagaaaacaataaataaaataagcaaactcctaggtaatcaagaaatttaagtcagaataaaagacttttaaaaataaccttgacgaaaattcaggaaaagaaaagacaaaaaaagaaacaattaataatagcaccagaatactggaatctgtttaaaaagaatcaaactgatattttagaagtaaatgaacattttaaaataaaagctaatgcacggctttcacagcattcgtggtggtttaacagtatttgtcttgttcagtgtcccttcagcaatgaaagttatgtctgccatgtaagaatggttcttctacatatattttctgaatatgcagtaagaatgtggtatgaaattaaactcacaagcaataaaactgaaatataaagggtaaataattagcaaaggatcataaagcagataagtggcagagacaggattcatactaaagcatactgttcatggctcaatagattacagaatctagttacagtgatcttattcagctatggtccatatgttgatgtaaacacacacacacacatgcatacacacacacacaaaagttcttttcaatataagctggaggacatatagctagtccattcgattcattacactttatattaagtagtttttattacatagttcttttagttgtggtctttccatcagttcaatgaaaagcttaataagttaaaagtctgtttcttttaatcaagagattaggatctgtttattcccccaaattggatcagatttaccactgtgtttgtcagagtcttcggtagtgtctctaaaagaggttaataataaatcattaagctgtcaaagtataatatccaaaagtcaacacagaaatatcttacacacagagaagaaaaatgtgtgaaagattatatttacctcattaacaaatacagaataaagatagtaaaatctgagtcaagggcatttgaggctgccatggcttaatcggtgaattgtataaaacatataataacaatttatgctaatttctgacaaatacttctagaacatacaagaaggatttatctcaggaatgcaaggttggtttatatcaaaatataccatatcagtagaataaaagacaaaaaatcacacaatcatattaaaagatgcagaaaaggcacttgacaaattcaacatccctcatgacaaaagctatcaacaaactgcaaatagaaagaaacttcaacaccttaataaaaggcctctacaaaaacccacagttaacatctcactttatggtgaaaactgaatgccttcctccaatatcaagaaaagaatgttcactgcattagtcaaggagtcaaaagttctccagagacacagaaagaataggatgtatgtgggggggggggggggtgtgtgtgtgtgtgtgtgtgtgtgtgtgtgtgtgtgtgtgtgtgtgtgtgtgtgtgtatgagatttattataggaaactggtacacaattaagaacctgcaaatttccaagatctgcaatttgagtctgccagctggagacacagaagagccaatgttttagttcaagtctcagttggaaggcctgagaaccagttaagttttagttttagttctagtccaagagtaggggagaaagccaatgtttcatttcaaaggtagtcagacaggaagaattatgtgtttttcagggtagagctagcattttgttttattcagtcctttaactgattagatgaggctcacctacacttgggagggctatctgctttactaaccttactgatttaaatgccaatctaattcaaaaacactctcacagaaacatccaagataaaatttaaccaaatacttgagcacacaaaggttcaatcaatcggacacataaaatcagccatcacactaacttttacaacttctattcaccatagcacttgaaattcttgctagataattaggcataaaaggaaggaggaagtgacagagtggggagggatagagatagagaagaagagagagagagggagagagggagggagggaaggaaagagagagagagagagagagagagagagagagaaagttatccagattggaaagggaaaaattatttctatttccatgtaaaatgatcttgtatatacaaaccctaactaatccactaaaatactatgagaagtaataaaagtacagcaaacttacaggatacaagattaaaatgcaaattaattgtatttcaatatgttagtaatgaacaaacgaaaaataaaatcaagacagtaattccatttacaacagcaacaaacaaaataaattattcagaactatatgtattaaaaactgtaaaaagttcaaatttatactctgaaaactatagaaaactgttgaaaggaactaaataatacctaaataaatgaaaatacatcccatgatcatgggccaaaagactaattattgggatggtgatactatccaaatttatctaaaatttcaatacaatctctactaaaatcccagctgagtttgcaaaaattgacaagctgatcctaaaattcataggaaaatccagaggatccagaatagctaaaatgaaaaataagaatgaagctagaggactaacacttcctgatttcaaaaattactgcaaagctaacataatcaagatagtatggtactgacatgaggataagcatgtagatcaatgtgatataaatatgagtccagataaaagccttcacatttatgttcaattaatttttgaaaaaggtttctaaggcaattcaattggaaagaatattcatttcaatgaatgatgctggaatatctgaatattcacatgcaaaagaatgaagtttgaccctatctcacaccaaacaaaaaaatgaactaaaagtaaatcatagatctgggggtctgagagggaatggacaataactgctaataagtatggaggttttttttagcggtgataaaattgttctcaaattgactgtggtgatggttgaaactgcaaatgtactagacatcagtgaattgtcaacttcacttacatgaacaaatacatgggaagtgaatacatctcataaaagctgttatgttttaaagcatgcatttaaaggagtgggaattatatactcaatttaataaaggaataattgcataaaatagctagattatatacaaaactaggcaatgacctgtagggcaataaaacataacttttggaatcatttttcttctgaatagaaattgcatctctacttgacacaaagctactagttaacatgtacattcataggttgaatttttaagaataaatacagaagtgagccaatggttctttctcctagaaaactaaatagtacttagttgttcccttgtatttaaagaataccttagtatgataataaaaagacacagtcatctccttgacctgactttctggttttggataattttacttaataataatgaaaatgagcaattactaactcagaattaatcagtctattcctaagcaaacatatttagttcctgctgaagcccactgatctcttcacttagtaaaagcaactgagcaggtcatcattgttagaaataatctcaaagtcactgtcagtattctttcctcctcttatatgacatcacagaaacacttgatgtgattcattaacaaatatttgactgactccatgactcaaaattcccattgtataattagaagtgtccttgtaatataaaaacagtatcatgcaaaaaaatgtgatctgcaattggtagaccacttttaaggatacttggggtaaggaagcacagaaaaaaaaaacataatccaattaaacacttaagtatctttccacaagaatattgattgtttcatgggccccaaattagcttcaagattgcacataaaatgatatcacaagaagaaaaagagacacgtttgaaaaattgcaacaaataaaatatttaaagttatacttatggctcatgatttttctatagctgtcaaactatgagtgtctgatctactactgccatgaaattgtctaataattcttaacactctcatgactctaagtaaaaccctttcactaaaataaaatttgtaggaggttaaaaattgttttaagttagtaaggatttattgaatgtcttctaaatataaagcattatgtgtatgtttatttttttgaaaaaaacaagtatatgcttcctgatatcaagatgctttagcatcagagtaagaagtcatttcaggttaaggtgtccagaaacagcattaaatgggtaacagtcaaaatgattctggctgtgacttgtctaagataagagagaatcatagccacatcattcttgattgatatgagtaaatattcaagaaagttcacaatagggtttggtgtaatgacttggcaatttggctgaggtaattcattcacttgggaaagattattagaagatatatttgaaaaatatgcatgaaccaaattatggaggattctgactggcaagctgagggattactatttaattaaagctttttaatagaagggttccagtattaagaaactaactaagaaaaatattgaatagatgatgtggaaattctcagaaaggaaggggaaaggtagggagcccaagagaggttacacaatgatgcctagaaagaggaaagcataggcatgtttcacagaataaagaagcatgattttgaaaatgggttgaaccaatattaagcaatgattcacaagtcacctttgcaatctatctattacaaataactttgaagaaatggtagataactccattgtttagggatcttagtactcagagccaaagacactcagaaacctattaggaggggaacacctcctcaattcttcccacagataatgtcaagatcagtatcaatttattctctcatagcaagtgggaagatttcttgagtcctccttctacataagaggtttgatttctgttctgtgagctcttcattctttttaaaagtaaaggctagaaaatttaaatttagaagggtactttatagacaccccagcagtctccttctagaaaatacacactacttcaactggttcatgttattcaatcagtcacaaacatttcagtgttccatcatgtgaggaaaaaatgtacagagctatgtcaggagggatacaaaatacatatctgatttttttgtgcatagagatattttatgtacaaaacattaagactttcaatccttctcctaacaaaaatctaaagacaaaaataatatttgaaatgtttgctgttttcaaatcaacacattaggcattgaatgttctttggcccactaatttacccacaatttgcaggtgttgaattttctattagtccttggggtatttaaagcatgtctataggcacgacatgtgccacttaggtgagttaattttaaaataatttaatttctatactttgctttttatttaaaattacagcatgaaactgcattagtgtcattcctccacaatttaatgatttccaaagtcattatcaagaaatggaaaactcacaagccgctaccctgtcatatggtataactaatttaacaaatagtcctatcatattcaagtcttcatatcactacaagattatcaatacagctggtggatttattttaaagtgttcttccttcttccaatgacagttttcacagatggaagcacccttccaagataaactccaatctgctgcatttaaaaaaacacttgggctaaacttcaagaagtttgcatgtgtgagaagggtgaattaacattacttttatttctggctcaagctgtaatggtgaatgtactgatgtacattaattgaatagaaaatgtctctagcaccacacacagaaagtacatgcacacagaacactctttttgtcaagctgtcaccatccctcaatgaacaacctgtgggtcctcagatatttggcaaagaagaatgtagatatattgtgaacagaacacatgaaaattcctgccctcatcgtactcatactctcagaaaaaaaaaatggagatagaagaataggtttgactagctttattctgaaaaattctcttttcatatcttagatataccacattttagatcagctttatacaatatgattcatttttagaactacacatttggttcagtgagcctcgtttaagcctatacatgtaaggaaattaataatcattcttgtagaagataacgtttttattgatcctgagatatttaactggaacaaaaacacaggcacatacaagcacgtgcacacatacacacacgtacacgagctttgaagtcatcaactgaatttgaattctgcttatactatgcacaagcaatatgactggggaaatgtcatatctctcagcctcggtttcatcacttgagacatgaagatcaaaattccttcttcgtcaggcatatttatattatgcattttttaactgtgcatggataagatgcctattccattatgtactatacaatagattcagtgaacttaggttcccactctacccctttaggctttttgtcactaaaaagattttgttaaatgttaatactgtgagtttaagattttaatatttactaaataaatattaaataaatattccatgttaggaagtagaataagaaatacagaaagaaagaagcaaaatgtatgtacagaaaatcactaatctaccaaaccataaaatatcaatgacatgggggcatatgaatggtggtaaattttttatatagaacctatataaattttaagtcacttctattactcctattttctgcatcctatcctccctgctctatttaatgaacttgagaacttacaatcttccccatgagttagtcaaaataacttagtctatgtgtgcacatgtattcaattcattattcatcaaatatgtgagagcgcttttggtaagcactagatatgaatgaagaatcaatattgttgcctctatattgttctagctaaatgaaataaaactttcatctgtatcaaaacccattcttttcaggtaacatttcttttaaagacctttatcaatacttcagcttttttccaattggaagcataatgccagaaagcactttgtacaacagccttttgatgattgtgtttgttaatatatatttgcggtagtcttatatttttatgacgtgtcttattttttcttttattaatgtcagagatcatgtctaatcaaccccttttggctgtaagcatataggcaactacatatataatactagaaactgaactactgattactacttatcgtcttctttttagacagagtctggctctgtcacccaggctggagtgcagtggcgatatcttggctcactgcaacctccacctcccaggtttaagcaattctgctgcctcagtctcacaagtagctgggactataggcatgcaccatcacgcccggctaatttttgcatttttttagtagagacaggatttttccatgttggccaggctggtcttgaactcctgactacaagtaatccagccgcctcggcctcccaaattgaggggattacacacgttagtctctgcacctggcctacttatcctttaatattgaaaatgaaaatctctataaaaggcaaaaataagaaagtgctttatagtttttgaattatcaattaaataacatgaatatatattttaaaattataaaagccccactttatccagggaaaataattataaatgcaataaattttataagaaatttagaggcttaagtttttcatttccagtaagttattaaatttgaagagagaaagaaaaagatgaaatactattttatttagtgtgtagtagagtttctacaatttgcttcaaagaggatacttttctacatcgaaacactaatacaaatacaaaaacaaagatgtcaaagctagtcatcattagagttgaaaaaaaaagcattgggtattgaaagaattctacaatttcatttatgaatattacacagcttgcaagcaaatgagaatctttaagtttgagaaattattgaaaggtgaagattattaatcaaagaatctcatattaatgtgaaatatatatatattcaaacatatataacttacatataaaatgctgaaaactttttctttaatgattatttatgccatgccaaaagacacatgattatttatgccattaaatctagactgtaatatcacaccatttgttctatacaaaaaagtcagactattttgtgcgagtttgctctttattgacgagaatatgagcaattccttaattgacagactgttgtgatgcatagtacagtgtgttattatattctacagtggaaataaaagggtttttcaaaaaagcctccattctaagtacataatttaaacccattaatagcttcaaaatataattagtatcgattctaataatttactttaaaaattttaatttttcaaagtagttttcaaaaaaactaaactcaagtttctttaacatgaagtctattacattatactttttactcaacattcaagacgttaatagcacttacaaaatttggtcatgatagcaaatgttccagccttttatattttaataatatttcataatctgcatactttgttaatatcgatagtatagtgtaatacaaaggcacactgaacaagaaatctagaaaattcaattatactatcaagcagctgtgtcattagctttgctgggtttcaaatttcttttctatacaatgagatgcctagttcaattacattttcttttggtctatattctgttacattgacttttacttattaatattaaaaaatacccaaaatagtatcctatgtgtttcttatacagatttttcttgtcttaatattgtaaaagaaaatagttgtgattccaatttaatttatatatatttagtttttatatcattagtgttttttaaaaataatttaaattttatcaaatatttacaaaagcatatgtttaaatttgtctatactatacacaaccacaaacaatatgatgttactcgtttcatataaaactggcttaagatgtataataaaaatcctttctcatttatactaacatgactcttggacttatagttgtttacattttataacttataattgactaacatttgctttgagcttacaggcttttcaaatctgaacttcctctattaaagcaaaagtgaataaaatcagtgactattacacattgtatcagctgtgattaaaagtaaaaatgagccgggagctgtaatcccagcactttgggaggccgaggcaggtggatcatgaggtcaggagatggagaccatcctagctaacacggtgaaacctcgtctttactaaaatacaaaaaattagccgggcatggtggcacacgcctgtagtctcagctactcaggaggctgaggcaggagaatggcttgaacccgggaggaggaggtttcagtgagccgagattgtgccactgcactccagtctggcaacagagcaagactccatctcaaaaaaaaaaaaaaaaaagtaaaaatgtaaccttgtgaagttatatatatatcaaaacagaagcaagatacatcttatataagcattaatgactcaatagataatgttatatccatctatccttttcacaccatacattcaattaagatgtgatattttaacaataataccccagtcctttgtctttaactctagtaaatttagtattccacaatttgccagattcaagactaggaagctatttattaaaattaaagtctggattctggaaaatttagttaatagttacattaactacagtaacattagtaataaatgaatgagtcaaggtgggcatacatttacattaataattagaaattaatattttattatagtctgaacatggtgctcaatatttattctgtagaactctttcagtttacaaagctagttttacacgcagaaaaaagctaggatactttgaaaataactgtaatgtcaaggagatgcttttagttaataacaaaatatactacacagcaaagaaattaaaacagcttggtcctgttacatatagataggtaggacaaagaagatttgaaaatagatctaaataaatatggaatcaaataggcaataaaggtggcattagtatactagagtaattattcaaaaaacatatttggaactattttagcaatctgggaggaaaatcttggtatttttctcactccttataccacaatgaaaacttagaatagggtctgtcatgtgctattgtgaaacctctcagctttactttatttaattttactactgaattttaatatattgtttttattataaaacgtatgttcattataagaagcaaagtcatttagagatttataaggaaaatgttagaaacctaacttcaccctacactaacctcaatcaaatgaagaaactaaattacatcctccccttttttgtttatatacagattaaatttttttctaaaagtagtgtcatactattcacattactatgcaatttgtcctctttcacttactacaaatatccttttagaccaataaatataaaatgcaattttaagaattgcttcttaaccttccataatataaatatagcctaatagattgagctgatactaaagtattcacccgtttttattacttcaaacaatgctataattgctttaaataatatatttgtatatgtgtccctttacattgtaattactttatttctctaggtagaacaaattaataaagcatgctggtgaaacagtacatatatttttaattctcaaatatatatccatcatatcaaagttctttccttcctgctgagtaacacaggggtttacttttcaacttcaacaatttgatgagagaaaactggtatctcattttttcatttacatcttactgactaatatgcaagcaggctaattttaatatgattaatagtcacttatatgacttctataatagtaaaatttttgcctatgcctgcactgagttatccttctcatataaattttcaggagctctttgagtaacaaagatgttaacacttggactgaaacatgcatggcaaataatttttcacttggtttcaagtgtggttagtttttattttaaaatatatttttaaaatgcaggtagtaaaatgtcctctcccatattttatagctgcttgtaattaaacttatccttaaatatgtacttttaatatctaggttagtccacctgaaaagaattctaggagataacctatgaaagattctaaaagtaaagtcaaaattattccagatctacttattgaagaagtaattaattttccactgaattgaaatgtcctccttattatatattacacactcatatttacttggttctatttatagactctcatctgtttgagaaatgtatattccagcaccaatactacattgttttgattacagtagctttgtagtatcagtatctgatataataaatcttttttgtcttcattttttaaagtttctttcttccatatatctccccaattactactcctatattttcctacaaaatctctgggttttttatcagtttagactatccactcattgttaaatatctaccgcacttttccagggcatattgaaaactaattatctgccatgactcttctaattagaaattaaaattataggaaaatagcttttaagtcatgaataggcatgtccaaggactgaaaataacaaggcagtaagtagaccagagaaatcagtgggaatcatcttaaaggcatttgccaaaccatgtaaacaaaggcttctgttttaagggtctccaagcatataggttttagaaaaaaaagctcaaggcccacctaaagtctgagtctaacataagactcaatcataaaactaggattgtgtaagtccacatcaccagaaagagaaattaaaattaaccccacctaggtcccacctggaactgcacagaaacttttcagtcttaaacttgggtacacaagaaaaagagggaaaataatgtccttagcaaattaaatttatatttgtatttttggtctgattcacacaatcttggtgactcgaaaaaaaacattaagtgaggaatttagtttaaggtggtcccagaggactggcggtaaagccactgcctgagggaagcaaatataaatcccttgtaaagaaacatgcatgcttcacagttctcagagaatttcctccaataaggcatcaacacaaatgacagagtaaaaaaataataataaaaattcaatgaacatacaagggaacacaaagcactcagtggaggcaacagatagcacagacagtatcatcagactcgcagagacttttaatagtaaaattgacagaatatgaaaacgaatattttaagttttaagaaataaaaggcggccaggtgcggtggctcacgcctgtaatcccagcactttgggaggccaaagcaggcagatcacgaggtcaggagttggaaagcatcctagctaacacagtgaaaccctgcctctaataaaaatacaaaaaaaaaaaaaaaaaattagccgggcgtggtggcgggtgcctgtagtcccaggtactctggaggctgaggcaggagaatggcgtgaacccgggaggcggagcttgcagtgcgcagagattgcgccactgcacttcagcctgggcgacagagcaagactctgtcataaataaataaataaataaataaataaataaataaataaataaaacaataaaagtcttgaaaagattaataaaaagctggcagattagaaaaaaagcacaaaaaactcttagaaatgaaagatataattgtagctcaaaactcaatggaccattttaacagcatatttgaaactggtgaagaaattattagtaaacttcaaaacagaattgaaggaaattatctataataaaacccccacactgtaaataaaaagacaaatgtatgaaacctaagagtcattgagaacaaagtaaaaagatttaacatgtatctaataagagcttcataaagaaagagagacagtgagatatttcccaacatgatgaaagaaatcaatccagtttcaataattgcaaagaaaaataagtaggacaaataaaaagaaatatggacttagataaatcatggtaaaattgtttaacatcaaaaactaaaagatctttaaaacagcaccccaaaggcatattaacctcaaatgaacaataattagacttccattcatttttcaatagtagcattgtatgataaaaggccccaaaatggtaagttctatgaagtggaaaaataataataatcattgccaaccctgaattctataattagtgaaaaaacttttcaaaagtaaaaaaaatggaaataaaaatagttcagaaacaaaaattaagatagtctggcaacaaaaaaaaaaccctttctgaataaaattttatttattccaagtagaacggcttccacatggaaattgcaacactgaaaaaattgacaaaaatatgaataaagctaatccaatattgactaaataaagcaattataatactctcatcaaattttaaaagagagaattaatatccacagaacgtcttgtaacgtggaaagaggtaattagaattaaacctcattctatgacacaaaacccactcacattgatattctaaatgacacaaaccaacccataatacataggccaaaattggcaggtcatctgtaatgaaaactggcacgagttcagaattacttatttaaatcacatggcatactcaactcagcaactctgcaggattatggcttgtgtaccctctaggaatataacagagatagaggtgggggtgtgtgtgtgtgcatttgtgtgtgtgtgtgtgtgtgtgtgtgtgtgtgtgtgtagggctttattaagatataatctacatagcatatgtacaccaattaatttagaacactgatttttgaatcactcaaaaaagatactccatcaccactagtagtcattacccacttttataaaatactcctcacctatttttgcccaactctccaaaccgagtcccaggaaatcacttatctactttccgtttctatatagttgtctattacggacattttctaaaatattcctcctaactgtaattctataactttggagacatgctggtcaaaggagatagaggttttgttttgttttgttttaaagctttgttctcttgagcactgtcttatggcagatagataagtcaatactctttaaatggatagaggggtaaatacttattatccaacaataaagatgaaggaaatgacctcctgtaccaagggaaacctgaaatcttatcactactttttgttgcatatatctaaatcttcacattttaaaaaattactgggttataaattacggactttccaacattttttcttccacttacttctttaatataatagtgggagaaaccccaatcaacttacataatagattatgtatttggacattagtttctaggcactggggagtaactacagttactgagcaaggaagtcagaatttgagcaaagctttagaaagttattctggaaatgatcaatattttgtttgataagagtataaaccattcagccattgaaactgaaaggcaaactggaaagcagaaagcaccaaatctattggttacatttctgcttttctgctttgtaacagctgtaatatgtgtgtgtgtttgtgtgtgtgtgtacaatatatgtacaatatatatccctctcaaccatatatatatacacacacacatacatgcatacacacaaacacgtatcaatgtaactttcttataaatgcaaacattattatcaataatttctgctgcttcgattttgttgtttctttaacttccagttacttttaataaggatctatcacaaagaaaaacttttcttttacatcgtgtaatttagtcagcttttctgtaacacatagtatacatttatttatctatacacaaaagccacactaatctgattacacagattttataaacacatgcaaaatcatggaaaaatcgatggcttacactttaaaagttttaaggagaatatatctctattgttttaaatacaggatcacgaaatcaaggaacactgtttaaaacagccatttatttcactatatttatagactgatctcatgcattctcatataaagtagtgttttttaaaagaaaacctatcaagaaatataacccaggattcactgtttgatgaatctgaaatgtgtacttccaattgagagatacaattgcaaacaacagcctgcacaaaccaaacagagaaaaactgactgaggggggacaatagaattgagtgtacctttcaaaactagagctgtaatccagtttgtaagaaaataaagaatggaagtattggcctaaactccactgaatcacagaagcctaacacaatacaaaacaagtgacatccttttctcaaagaggcgcaaggctcattgagtctggcgattcaattaccctctcaacctggaaagaacacccctcctgcgttgaggtccactggcaaagcaatgtgggacagcctacattgtacacagctggtaaatatctaaaaagctgcaggctttaaagaacaacagtctttgaccttttatgattgctacagtgatccttcaacaaaaaattaggagagttttttttttttttgaggtttgacaacatattatcttctcaattaatcatcttcaaatctctcatattcatataaaaatcttttaaatagatatctaagcacaacgttccattaggtaaagaatatgaacaaattaatgaaacagaaagtggatttccaaaaatagagatgactgtgatcttgcttagacattttgtaaacctaagaatcctttttgtctttttttctatacatttgtgtagaccttgaataaatgaagtgtgtactcataaaataactactgattctgaaatatctatgaaaaaattggggtagcatggatcttgtaagatagtccgtcataattctcatatttcctcatgcttgatatgaagagtgttaacttagatatatttttagcgaaaatactttagacttcaatctttggattctccttttctgatgagatctttattaaaaaatgtgattttataaatagcagtttacttcaaaaacagcaatcacttctatagtatttaccatattgaatgaatagggaaactaataattccacataaaaaattgttgagtaatcactatattagacattttcacataaaaatattattcagtttatactacaactctgtaagatagatgctacctttccttcataagtgaaagtaaggaggtaattacccccagtttcacaataagcggtttatctaaaaattcaaaccagacttcaaatcctaataaatctgacaatgcagatttaaatctgaccatgcaggaataatttttaaattctttcaagaccctaaatttatataaaagtatttatcatttttctcctaaattatctaagtacttgaaatattaagaaataaactttatacgtaaaaaggcacctggttgttgaagaacgaggagttaaggtatctttacagcattttagaaaattagtgttaaaccttgtgaaaggattctctgtatctttatgggagacattgttcagcctttgctcatccttaaaggattagacacttgggcgagctctcaatgctctcttcacaaaaacaataggtactatcaattattcaatcaatcaaccattcacttagtgaatgaaaactgggcttagacttacattgatttttaaaaaaaaataaagatcaaaattccttttgttctactcatgcccatataagccttttcttctaattttagttgtgtattttttttgctacaactctatgagtcattatgaattatttcaagtcttaaacatattaactgaattttagttaaaaaagtctattaccttgatatatctatgtgctagacttactatcaaagcacactttcatagatatttcacaaatcataaatgtgttttgatgatcaatgacagttcttgtctattagtatttagcaagcataaactaaaatcaatcttttcagtgtcttgaattttaaaaatcattcattttaacacaaactaattttcaaaacaaaaaacaatgaacctggattttcatgataaatcacaacttggaagtgcttaattaataaatgtgccacatttttaaatgcctatagaagtcatatttaatggtttaactggatttgctaagacaagctgtattctgtacccacagataatagagaacaagatcaaatactgttattttcatttgcagagttaaatctgaatttaccttgtttgcaatacttgtgatgaatgatttaatatcaagattagttggacagctcttctgacacggggcatctgcacatttcaggcatctaggaaataaaataactatgttaagaaactacaagataagtgagataatctattttctaccttatactcattcagagtccgtgtctagtaagtataaataaaatcgtatcatttttaggtacaaaacatttttaagcaataaatacaaagtttctgtgtttcatctttggcactcctcttgggatgcataaatgagaatcatgctggctagtaactgtccctcctctcagagttccttcttgattttaagagaatcatacttatttaggacataccattccctcactctatcagttttgtttcatccttcactatgctgacaatacttgcatgcagttttttatgataaggtttgtaattcttttagaccaaaattattaaacaaatgcaaagattaaaggtaaagtcttattttaccacttgaaatatcctttcttccactcttccttcctcccagcttccctctctacctctctctctctttccaattgtctgaagtctttcagcctccatcccattcacaggacaattgagttctgtaacagatgcctcaaagcatagcccagatccatacccttcaggaccaaagctttattcccacagctgccttccctctgctgctgaagagaatgggctccaacaaggtcagcctcctttccagtagcagcacacatacaattcaaggtcagtgagcggggttggaggctctctgcccattcccatatttggggaactagtctgcaaggagccattgaagcatttattgtgactatttgctcagtcccacttccttcactcttctacagatgttaacctgcatataaacttcctgcatattaatctcatctgactctcctctccgggggactggccagagatgtattcaaactttgttgcacctaagaaccacctgggaagcttgataaatggcacagacttcacagaggagcccctactgagtccaagttactgacctgggaatccgcattttgaaaagggcctctgaagtgattctagtgttcatagttggaagcacattgttagaacaacattctataattattcattcaggacaactaaaaccaatggccagactcatcctttatttgcacattaacttatgtgtgtttttcttcatttattcatttatttaatacatatttaataatcctccattacatagcagaccctgggatatgagaatataaaagtgttggaaaaagatcaccatggtcctgccatcatagaacatgcagtttgaatgaagtacagacacagaaaaagccacacactggtcaatgtggtcaatgagaatctgggtgaaatatagcatgctaagggagcacagatgaaagacagtagtcctggagggaggttgtcaggacaggcttcttgggaggaataatattgaaatagaagcttgaagaacgagtggacattaggaaagcaaatgacagtgggattctgagtgcagggtcactcaggataattacccaagaatagaaagagtatgcaccagtgcctggaaagaaaagaacgtgacaaggtaggtgaactaatgaatttggtctagcataaagtgagagtgggagtagaaagaaatgaatgtggagacagacaactaaagaaaatatactactgccacatgtgtcagaaaaacagcattctccaagaatttcactgagcatgaatcctacattgctcagtgacaaaggtgactagctagttcattttctatacacttccatgtgtaaagaccttggttcatttccttcatgaaaacaataccagtctccttgtcattcttttgtgagtaagagagccctcttcattgtctgaaccaatttctcagtgcctaattaatatcttgtttttaaatctgatctcttttctctggtttgtgcccttagccttctctctaaattaaattttacacaatgagtaccaaaggcttttcataatcaattgtcctctctgaaatgtagtcattaaacctcttccctatcatttctctaaatgccattgttagattcacatctatcatttagttgaattcctgtctgctcatacttaacgttttttccccgaaacactattgttgagttcaaaaataatttcttcgaagtataatctgcagcatacattgcaaacaatacaaaaagctccataatgtatggcctatttggtccttgatgttaaaatgaggtgatatttatatgtgtaactgtcatgtggataaatatactgagcattaatagtggtttgaaaggattttcttttatgtcgcaatacaaaatagctaaaaagtaaataatatgccaacttaaatgtcaccttattgttgaaaaaaagtcttttaaacagttgtaaaaatatctgccatcacacaaaagtaagcgcacacacacacatatatggcacatcatatggattctggttatctctatgaagtcacaagttttctgcttttcttttttctaacacccaacttgaataataacacaattaaaaaataaagttataatgtcagcagatataagggaaccaaattaatgtgcagtgtatttttctgttcttccagagaaatcttatattcaacataaacagattcacttaacagtattgacaatgtaaggatttttagttgtggttattaagcctctttaccaaataattctccttttattattgagctagttcacaaataacagctgttgaaaatgtcagatgttaatgaggcagggccacgcaaacctgaattgtagcattcctttttcctttggtgtcatgaatatgccagaatgggcagactctgataataataccatcttgcaattctctaagcgctctgcagactaaagtgcatcaggctgccattaatcccacttatcactctgacagctcagtaattacactactgctatagccaggtagtcctaataaaatatcaaccactgcactggaatgcatactggtgagatgttttattaaactttgagcggtgggggttgatcatcaagtgacattagtgttgacctatttttctatttgacaataaattatcctttgaccatgccataatagatattacagagtgcatttactgcaccaaatcagaaaggtactgcattacaatgatataggcaaatggtgtaaataaaatagcagaaatgcatgtcagaatgttattacctaaattgctttaaatgattgataccatgaaaaatcacagacacagtacttaggggaatatgtcaacaattatcgtaaaccacagttccacataaatttctccttaaaagtaacatttaaattacacttgttttcatctttagtcatttaattccccttttacctttcaaagttactctgttatagtgcagtttatttttaaatgcataagcagcaaaaattaattcagagaaacaattatgtcatacattttcccccaaatagttgttatacataaagaagtatatttgatttttttaaactacaagaaaacaacttagagttttcactaggcatacactttttaaattttcatatttaatacaaagcataacaatgaatttgtcgaagagcaaaatatagaatacttaatcaatgttaattttttataatttgacatgaacataaaaatgtatgaaaacttaagtactgttacttaaaggccaaaaactattaaagatatatttatccatgatatttctctagagaaagagaaacatgattcctcttcccaaatatccgtgaggctagacagtttgactccatagtatgacaccaaaaatattatagtgagtaatgaaacaagcggcatttcattcttcacacatctgagaacagatgcctgcttcttttattggtaaccatccacagcatttggaattgtaacctatgcttgttaaagaattttctagtcaatgagtttaaatggctgaattaatttctttctcagataaaaaataataataaaaaaacacatacacacaaagctatctgaaacccttaaaactcacattgcattgtcttagctttgctagagtttggtttaattgagtcagcatggtttcatcaggctatgtaaatatacgttaatctatatataatggcattaagcaagaaagtattcacattaaaaattaaaatattttcctaatattaacattgcatttccttagatatttaatgttctacatcatcatttggaaagtctacctaatttacatgtatcagatggattcaaaaccttgtttccctaccctataagcaccagtgtaggaaaatacataatttaatatcttcctcagtggtgcaacatgtctactgaaaactgagcagaatcaactatcaggttgaaaagaaatgtgaataaagaaatcaaagttggaagtgtcatacatgtatgagttccacaacttttatcctttgcttccagaccctatcataataaaggagacaagaaagatggctggtatctttaaaacatgataggactaactccatgttctgatccattaagcagtcaaaacagtcaaaagccatcctcagcttccaataattatctgcctatttatacctctgtgcttctcttaataatccattaacagcccttcctatgtacttctgactctgcttttctgattacaccacaggttcttaatagcttagggctatctggaactaactttgaatattcttaaatatgcatcttggctcagcctctattatactgagctggcagctatgataacatcaatgaaaataactgaatttttaatgctgtgcaccatttgccttttaaccacacctgtgatgttcatgttttgaggcttttgatatttatttgtatttacaagttaatgccaaacataattttaaatagctatttatctactagaaatttccttttgcacatgggtgcttcaaaacaattcaagagaagcaaatttagaacagaacacaattcacacaactgatgctcaaaattatttgttggatgataataaccaggaagctgggaataaaacacagttgagaactttcctgtaagtattttctgacgtctatgtcaggggattattggttttaccatataatagctttaaaatgtatagtttatactttttgcatattttgaattaaatgaagggacttacattaaattccatacacattatttatcttcatccataacagattcctaaaaatttataagactacctctatctccacctcatagatgaggctccagtcatctcccgtaagcataaaagaccagtggccaaggcagtggaggaaataactaaaacacatttagtatcttacacccaggactatcccatctacgtacaaaaacaggttagaattttaaaaggtggtgttctagtgaccccatctcttgatgacatcagtgcctccttgccagagtaatttgaagactgagaaaaaagcagttaagaagtcacagctagaaaaagactacagtattatctctcctggagtccaattttagtttaggaaaaaaaaagtgaaaggtagtcttgactgtctcctcaagaggcttctcaagtccagatgaaaaggttggagttttacagtatcacatagttttgaaggcttacccaaccttagtagtcattgaggcactatgactcagagaaggaaagtgacttgtcctaaatcttcctcagagtttatggcaagcttttctaactcaatccattgcctattctagtctgtaacatttattttcttctaattcatatgctattattaggaagctagttttattacaattttaagcaactgtgatttagctgtttgtgctggaaacatacttttattagcatattcttattaaaaattaaatatgctacaaaatcctcaatagcataagaaaccacaaccccaatcaagtactttgtgctgtctcacaagcaaataaaatatcttcataaaaacttagtacatatcaccttttataaaattttaaacaaagcttgtcctattttactatacacgaaaaatatacttatgactattaaagactgttgctcttaaacgtatttgtttcgctttcttaccctggaagatatctggataaagaagaaaaagattaaaaaataggcttttggtatacagtggtggaatacgaaagacgtgatggaaattgtatacattaataactgcaaaggagtcattggaagaaaatacacacatcatgaatacaggtacagacagttataaccaggaatgaaaagagaacagagcccatatgaagaaagtagcgtcagtacttaataatttctgaatctactggggctctcacttattggaaatataaacgatataaaaatgaaaagatttaaatagtaacactaaacaacaatgaccaaaaggccaaaagaaaatgttttttgttttttggattttttttgttgttgttagtggtgtgtgttttttttttgttgctaaacgaatgtactgataattatgctgaaaattatgggattgaatgaaattactgtaggttgcagcatgaaggaaaagtgtcccaattctgactactctctgttagaaatttatttatggagcataagatcatggtttataaactgaattcttaaaactgaacaaaaaataagttattaattacaactattagaagtaattaaatattagctattcaccagtttttatatatcaataatacagaaacagtaacagtaaagacaatgaataccagaaaaaaatacgtaaaagcattcattaaatgttttcctgcccagtagatatgttggcactaaaatagctgatataatttgatccctgtcacctgcagctacaagtgaggtacactttaatcaagaaaaccagagaataccatagataaaagctctgctttatgtcctggagggacgggcttgttggcgacactctcctaggaagccattctttattcaccttaaagatggtggggattgagagtatgtacttaaagggattgaggaagatggcaagattcaagaagatcagagtttcctctgtcttgtagtaatgaggaaaatagtgataagccatgtacctaggacaggatgctttatagaatgtctatatttagcataagtcagtcagataatacatagcatatatgtatgtagctatgtatgtacatagcatatatgcatggacccagactttcgtgtatactaatattaagtgctcaaatgtgcttgctcatccaaggcctttaagtgtattaactcagaaagcgtagcattgaggttaagagtacaagtgctggtgcttgattgcccatatttaatttttgacttcactttactggttttaacacattaggcaaaggacttaaactctctgacatgacttttctcatttgcaaatggggataacttgtacatcaaattgttgcgataatttttaaagattatacccttatatgcatttctttagtaacttaacaggtattctctacaatcttcaatatattctgaaacttatatattgctttctcttctttaatgtggaaggaattagtgaagagtcaatgtataatgttttataattatttatgtacattaaacatagtagacatctgacaaacatatacatatgctttaagggttcattttctccatacgggatttcagaagaaggaaaagttattttcctctcaggagaaccagagacgccttcttagatagagaaacttatgctgaaagttgaggaacaggtaggttttgaccatgtagagattagtataatagatagatagaatgaagatagattatgggttcatccaggacaaagagtataatttggccaggcacggtgactcacacctgtaatcctagcactgtgggaggccacggcgggcggatcacgtggtcaggagatagagaccaccctggctaacacggtgaaaccccatctctactaaaaattcaaaaaaattagccaggcgtggtggcacgcacctgtaatcccagctactcgggaggctgaggcaggagaatcacttgaacctgggaggcggaggttgcaatgagctgagattatgccactgcactccagcctgggcgacagagcaatactccatctcaaattaataaataaaacaaaagactataattcatctttggttctcagtgcgtatcctattagcgggcacatatataagtgctcatacgcgtttaagaaacatttctcagtcactgtacttcaggaaatcaaacaacaaaaatacatgtcaatctcatcagtggtccaatattatttacagtgtactgtatatggaatcctttcttcttgaggcttttggttgtttccccatggtaatggtatgatgtaaaaaatattcttctaaaataattaaattaaaaatgacaggttggacaacacaatgtactgtgaagcttctacttttgaaaatggctacattctagctaaaaatgtaattgatccttattatggttgcatatgtttgaaaagtatctgaaggatgcaactggtaagtatgagaatatatgtgacaaaagacgctttcctttattcctgctccacacattatctctagctattctgtacagcctatctcccttccctttctcaattgttatctaatgagatggcaacaaaatatttctcatgttccagggtaaggcagcaaatttccgtgacaaaataggctatccatgtacaaatatggtctatctttctgtaagttctgaaagttatacattgctttctcttctttaatgtggaaggaattagtgaagagtcaaagagtaatgttttacaattatttatgcacaataaggatagtagatatctgacaaacatatacatatgctttaagtgttcagtccaaccatttttacattttgcactggtcatatgaattgactaggcaaaagcaaaccaacgatactcccatatatgaatttcctttctcaaaatccttccaaagctttacaaagaattcagttaagagttttaatagagaattttaaagagttcagttaacagctttaacagagaaatacctatatcttatataccacattaatttaaataagtttacataaatgcaaccacatatatccataatagagaatagttatgcatttagttaacacgtagccatattctgaagcccaaggttcagagtattttttacagtccaatcattttatagttaccatttttaatttaacaataacaagccatatgtaatttttttttgcaaaccaagatattgttccctgctcaccacaactatggtttccttcatattctagacagctgttacatgatgctcaatacacttttgatccttcacagaccttgatgacagtactaacagtttttattatagcttttctattgcactgtaatcttatttcacctggaccatttccccactagcatcataaactctttgatttatatcaaataattattccaggcttcatagaaaaaaaaaggaattattttgtgttgcatattcacatgctatgcaaattatcttcttaatttttgaaacacctgttgtatgtttatcttaatttcaatgaagctcctttagaaaactttaaaaaactaatatatatttttcatagatgccctagaagtaaacctctcagcaaacttcaaaacagagaaagctctatattttatgacatatttgtgggcaatttcagaaataatatattagtaatagtaatctgacatatagatttagagtgcatgtaccctagaacttaagataaaaataaaaatttttaaaaaagaggtgaaaaaggaactcaaattgttaaatccataaataaaataggttatttgttcctatacaattcctagatgtacggaatatgtttgttatgaaaaaaacagtatgtagacaaatatgtaaacccatcttagggcatgtggactaagatttgggatagattttacttttcacaatgctatattgtttgcgttttttgcaataagtaagtataacttacgttattaaaaacaagacatagatgttgactaaaatcacattatcctaagtaatttttactttttgcactggtcatatgaattgaccaggcaaaagcaaaccaatgatactcccatatatgaaattcctttctcaaaatccctccaaagccttacaaagaattcacttaagagttttcatagagtgaccataatggatattcaatttacacaggtttgaactgctgggctcaagtatacatgggcttttgttttcaaccaaacaaggattgaaagtgtagtatttgtaggatacaaaatttgtctatatggagggccaactgagggacttgagtatgtgcaaattttggtatatgcaagggtcctggcaactctctagcatataccaaaggatgaccatatttctgagtatttggtggctcataaagctaccataaaaaagggctgaggtggatgaaaagaatactgagtgacaatgcaagtgctggaggcactcattcattaagctgaaacaatagtgaaaaaaagtttggccttaaaattaaaagacagtattcatcaataatagaatcttgaagtaaataaatgtctccacatattagctgtgtaggtataattgaacaacagaaataattcaactcaaaattattaaaaggttctgtgttctaagttctgtgctggcaaaagggaggagttactggaacctacttagaagaggatgacttaatatactggacacatacttcatggagagggctttcaaaatatatatatatacacacacatatatatacacatatatacatatatacacacacatatatctatacatatatacatatatataaacacacacatatatatacatatatgtgtgtatatatacatatatacgtgtatatatatatgtatacgtgtgtgtgtgtgtgtgtgtgtgtgtgtgtgtatatatatatatatatatatatatatatatatatggcaggggacagtggctcacgcctgtaacctcaatgctttgggagaattacttcaggcctgggttccatatcagcctgggcaacatagaaagaccttgtctctaccaaaaaacaacaaaaatgaaagaaattagccatgtatgatggtctctactttagtcacagctgtaggctgaggtaggaagattgcttgagcccagaaggtcaaggctgcagtgagctatgatcataccactgcattccagcctcagtgacagaacgctgtctctaaaaacgattttttttttttgagatggagtttctgtcgccctgactggagtgcagtggtgccatctcagctcactgtgacctctgcctcctggattcaagcgattctcatgcctcagcctcccgagtagctgagatcacaggcctgtgccaccacatccagctaatttttgtatttttattagagactttcaccacgttggccgggctggtgtcgaactcctcacctcaggcagtccgcccacctcagcctcccaaagtgctgggattacagctgtgagccactgtgcctggcctaaaaaaagatttttttgtgtgtgtagtttttttctttaaaagtgcaacagtgattgccattattatagaggatgaaatagcacatttggaaagcaatgtccatatatgaattgtcttcctcttagaactgttgagtttcatgtgtgacatccatacaagtttatttggtagttttattccataaaaatggtgtcattctcccttttacaaaaataaaaagtaaacctacttcacacacacacacacacacacacacacacacacatacacacatacattaaatttaaattcaatttaaatttaaatattcattcattttacttagctaaatctatgttgattacgccaagtgaaaggataatttattcagcacgaatttttttctaaagttttaatgcaatcctggtgatctttttaaaatccctgtctgatcacgacattctccttaaggggagaatcttggtacaatattatctctgagcctcggcttctattgcatttccacagctacagctgcaacacctgcctgatgctagaactctgctcatagttccatgtgtaggtcattttcaaactgtgcattccacatgctcttccctttcctgaagagccacacttcaagtcttcatccgaactcagctcagatgtctcctgtgaaaccccctggctatcatgcttggagccattctgatctctctaatagcaccccgtgggttcccttatcaaagcaattatcacattggacagtaacagctgattcacttttctagtctatcttctatttcctcctccagtgagaaaatggttgggttcctctgtctttgaggttagtctacttggaaatagattaatttgaattcagatgaaaaagccagaattttggcaataatccagtttttgtacagttaatgtttggtaaaaattattttttaataaatgttcttcaaatttatgtaaataacaaatctttataatttaaacattatatttaatttatttagtaggtatttatgcaaggggttactatatgctagcactgttctgtgtgttttataaatgttaactcatttaattttcataatcactcaatgaggtagatataaatattaactcctatgtttataaaaacccaatgagatagatactgttgttattctcattctaaagaaaaagatattaaggcacaaaatttgctcctctgatttaggtttgaaatatgttactgcctatttgtatgatcctgataatcatcaagaagttaataaagatctcctaaaaatctataattctggttatctctgccatttcctcagaacagagtatggtgacatcaaggcttgtctcacagtttgtgaaaggcagattcaggactcttatccaggtttgacttgctctacagaccagcctgtggggatcatcatttcatttctgcaatagttctcataatgatagccagtaatcccagagaacttgagaaagtttcctgaaataacacattaaaaccaagcataacatagtcattactatatattttatatatgactgaatttagaaacaagcaaacaaaaattcctcatttatttactaggaactcagcaataatacttgcagatcatgtaattatttacaaagcattttctcgtatgtaaattacctatagaaatcagtaagaccaatctttccagtagaaatactagacaaaataaaagcaattagaaacaacatttataactatcagaaatatgaggcataatagatacaataaaaatatataatggataaaataaaaatacatatctaacttatataactttgactctaaactaattatgtccctatccagtatctggaatattatataaaatgacataaaagtagctcagaacaaaattgtccccattaaaactattgtgtgggaccactataacctcatgcaagcttttgtatgaaatggcttaagacatgacttttgttcttaggcatttaatgcctaagaatcaatgctgatgttgcacataaagaatatgtggaaatttcaggaaattaatgaatatgggtgaaaaacagataagaatataaatgtttaatcttctcagtttaattcatatcataaggtagaccacgttttcgggcaatggcactgcttagaaagtgaactaatatgaagatgacctattcattaagagaagattttttgagaaaattagcctagaagctaaaggacacaatattcagaaataatatcttaaataacatcaataaaattagctgtctacagcttaatatgatttaaactagaaaaacaggaaaataaaaaagctaagggcaaataatatatagttttgtaaaaatggaaaattccctccactatgctcctaatgaaatgcataagagcactgacaatgctgtcacagtacgtggcatgctccattaatttaagaaagctgaatgaaaaatttgagtcaaggtaatagtacttaaatgtgtttgtgttctgcggaatcttaacatgttatttgcgttgttccttcattctttgttttcttctttccttcaatcaacaaatgtctatagagcacttaactattttctgagattttgctaagtgctggagatagcaggatgaataagttataggttcagccctcaagaatcttcacagtggtggagtcagataaataaatgcccatcctcagattatgtacaggtggggtaatagaaagataagagatacagggtgtttatctttttcttcaattaaaaccctagttcagaggtacattcatttgttcattcctctatcttcaaagcctagcatcatgctaaggacacaatgacggttcaatgttcatttgttgattaaatgaatgaggtatttatttgtttcttcgggacgaataagagggagagagagtcttgtggacaggccaagtaacacatggctttaagaagacacagaatgtgaggaattgaaagcacttgttactatcctactgaaagtagcatagaggttgcaggacaattctatggatggccttgcaccaacccggttctcccctctttcctgcttgtaggtctcaagaacaactatagcatgtgctgtaaatgcagcatcttgagctaagaagggacaaggtagaacagatcaagctctgctctagtctcccctagaaacagagattccttcaacactttagcccaatatgtcctatgaccctggggtataaaatccagggcaggctgcttccctgaatcccccagctgtgatgccagtgggatgcccccattagtgataccatccatgcctgggcaactctcctaaaccttggaagactggcccacaatgggtcttaggctcctgttttccctactatctatctgtaagtaataaacctgcttcatgcaacttgttgcatgtaagcatgttttgtctcaccagacccagacaagctggtaactgtgcacaatgagtctgcttcacagagctctctgcccaaccacatttaattcacccccactgtaaacaaatcatcccttctttcaactgatctctcttcttttatccacactccatacatttgatacccaccacaacacaatatcataaaaggcagtatggtttaatggattctggatttaaatccagctctattattagctttgtgatcttgagaaagttatttaaatcctttgtgtcccagtttcctcatctaaattgctaattatagtctagacatcataccattatagggaggattaaataaataatatatgtggaacatttggaacagttcctgccattaatgagtgctcaataatgtaaatcatttgtattataatctaggaacaatgcagaatacaatgtgggaaatgagcactgttttttaatagccacttggaagtatagagctatggtgaaaactgtaaaacagggactaccacatcagttactgtgaaaataaatgaggtaattatgacaagcaccaacatcatatttatagtagctgctcaataaatgttaactagaaaacatgatgaaaaatgtctcaatctcccaagccaaccaagggggaacacagaagggaagtagtatgttgaataaaaataaactgtgtaaccaaagagatcataataaaattgtaaatattacgtgcatctattaggattataatgaaagcagcagccataccacaaagccaaacataaactgatctccatagataccccatttgcacgatgagttacattacacaatgacttggcaatcattatcttatagcgcagggtggtgggagcaggcagggaggccaatgagtctccctttgtcaagggaagatctctgatggaagtttgatttttgcctcgtttattcctcacatctaaaatggatatttttccaaaacatgaatgccttccatatgatgagacaacactaaaatttctgctttaattaaacagaaagaagaagagaaacttattttaaaataatattacagaaatttttcttatgtgccaccttttcattaagctgtgaaatttctcacctgctccctacttggtatttttttaaggtgaacttttcagaacaaccccacagagaggaaattgctttgcaagctaggaagatattaatctgttctcccagcatcatgggtgcataaatcctttcatattgaagaggtgttgttaaagttctatatataagatgacagtacagtattgactttagtaatgctaatacaaaagcagtattttcagttaaatatgctatattctttcaattttcctgcctttacttttgcttttccctcaatagaaatgcgtgctgctcattcccactccctatctggcaggttcctgggcatccttcaagacacagcattaggtgtcatctccgttgagaagctttcctcaactaccccccactcctcctaaatgttatttttttcttattcatatccccatatttttcaaactataatataattaatttgtaagctaactgtatccccaaatatcctgataggtctcaagaggacattcattcattcaacgaatattgtttgagtacctgttaggtccagggtcaagggaaaatgatggcaagtaatacagagacagattctttctgtaactcagaattaaacaagtgaacaaacaaacattgcattgtagactaagcttaaatcatgatagcacagcacagtgagatcaggggatcaggaacgtcttcctgctaagtcaaaaagaagcaggagttagccagggtgaggagacagtggaagaggcagaagagatgtgcaaataccatcagatgcaggaggcccagcatttggaggctctgaaagaaggccctggtgactgaagcaggaggtgagtccagggaggctgatgagggcaaggaaaatgccaggttagtcttgcattttcagcagcagccacaccaggtgttcaacaaatgctttttgaataaataaataataatactaacaaagataacgatgccattgtttggcttttgaggatatgcgttcctatcttgaaaaaactgaaattgttagaaggtaatttacctcccattactataaataggaatatttttgccttgttaagactttccccttttcatatacttaaaaataatgtagacagctataattcagtattaaatacagaatataaagtatttatgatgcaagtaactagaaaaacacacatcttacatacatcagcttccaagacaagtattcacaatatgtaggaagttccactgtggatccaaggggatgtagatggtacaatctctttaggaaaaaaatgatcattattttctacatagtgttaccaaatgaatacccaataaggcagcttggcgctaaccatttcttttgtctgcactactgaattctcataatacgcactgcctgagaaatggagcgcctgcccctttttgattatctcattcatagacatctcccatcacaaaatacttcagtcatagggcaatcaaagatacctataaataaactcttgagggaagacaaataagaaaatctaacccataattgtccctctgcattgaaaaaacactggacaaataatgcaatctggctgccattctgttatcaacaaattatataacctttaacaaactacttaacctctgctaagtgaaacctcatttttagctatgagcaatgggtgtatgattaggtggtctttaaagtgccttccaacacacaagggccattaccccatatcctcttcacatatgtcaaaagtgttatcagattatgagagcaaaaaaaaaaaaaacagtttcattttaggggaaattgataatcaccaaaattttaaactctgaatgtttctttacatgagagacattaatctttcaataagaacatagttgaggcctctcctaaaatttcattagcagtgaaacccttattttaaaaagaatgtgaataacttgaatgaaatccaatccacagcagtaaaaatgataaaatatttgacaactctaatctggtccaaaatatttggctacattaagtgattaggatatagaatgtttccagcttctccaccctgtagttcttggcagtccgactagtaaaattttggaataagtccttaagagagttatttaagttcaattttgagaatcaggcactgaccttcactacagtcagcaatttcccatttatttctatccctatcatgtcattttagcctcctgcacaggaaacatcaagcttctttctagaaagtataagacagaataaccaaaagatctggtctggagccagaaaataagagtttatatcctgtccctgctacttggaggctgcagggcttggctaagccacttaatctttctaacattctccatttgggaaatgagacaatatttaccttagaatcatgagaatccaataaagtacacaaagtgttggggcaagcagctattcaagacacagttatttattcacttatacatggtttgctggtgttcatgcccattccaccaacaacttacctgcagtgtacttctgtgggactaaattttttggcttgtgttttgcttacttgctgcccagtctgtataccagcgttactgcatcctaccaaaacaaagctttgctgcattggtgttcagaaatatttcactaaatatcttaaagttctaagagcccaaggcatttgttgactaatcattaggtcagatttcttattcctcttgtcctacttcccttcatgtttctggttaatgcttcttaaaattgctaaaaccttggcttttgagtctttactgcccatttagcttttaatattatgctcaccgactcttaggcaatccaacaaatttatccatatggctgcttctgacctcacaaccatctttgatatttctttttcctgctagccatcaagttacacataacagtggaaaacagcacttatccaaagtaacattgaaatatttctcttagaagacaagcaaatttttgtttattattgtgtagaaaccattcagtactggtattttttcagctgtgctttgttttagatgaatatttgtaaaacaaataaatattacattgtattgccaccttctacaatcttttatgtattttttgttgtcctaaattgatatactgttactaaaggcatgattctgatttaattcacttaataattacatatttatttattgaacatttcctagatacttacaatgggacaaacactatactatgcaccagagtttcaaagatgatcagaatgtgatccataacttacacaataaccatattattggacagcaaatacttaaatatccatttatggatatatgggacgtgataaactaaaagcatgcgcaaaagactctaaaaacacgcagaaaggaatgggaagaaacaagataaatgtcccatagaaagtggcttttgggatgaatcttaaagaacgatgtcttcaacagagaacggaaggaggtgttttggtggaagaagcagaatgggcagaggcatagaatatagaagtacgtaaagcactcagggaaaatctctgttcctcggaagagttaggataacagatacctgagagagggtagctggaatgaaattctagtctgtattggaactcagttttactagtcctctaagaattttgttgtaaaacttttattggaagcccatcttcattccaaatatacagccatatttgaatctctctctcacacatacacaaacacaccccacatatatacagttgatcctcccgtatcagtgggtttcacatctgcagatccaacaaactgtaaagcaaaatattcaaaaataaatttcaaaaaataaaaaatagcaatacaacaataaaaataacatgaattttaagatacagtatagctatttatatttgtatttacattttttaggtatatgagtaatctagagatgatttaaagtatacaggaggatgtggaaggatgtgtgtaagttacacccaactattaaaccattttatatcagggacttgaacatcagctgatttcagtatcactggggatcatagaaccttggtggacgactataatgtcaaagtacagagggcacctaaagaacaactgagatacttcagggatcagagaagaaacaaagacacagggtagcaagcataactgaaactacaggtctgaagtgctccaggttctgaagcaagcagagatagcctagaatcaactctgctagtgtaattgagaccaaacgtcccctgcctcaggtgggggactgtagttaagctccttgcttcaaatcgtgggccaggtggataggactgatcttcccatgcaaggggttagaacaacactgaaagtcgtgctaattaggataatataaaaccgtatgccaaagagaaaggaggaatccaacacagatgtagcttgaatctaaggtgtaggtccagccacccctcgtgtggtttccatagataaaacatcaacacaattatcaatgggactactcccagagccaccagtttaagacatggttctacatcaggtggcttaaagtccatgttgaggcaatcacagagttgttagttcatcaagataaaaacaaataaacacaacaatcaccgtagatgcacaaattcacaaaatttctaaaatgatacaaggaaaaactaataccaaagaagactgccaattacaagaaacaaatttattacaaagtgaaaaaggagcaatctgaaaacgtctttaaaattactgtttaaaattctcataagaaaagaaaagaaaggaggtactactatcccttaatgacaaaacgagaatatatgaaacaaaatgagcagaaattaaagagaaatggagggtactaaaataagccaagcagaaattctaaagatagaaaatcctgacattacagctattactaaaaagccaaaaagtaacagatgctggcaaggttgctgagaaaagggaattcttacacactgttgctgggagtgtaaattgttccaatcattgtggaaagcagtgtggcaattccgtaactgaaaaccaaactactgttcaatcaagcaatcttattactaggtacataaatcattctaccataaagacacaactatgcatatgttcactgcagcactattcacaatagcagagacgtttaatcagcctaaccaccaacactacactggattttttaaacagtgttatatatacacaccatggaatactatgcagccatgaaaaagaatgaaagcatgtcttttgcagaaatatggatggagctgaaggccattatcctaggcaaacacacacaggaaaagaaaatcaaatactacatgctatcacttataagtgtgagttcaacactgagtatatatgagcacaaggaaggaacacaaggacactagggcccacttgagggtggacagtgggaggagggtgaggatcaaaaaactacctatcatgtactatccttactacttgggtgacaaaataatctgtacaccaaaccccagtttcacacaatttacctaaacaacaaacctgcacatggactcttgaatctaaaataaaagttaaaaaaagaaaaatctgtgattgaaatgaaaaagtaaaagatgaggtacattccagagaggacatagtcagagaaaaatttagtgaattggaatatgttactggagaactcatataaaatgtaccacagagtgacaagattaacacctttatatccgaggataagaattttagatattattgtacagataaaggagagccattaaggttattattcagaggatgctgtagaaactcaattctggtgtcagtataaggaatgagtagcaggttattgtcatagtcctgccaaggaatgataaagtcatgaacaaatagctgatagaaggaatggaaagagaccaattatttccccctgcttttctctgtaactccattaagtcaacctttatattttaaaactgcttagattttgttaaaacttgattagtcattctctaaatcctctccttcttaaccttagattctctctccacatttattcctgtcttcatcctttctttccaatctacttagcagagaacttcagtatttcttgactagaatataattgtctttttttcccaaaaagatgtacacctccaatttgttttaagcatagcagccataacattttcaaagaactgtcaaatcaagctcacactcccgaaatagggtagtagaaatagcagtctcttaaaagtaaaatggacttagattcaaatcctgattattctacatattaaatatgcgtcgtcacaactgctgtgagcctcactttcttaatctgtattaagtggcataaaaagctccttcttcctagagttattatgaggaacaaaggagattaagtctctacagagtctagcaaagtgtttgtaaagtagtaaatgtccaataaatattttgctatcctcattaacacccagcatgaaaggtatttcctaatattcttgactgagaaagaaaagaccaacacctccattgtgccttacttttctgtttatatatttgattaaactaatttatggacacatctatctccccctactaaattgtaaaatcatttcagagcagggcccatattgtattcctttctgtatcattatatttctagcacagtgcccagttaataggaggggattaataaatgttagattaacaaattattgtagataaagtctaatttatcttccactcagtgcctatacatgcaaccaatgtttttttttaattgcacaatacaaacttcttaaattattgttaccttctcttcctcttttttctgtttctctcattccctttagttttcttcttctggcaaaagcacacccaatctaccttcattgtgtccatcaaggctgacctatcccttctctgaactcctccatcaagaaaggaaaatgaaaggattttaactattatatccaacaacatactcttgtttcctagtctagtttgtcatacacagtaggaattcaaatttgttgaactcacctgaataatcttgcctattgattaaaatagttcttgcataggggtaaaatgcaccatataaaaaggtaatgcatcttttaaattattgtgatttattaatttgattatttttgatttatgttagggtatttgaaaagaatattttaaaataaaaaaggcatcaaaattctcaatattcatccaaacatttattatgaatcttatttttctctgaatgtaaagcttcatactagcttaattagtatgcatttattgtgtgtgaaaacatcctcaaggattttcgttttcttccagtcaggtcacaattgtttgcactaacagttactacatattttattaattcagaatgaacataaaagtaggatgtcatcactgtattcaaaaaataataacactgctgacagaaccttttgtggtgagaaggatggcatgagacgggaggaaagacaaagttgataaagaggaaacaagggtcaaagcaaactgaataggaaataaaaccgatgaaggggtaaatataaaacaaaaagtgaaaaaaggagggaagattacataaagtaaagagagaaaaacaagaaaagagaaaattggagaataaagaaggaaacaaattataaatgcatagttagatccataaaattctagcactaggaaattaaaatatagtataaggtaaaatgactgtcttcccaacacagagatttttaatattttcccattccctactcagaaattcttgtataattccaaaacacttaaaaggagatctgtatttagattttaactatctattctggtttagtacaaaggtgacattacatctgcactacatgttcaagttaataataatgaatactttttagcatttgtctttcagttctaagcaaaaaaataaacttttaactttatcactttacacaaagttaattgtccaattttcagttcccatattttatgtgaaaagaagtaaactagttctatttataattaacttacactttaaagaatttttaaactctagggaaaatatctttttcctaagaataaactttaacaatactttattatgatctgaaatgctgatttataaatagcttcaccatattttacgtaccatatttgttttagagatttattacgtacttctccctgtagactgaaaattatttgaaagcgatgttaattttaatttatattatatctctcatcctgtgaacagtgcccaacaatttatacattcaatgaatatttgttgaatgaattaaggaataaatcaatgagatgttatagtttaagtatactttgattaagttctacgtgaactaatattctcatatgtttgacatatttgtatgtatttcttccatttgaatctacctattactaccaggccaatcttctttaaatatttatttcataatggtattgcccatttcctaaacattaagaggaccaactctttctaaagcttaaaaatataaatgccttgacctttttcagtcacagattttaattctatacaacgccttcactcttgagttttacttttagtttcaagcattgtcataaactcattgtgggagttgtttatagagttttggggaaggaaatgcttttctattttatgtttcattgcttggatatctaatccatttatcaacaaagtattttcagaaatttgtgtttaatatatttctttggtctaaggctatatagagaggctactagagcactgtgcccatcagccattactctgaggcagatcactggagctattcaggtataagctcacaggacacagaaccagctatgtaagacagcagctaggacagtcaacacagagaatctaccccaggaattccatattccatttttacttaacagctcacacctcccaggtgggtttaggaaatgaacagaatagtttgacagccttactccttaggaggcactggcaagtcatcagaaaattggctgagatcagttgagcccagtgtagacctgcaggactgtccacctcacccttagacttgtgagcagtaatacatgcacgttgttctaggccactgggttgggagtggtttgatctacaacaacagctagttgatgaaagactgtgtctacaagtacaataatatgtaacacaaacctaaaatatgtggcactggctctaggatcaggtagtaagcaaaggctgataattgatgcaaaagctaaaaagacgataagtgaactattatcaaaggctgaataatgaaatgatcatgtgtgctggaagaatggtgacctgtgttatgcagcagcaaatgtaaaactgttgtggccaggtgcggtggctcacgcctataatcgcagcacttcaggaggccagggcaggcagatcacctgaggtcaggagttcaagaccagcctgaccaacatggagaaactctactaaaaaaacacaaaaaattagccatgcgtggtgacacatgcctgtaatcccagctactcaggagactgaggcaggagaattgcttgaacccaggagatggaggttatggtgagccgagattgcgccattgcactccagcctaggcaacaagagagaaactcagtctcaaaaaaaataaataaataactgttgcctgtggtaaatttaaagtaagataatatacctaatggatttatgaagtatggtaagataagtttttagatattatattcagaatgtcagttggttttattgcatgtgataaggtatattgataaggagagaatcaaaacagcactcacccatttgcaagcagattttagagggaatatagagaggccaaggattgctgagttggaaaataaaattgtttttccttatagtcttcccatttggcaaaagatcatgtaaaatgaggcttaaagactatgatcaaattaaggctgtggccgtaaaaccctttgttaacacctctgaaagaattaagtggtgcccaacaggggaaaggaaaggggaagggtgcttctagaaatcttaaagagtggtcccacaaatgtcaaatccctaaatagcagtagttaagtgtgtacaaagaagcattcttgaaaataattgtagtatggattttgcagcagagagtagagtataaccagacttaaagaaaacacacaaagttttacagtaagtttcataggtaaaatagccatcaactaaattgtctgcaactttctataggaaagaataagtctaagaaaactaatcaggtgccaaatagaacatttcttcagaagtggcccaggaaagtgatagactacgaaggtcatcatagagggtagagcaaaagggtaccatgtgaaaaaataaacagggaagttactcccaaggagcaaaggcaggatttaagaaacatttcctattctgtagatgagggacttggtaacatttttctagcatgatttcagaattactactgatcggtgattgctaggtagctcctgtttttcccctttttggagttacatctgagaagccacatcagaacttcatgtagtataggagaccctggaattaacatgatgttagaactggattcaatttctgggtttggattgggcatattttttcctttaggagagacatgtataactgagaccagggatggtagtctttgatagacttgagacaaaatgagtccatttttttacccttccctgtattcataacctttgcaatgggactttgcagctcttcttatcaaagggtaggctttttccctactctgtgaatttaaactgagacaaactgctttgaccaagagaatgtggcagaaataatggtatgctcattctgaacctcagcctcaagaaactctgcatgttctgtttcctctctggaaccctgccattcctatgtgagcgactcctaatttgtctgacggaggatgagagacgacagggagaagagtccacgtgatggagccaaatctaccagactactctacaggcagcaaatcccaaatgtgtgaaagagttcagtcaagataagcagaacaacctacacaattcagccctgacaggatgcataagtatactcaagtaataatacatgtttattatttgaagccactgagtttggggctggcttttttttttttttttttttgcagcagttaacacatgcaatgatcccctgcaaatatcaactgcagattaactaacatccaaatgttttaaatatctagaattaatttcagcaatcctctctttaaatagagccaaaactagataatcattttaggttctttcaacttgactgtgtttttcctgccaacataccaaggaaatgatgagatttgtcaaagttaatagaaaatccactactgcaatagaagagtatctgatttttacttaaatgtttccatgaataagtttacaatgctcaagtaaagaaggacataacccagagagacagcaatcaggtcctcgaaagttttgggaatctgagtagtattctcataaatatgtacatgtatctcttcctaattatgaaatatcttgagcaagcagcccaaataattcttgatttttttaaatacttggagccatataatatacaggtttctgaaagttgctgtatgtctgtatgtatatctttgtgtgtattaaacaaaaaaattaaaaaatttccttataatgaggccatagacatgggacccaggaaaaacgaactcgtgtcctgaatgtgcccttgccagagtttatttcaacgtgaattgattctaaatacacttttttgcaagcattgcccaacatcattatataggcaagaatttcacacaaatcactgattgacagaaaaagaaattcactcttctcttttattgtcattttagaagatacattaagatctgtgatgataatgtaagaactttaagtattctttcacattccaagcttagtcattttctttgtaatttagataggtgaacagttattgtgatgtgaaaattggaataattcaattataaaagctaaatttctgctacaagatgcataaatgctccacattttttgctgtggctaaaaactgattttcatgcatgtagggcttctaaacccaaaaatattatttcaaaatgcatcttttccaaataagaaaaaacccacattagtctaccaggttaaatgaaaaggctaaatgagagagctcttaaatatagcaaaacaaattttacaaaacacaattttaagatacaataaatatttgtcatattttggcaataaaataaatgggaaataaaattatatttataatattaaccacgatataatcaaaaaatctccacaaaataaagaaaaaaacacataaaaaactcgagtattaaatttaaaagtgaaaatttcatttggttttccatatgagattacaaaaagaaaggcatttactaagatataacttataagaggactttctatagctattcatctttctattgacagaatatcccagattctttacaaactatttagaaattgctgggtttgcctagatttccattaagtagcagtattccacaggaaagaaaaggacattttggaaggaataaagtattctttggcataatgattttcattcccaaagaatacaagaactggatacaattatacatttttttctaaggcaatggaaaagtaatagtcaacaaggtggtaacaggcttcttctttaccttgaaaaaacactatttttaacatttttcaaccagagaataatctctatcatgtatttgagttgtgtaacaccatttaacatatcatgctggaaaacatttgccattatatgatttcattttaaataattataagatgatttgtggtggttaaaacactctgttttttagattagaaaaacagtttcgtttcactctaaacattttcaaagagtaggacaagatctcagaactagccctcaaaatatttggtggaaaatatttcaaagtgaaatgtgaagttgatttagaaatatttctgttaaaatataaatacatgtactatcaaacttgaacatattagctgcttattctacctgtgaaaacagcttaaaaatttgcaaacattatctccataaattattttaaaaatcactgtccaaagaaataaaatagaaaattataggaaacatttaaaagaagttatctttccacttcggaagtaccatttagggtgggaatataaggtggtgaggacatgggaacaaatcagtgaacaaatgaataatcaagatgatttcacctgtgattgtgctgtgaaataaacaaaaaacttggagactgatttatagaagaagagatcctttagattaggtagtgaggcttttgcataggaagccagtatttacactaagcctgaatgatattaaaaagccattcaatgaaagatctgagaggaagggcattttggcagaaggaactgcaaatgcaaagggccagtgctcattaatatgttcatgctgtgcatccacaactaaactgcaacctgcctaagtttgaagctcgcatgtcctagttgtttggtgtaaagattattatcagtatgactttaccatcgcaacaattaattcataaaagtcttatttaattaaaacacaaatttggccactttacaggggtatgatatatgacagcacatactgattttagctgttagaaacaaataagatgttatgatttaggtaatgtaaacaaagaaatgcccaatgtttttcaataaattaattcaataacaaaactcaaagccttttaaaaaaactttccatattttcttttctatgagtaccaagattttccaaataagaaaagggaaaaaaaaattttgaatagtgaatgctctgcatgtaaaggagaaaaactgtttggaatgtaaagatattaataactgtagtgactaacactgtacatgagaacaaactgttttcaaactgttttgagtagctagaaaacatactaagtttgcgtaagtgttttttgatatagattccatacaggctgactagataatataacaattacttttatttcattaaattgggaaacttcataatcctcttgcaaataaaaaatttcattgtaacaatttatttgctgcacacgtctctttcaaatattttattttttaacatttactagttccttaatatatcttattataatcttaaaatgatatgtgcacacatatacacaggatgtgtttgtgcatatgtagctaaaacagacaataatatcataagtattataaactagtcattgtgaaaaaattcaaatgtttatctaacatatgaaaaaatgtgtaatctagttattaaggaaattaaatcaaaatgtacgttttctagcatgaaatttgctaacattaaaaagaaaaataggctggatgcagtggcttatgcctgtaatcccagtactttgtggagctgaggcgggtggatcacctgagctcaggagttcgaggtcagcctggccaacatggtgaaaccccgcctctactaaaaatacaaaaaaaaattagccagttgtggtggcatgcgccagggggtagtggaggttgcagtgagccgcactccagtctaggtgacagaacgagactttgtctcaattacaaagaaaaaagaaaaatattaattttggaaagtaaatgagaaataagtactttaatatgctgttagcggctgcatcaacttcaatgagctatttcacatttctagtaaaaaatacttctgcctttttaaccagaaattgatctctagtaatatatcctatagagacatgcatatatgtgcacaaaaagacatgcatacagatttatttcaaataaatgaaggagatgaaattaacaaaaaagcatatttttactgtaaagcagtatatcttatttaaaagcacacattctaaagaaagaaaattaaatcatggtatgattctgaataataattgtatatgataccatattcccttacatctgattcaaaacagctagatgaatgcattaatcttctttaaaactaattatataacccatatttggggattaagaatgtttctgacttcatctgtcaatatgatagacagtacgttagccccacagattttctaaataattacgaaaacattcatatttaatggataaggaaaaaagccattgctgtttcaaaatgaataacttgtgtgcttgattacatagtctaataatttaaagcaccttttgttttatcttacaaaatatattataaaatattatctgctacatggtcttttcttatgctcaacttatttccatttcttaataaaaggaaaaggctataaaatttagtaagtagaaaaataagtaaaaggtattaatattctttcttgtattctttatcatattatacaaaaataaaagataaatctttatttatcaaagtcctctcactttttctgcccaatgatgttgtcttaaatttttttatctctttaaactactctctgacttcctcattctcatcagggaatacaaggaaaatggagaaaataagacaagactctcaattttgccactcagcatcctctgtattcaataactacttcttgagtgtcctccatagtcttaggcactgcacaaggtcatgaggatacagcaggggatgagtcaaatccatgtttgaccttaaagaactcagaaattgtacttctttctttcttttattaaaggaaaagttagctatccagcctgttcagttaacaacagcagtattccacctctcatcctatcttctctccacagaaaactgtagagaagccacttgaatttggagaactccacagtcatctataaaagtataatttcaatagatcacattgaaggcagaagtgtaatttcacaggttggaagtaagcatttgatgaggaaacagatgcattgtttgtgtgtgcagatttgttcaaaataggctgacttgtgaaagaaagaatttaagtagaatgataactagggagaacaggaaaattgagccaaagcatattcagtatagaagaatctcatacatgcttacaaatggaggaaactggtaagtagaggagaatggagaatctagcataacaacaacaacatacaaacatatacatgagggaacaaggtgctgaaggaggtaaactagtttgattgaaggcataccttaaaagtaaacttacaaagaatagaaatatttcttctaataaagttgaaaagctgagaggccagatttctgaagaggatggatggtctctgatagagctctatacagatgattttccatggcctctatgatttttcatggcctctgcaggagattcacttggagagtagaaaatcaggaatctaaataattagctagctaagaaatttaaaatttgttttgaactaactttttcagagccctatggaagaagtgtgagttttattctatctctaacaatggctctgaaataaacactgagttcttacaatgcctataccccgctaattttcaatagggtaacttatgtattcttacatcaatcctgggaggctaatgctatttatcaaatgactgcacaaatgagacaactgagccagaaagtggttcaagtaaaatttgaatccaggaaatttaattccaacactcttaatcatgaatatatatttcctctgagcttatttccacaagacatattaggatattagtaaataagtttaattcatatttactaatgatacaggagaagggcagggaagtgctggcagagaagggcattgtccccggtgagggttctaccctcgggcctgtggcccacggacctaagtgagaacagcactcctattttcacgtccgaatgttccattttccaagaccactctgacccaccatgctccccccatcctgtgcctataaaaaccccgagacacgaggaggcacacagacacaggcagctggacattgagtggaacacaccagcagaaaaacacactgacagacactgtgtttgccatcgatggcagaacgacacggccatagatggcagaacgaagcggattacatggaatttggctgagggtggttggagaagagcccagccactgagctgcccaactccaggggaagaccaccttcctactccatcccccttctagctccccatccatctgctgacagttacttccaccactcaataaaaaactttgcacccatcttccaagcccacatgtgatctgattttttcagtacactaaggcaagaacccaggatacagaaagaagcccctctgtccttgtgataaggcagaaggtctaattgggctgattaacacaagctgcctgtggacacctaagctgaaagcacactgtaacacacgttcactggagctttgggagccgtaaacacccaaccctagatgctgccgtggggtccacattccccactacctgcccatatgcatgctccccctaggggtttgagctttgggacaatgaagaagcaagccacaccaccgttgcatgccctgtgagggggataagagaacgtttcctgttttacctggggctcatccaggatcctggaaggagagtatgaatgcaaaactgtaggatctgccactcttccaaaacactgccacctctctctctttcctgtgagtaaaaggatctgtttgccctcatggagttttaaccaccctaaccaggctggttaaacaccccagacttcgtctcttgtctctctctcactgtttgaaaggctcttatctcttcctttatgatattaagagttttgctagaggctgtggcaatgttactaggtaaaatgagcatttcactcagctgccaaaggtgcaaatcagaccacctgtagaggtacaccgactcagcctctacctaaaaagccacaggcaagtatggctctgggtatctacccttactctttcccctcccatctcgggtgcctgggcatgtccacagcatgcaaaggccatgcccaacagccacctttaaattgctttgccattttaaggaacacatgaaatcacattctactgagagtttcaagtgtgaaatacgcaataaaaagtatcttctggagagcacacggaaacagcacctaaattgaactaccctgaagtagttggtaactgggaaagaactaggaaaaaaaattcatgtatatcagtactgtgggaaacggtttgacgattttgaacattttaaagaacatctttgaaaacatacaagggaaaaaccttttgaatgtccaaatcatcatcaatgatttgctagaaatagcatcctcaaaggtcacctcactgcatgccaaactggagtagggacaaaaaaaagaaagaagctctatgaatgccaggtttgtgacagtgtctggggtttatatgtagattatcatcattatattgccagactcatattattatctactattttaaaaatatttgtcttttatattcacttgtactctcaatttctaaattgttttccattcaagtgtaaaatattttccaggtttttttcctaataggttagataaatggtatattttctgaacccctgaatgtctaagaatatatttatataccaacatacattaactatcttgcctctacgtgaaactgttagcccacaacataatttcttttaaaattctgcagacaaaatttttctattatcttctgatatatggaagtgaataggtgaagccacctaaatttccccccctgctcttggtaacctatctgtcccttttgcctacatatttattggcaggacttttcttaattgctgtagtataataacttgactagataatagtaaactaggaaaataaatcatttggagttatacattcaggtaaagaaaaaactcttctatgacatctctgattattggttatacttatttaactttctctttggggtatacctatttctgcctccctactctcgattcttaactctgctctgtttttactcaacatgttatcatctcccaacatattatatatattcttgtgtcctaatgtttataatctgtcttcctcctcaggatgtcatctttgtgagagcaggtgcaatgtttgctttgtttattgctgtatttccagaaaattgaatgataccatagctagaatgcaaatagttttttagtgaattcaagaaatcccacattgggtcatcatttatcctgaatattactgagtttgtctcacattactgtatcttaatttacatttagaattttaaaaataattttctatgatgtgtttcattttctgttaattttttcatttttacttacggtgggtgcatattaggtgtatatatgtataggctacatgtgatgtttgataaggttgggagggaaagcaggtggggaaaggtggggatggttaatggttacaaaaacatagaatgaataagatctagcatttgatagtacaacagagtgtctcacataattttaagctttatcattttcatctgctttatcaagagctgatcaaatttcttttttcaccactgattgtatttttctttagctataattctactcatgaatgcctgcaaagtggagtttatttaatgtttttagattcttaattctgtcttacctctttcctttgttttatctcagtctatattttgctcctttttcaaagaagtcatgctttcatgaactgtgctgaagtcctaaaattacgccaaggtgtgtccatatctctgaagttatcacaaaggttaatatttttcagtatgctccaggatgttagaatatagtgcgtagtagttgcaggcactgctaccagggttcatctgtatcatacaacctgcaagtctttattttttgaggtgatcctcttaaaaaggtcttatgattggattattttcccaagacgttctctctagtttttctatgcttttcaacatctgcctgcatgtagaagaagaagtagtggagacccaggaaaaagtcctctgttttgcacagacaatctaaaaaagacagagaaactgatactcagcttcctcattaacacaagtgtaaattctccaggcagaggcagagtattgaagcattttccttccttggtcttaggcagtctacgttttggagcacaacaatttggagcacaacaaaaataggaaacctgcttaaagttttcttatggaaattctttttgatgtatacttagtgtatttttctttaggactttattaattgtcaaaattagttgttactgttattacaagtttagacattttctagggtatttgagaatacataaaggcgcaaagctacaaacgtgagttttaattaaagtagtattcaaacttttcgacaaaagttatatactctaagtgaaattatctaaaaatactataggaagtgtggatatcatttaccatgatggaactactaataactgcaacaattatttatctgtatgtcttttcttctctgagtattcattatttactacctaacacctagttgtaaaaattttaaatgtttcgctttttcacccagatcatttataacattaaaacttttaaaaaattaatatactccaggcttttaaatgttatgtatgtatattttttcacttaccatagagacaagattatttagtcatgaaaatgactatccattcacttatgagcaactacaaagctgtttcttgcaaataaggccaaagagactgcaaatactcaaggccacactaatttctcttccctttgaaaatctactgtatgttgcttacttattagcaaattcataacacaaaatattctgtggataaaagtgccagaagggaccttacagatgatcaagttcaatgtacaaatgagagactggaaccacagaacttttgacacctattcaagatttcaaagccagctaaccctagaacacaggtcttcccatttcttatctagttttattttttcagccaaacagaaaggtatttaaggacagatatcatgtcctctgggtcctagtaacctcctccatgcacataatattggtaggaaatttaaaaatgctttaatgttgatatatggttgatgatgaacaagacatgctttttggttttttgttctagcttgactgtgtggtgaagtagccattatgtactaacctgtcatgtggcaaataaatgcgacaaccctcaagtttttctcttaagattacatcagaaaatagaaataggagccaggtgtagtggctcacacctgtaatcaagcactttgggaggcctaggcaggcagatcacctgaggtcaggagtttgagaccagcctggccaacatggtgcaaccccatctctactaaaaatacaaaaattagccaggcatggtagcacacgtctgtagtcccagctactagggaagctgaggcaccaggacagcttgaacccatgagacggagattgcagtgagtcaaggctccgccactgaactccaatctgggcaacagagtaagaccctgtcaaaaaaaaaaaaaaaaaagaaagaaagaaagaaagagagagagagagagagagagagagagagagggagggagggagggaggaagggagggaaggaagagttaatatattatttggttataataataattagaaaacatctcaaaatttagaaagcatacccataaacatcatctcattaaattcttcaacagtcttgtgtggtaaacattatattatctctaaattattaacaagaaaaaaaatccagagcccaagtaactagctcaagtttgcaaagctaatgagtgagaaggtaagaaattaaacttactctatttcattaaaaagcttaaattctattacttctccatagactaatgctatttattaaatcctgccaaaatacttctgcattcaatgctaccaaagtcaaagttataactattacacaatattcaacaggactataacctaaaatgttatatcttaaaacatgtaaactcacttactacttaaatgtatcaatgaccataacaaaaggcatttattttcattgctgtatcaatatatataggcatagctagggtgaaggaaaaggttttattttatgcagcagtaagtaatactgaaaatcaaaagagtagtatctttgataatttcacacatattacctaagaaatagctgctcaattttcctcaaaaaaaatctacagggaattttcatacagagctcaaactagctaaggaaccacttggttcaacaagctctctttctatactgatggttagcattgaaacatactgccaccttatgacaattctttttatatcttaattttcagaatattctgttataaaaataaaccttcaccaggaatatagccataatgtctagaaattatctggaatttatttgagatttttaagttattagctctattgaaagcaacctgagagaaaaacactacatttaaaagggtatttttagatttggaacaaaataataattttgacatggtttcacaaggatttttaaatccaagaatcaggcatataactgattacatgctggcaagtaacctaaaatttagaatctatttttccaataacagtttaagaagttatattcaagtatttgcccttattgtctctataattttgcaaacacacacacacacatacacacacacacaaagacttacaagctgcaatagcttagatttgaagaaagtacagggaaaataaagactaaaattgaaaaaagactgtaaacataaatacactagtgtgtgaaatttacaagaagacaaaataaaacagtactacaaaattactactactacaaaataaagtacctgtctacatataaccctctttttgagtatccacagtagaaatttccattgcaccatgaaacatgaagtttttatacaggaactgatttattcttctctatggatccagtgattcatgtttgtaatgggttctctgtttccctttttgcattagttgctaaagtacttacagaataatttattttttatctttatcaagtatataagaaatcatggcgtgcattttgtacagtattatcactcctggttgcatctttttttttggccttattttcactttggcctggtagtaccatttactttatgtaacaacttgtttctatggaaagataagaatttagaagttgaacaactagaaccaactctaacttttactagctgtagggccatgatcagttacttcatctctaggataaattatagattgtctattcataagttgtgacaaaaaatacctttagagatatctaatatttattgggtgcctaatatataatggctacttacataacttaatttctacattgtttgatttcagtgaagcttctaaaatcaagttatgttttataattacatttaatgcagttgtgttctcccacaaaagcaatttttaaatcagtgatgtcttggaattgaggaaaaagagtattaacttattgtactgtacttttgtaatcacctttgtgttcttttcgaattaagcagaattactaacaaaaacatttcagtaaaatgctcagttgcagttaaatcataaatggggaaaaattagaaactgatgaacaaataaaggctatgattaagacttcgacattgttgttttgagaaaaaagttgacaattcagtaaacttttccatatgtcatgaacactgaaaattcactaaaacttgtttaaacttcatggacaaaagaacaataaattttttaaaaagtcatgcacaataacataatgcttagtttaattactgatttgctgtttgcccaaagttttaatcaagagagttcttacatgtggataacaatgatgacatctgtaaaagctagtgccacgtttaactcctccaggcactacagcacctggtgacgccacagggaagaaatcatggatacttcttgaacatactgcaacagctgtcaactcagaaggaggtatattctaagttctaccaagcaagtagtactctacaaaacctcattctgtcccttcttttaactgaaaagaagccagatggaaacatgcaacttgtcaaattgcaaatgaagaattactataaactgtattgcatggatctctgggtgttcaccactaaaaatttggtcgctcaatttgcagagtaatttcactgacatttaaagaaaactaaagatgcttgatactatttcagataaagacaatatcatatttttaagagaatacagcaaggtaaagacaatgaaaatatgaacgtatctttaacataacagcagaacaaataactaacaggcattattctagaagcttcataatgtccagaatgactacaactgcaactctcacgacagttaatggggcaatctgcttggagcacacagccacagaaaaccaagaaaacaagctgtattactcatgatacagcagtcttagctacactgctatggttggctaaacctccacctgtatcttcattatagagttctatttccatccactgtatgtgattactataaatgtttaaacattttgaggaaatattcattgtaaatgtatacaaaagtaaaaactaataaatttgctttatacttttggtacaaaaattacctatgattttaagaccaccatttgtttgataaaattagacatatgtagttatctcatatttagagtgtaagcattaccatttctgagatgccccagggaatgttttgatttgctcatccattcttgtatgtctacatatatgcatccattgagcacctactgtataacatgttccatgcatgtttagttacataaagacatcctttcaacatcattaaacccttctttaacaactagagtcttgtttagggtagaaaaaatgccctgcaagttctgaaacaaaatgatttatatcaacctgaatcacatcctaaatgtatatgtgatcctaatgatgtgataaagatcactgagttcctgagagtatccatgaacacaccttccaaaactgtggtacaaataatttcttagcagctttaaatgatagacattatttacctatcttctaaagaaaccctaaaaattatacaaatgattttaacaagtcaactcacattttttctataccaataatgcattttaatgtggttaatcagcactaaataatatttcaaatgcttataaatttagatacagcttagctcaataaccacaccatgcatgtccacagaggagaagactgagtcttagcaaaggttgagaaagctgcttaagatcacacagaaacaggatatggtggttctgactgattcactttagcgtcaggcctgtgtctcattccaatcctttattctttggtaaatctcttagaccgaaaagtgcaacactggaaggtattagtacaaggtaaccatgtagggacagaaagataaattttaagttgttgaggaagtaaactcagacacctttttctgttctctctcttcctcatcctctcacactaatagatacatgattaaaccactgcaaacaaaggtctgtggaggatgctttgtccatactgcctggttcacttcacattacataaatcacggcgcagagctaccagcctaaaccacctctgttatcttcatttctctacagatttgcctttctttcaaacccactatcccattttcttctgtggccccagacagctgtctttgcagcacaacagacagcagtcactgcagctttgctttgagcatgttctacagaagtccacatcccttgcagttgcctttcctggatcatgggaccccatcacagtgagctcttccctatctgcaggtagaggactaagaattatacatttgctgggggcactgccatgtatactcactttacttcccattttactaaactgtattctaattttattcatttccctgtttagatttaaaacgttcagtaaaagcacagaaagtaaaagtagtataaaggcaagaccagtgaatgaaaaacaactcagaaattgaccacaaattcagtgctactttatatgacaatcccttctatctttaatagtattaatcaaatgtcttaaatcatttataaagagtaaattattttcctttgatacctttgacagaataaatggtcaaactcctttgttacttttgtctgtaggagtcaggactgagaaagtattctctggatatcaggtggtggtatcatcagggtgataccatggttcaccctaatgtgagccatgtgagccgacatagtgaaggcacagtcctaggggaatgtgcaatactgtggtgggcactggagaattctgaaagcatggggtaggagtgtgttggagagaagcaccaaatgctagctgttataatccctgtgttactcatctctcaaatgtcccctttctatttcttacagagccaacgctgttgaacagaaaaggataaaaaatggatttttgaaaaaactattattcgaatgatcatgactataaataactggcctcctccaaaatgaaaaagaactccatgccctagttgtacaggaataggtattgatcatcctacttaaagtaatacttttatacaagatgacttacaccacagaaaatcagatgtgctttatcgggtttggcaagtagggactgctttcccagggagatgtttccaaataaggaaagaatacagctttgttattttattttattttttatttatttatttacttatttatttttttgagacagagtcttgctgtcactcatgatggagtatagtggtgtgatctcggctcactgcaacctccacctcctggattcaagtgattctctcacctcagccttctgagtagctgggattacaggcatccaccaccacacccagctaattattgtgttttagagatggggtttcaccatgttggccaagctggtcttgaacttctgacttcaggtgacccacctgtcttggcctcccaaagtgctgagattacaaggtgtgagccaccacacccagccttgttattttatttttaatcaaagtaaggaggcatcatttaccagaggtcatgaaactggaaaagacaaaaaaagttgcagattcggaagacaactcattcagagaaaggctacacctttcttatggtcagtaatttattctaaatcccaagtctaacccaatatcatggtaacagaaagcatcagcttttccctgaaatctctcatgcttccaataaaataatggttcccatgacaatagatgctacctcagcagaggcaagttcagagtacaggcagtacacatatcttggcttaataagcagggaggaaactacactggcagtattatcctctcactttctttttgctgttagtaatagaagtaataggttataagagatatgaatcacattatcagccatctaatatgcaatacttgacttcatttgattttctattccaaagagactgtcagcgttcaacataggaggaatactaaaaagcaaaatgggagacatgacgattcctgctaattgccattcattacctctccaaacaacagtgtttccttagatataagccatgcttttcctttttttaaaaaaaaaaattactcttacagtgtaaataaaaccaatttctcagcgctttataccaacagttgagagtgtaggtatctacttagtaaccaagcttccctggcaagaagctctaggggatatatgaagtagatctctagatgaagaggacataaagaacaagagaacacacttaagtctctaagtgttttaaacaaatgtaaatatatgtagttttataagactaaactatctttctgaagaagtgtagtacaaaatgttctgggtggttctcatttaacaaaataggcgattactttaccaagaaaagaaatccagtttatatttcctattactccacacaggcactatggaagcactctctctcataaatgatctgtgttcaaatctacctacctctctcctatttccttttcagacagtctcttctaactactgtgaaaaacatgtgagggatgcatattaccagattaacctgagttatccaatgtgacattgtcatgagactgtgatttggactgtcatctatatcaacttcttaaggcctccattttttatacagttaaatagacactaacaaaggtagccaatacataaaattttatgtccagaagaattttaatgacaaacagatgctaggaaaacaattcctgccctggttacttttgtgtgaggatataatgtgcttaaaagcaagaaagacaataagctatttgtaaaatataattttttataatttcatggtgttctgattttaataaacacaaataaatttattaatctttgctgtctaatgaaaattattcacatcctgttgtttagtaaaatcattaaatgagaatatagctaatacaaacttttatttgtagaaagagaaaaacatagcagcatagcaaaatatacttgcattttgtataagcttcaaacaccacaaagtccattgaacgtttaataattatgcatatttcatttgttattttcataatgtataacatataaaagtactttactgaatatgagaaaggtaaaaatctatctccctgagatacaacatgcaccacacagatttcttctatctgtgtgttcttcatactgtcatacaaatcagtttggatcactgttttatgttatgcatattattcaatttgaatatatatttaaagtggtatttcacaaatggaagaaaataattacttacacacatatttgtgatttgaagctttcaacaggcaatgacactcatccatcaacagtcttcaatgccgtatgtttttatagcagttctccaaacatgaatagaacctaaatatgcagtgagtttcaagcacatcacacaccctgtgtttattaatagatctttatgctggccacaagagagattatctttttttcttttgggccactgactcttttttttttttttttttttttttttttttagacggagtctcgctctgtcacccaggctggagtgcagtggcacattctccgctcactgcaaactccacctcccgggttcatgccattctcctgcctcagcctccctagtagctgggactacaggtgctggccaccacgcccagctaattttttgtattttgtagtagagatggggtttcactgtgttagccaggacggtctcgatctcctgacctcatgatccgcctgcctcggcctcccaaagtgctgggattacaggcttgagccaccacgtccggccgggccactgactcttgactgcaatgatatcttcccaatttggcctttaaatcttgggtcaacgatatgcctcagccaaattaaaaaaaaaaaaaagaaagaaaagggattcaacttctctcccaaaatacgcaatttaagacaatcagaagatgaatggcaattaaatcacattactctaaaaagaacaagggcaacttttagaaaagcattcctttctcttttacatgtttattattaaccaacactttaccaattctaacaaacttgatgattggtgccctagaaaatttatatttctgatgaaattcatggattcttttaacgtacagatgaaaacaagtgtgatatgtaaaaatgtggacatttgtgacgtgtaattggccttcacttttacgcaaaagacatcttccttacaaatgattttttttaaagcacaaagataaaatgtgcttagtccactctgaattattgtaatgttctcatctaaaaccaccatctatcaaagattatcttattttataccaaaggaccatccattcaatatttatccttctcatcctggaaatgtgctcacacacaagatgagggccctacctgaggagacatttgtataagtcattttattagcttgtctctgaataaaacagaatagacacctgaagtttacacctaaagagcagcactatttttaggctgaagagtgtgatttctgaaggccaatattaaattacacattctgaaggcaatgagttaacttatgttatcttggcaacaaggagttattacttattttgtttgacctaaaaatagcaaaaatttgcaaagggaaagcttgttaaaatatagtatatacctgaaagaatttgggtggaaataaaaagctaattattacataactagtgagggagaaaactgtgtaaattgttctccttttgcatggaagttcctaacttctagactagttagccattgcttcatattttatgctttatttctctggctttgaggaaaaaaaaccacaggtcactgtgaactaagaacagtccttaaaatattcatgcattctcctattttccatacaatagtaatgaaaaaaattgaacatttggtcaattacagaaaatactactacaattttcaagttatatatgcacacaaataatacctaaattcagaaagaaaataaagcctctcatcttgtttcacagatttcccagtaggatacttgatattggcagtgaaaatatttgaaagcataacttaataagccacaattgcatcaacatctaaagtaaaatgaaataagtgagacttttatcctaaacagtgaaatagatcataatgaaaacactttggaaataaagaagtttcaagatgctatatcacaactgctggcttaaattgtcaacctgcatttctagcctgcatttagaataatggcagtcatccatggcaaagttcccctgctagtctgtaatacgtgaagaagaagaaagaggtctatttacaagattcaacttaccgttaggcagagaagtagcaaacactttaaagaataattcttggcaaagactgcaagtctaaggcacaccatttaaaataatgatccttctgcaatttttatgatgtcctccatttgttcataaaaaagaaaaaaaaagctaaatcttaagggaaattctgaacaaacagaagttccgtcgaacaaggctataacaataatagagcacttttgaaaactaagttaaactcaaaatcctcttttctgaaaagaggtgaagatatttacatgtaagtgctaaaatataagcatatataaacattgatattaccataatcaacaacttcaacataaagatcactctaccattgacctttattggtcacctgctgcatacatataagagacaagatttagtaataaagcttcctctagaaaaatcacacggtagtagagaggtagacaggttaaattgccattgcaacacaatgtgaaaactactttatttgtaataagtggcagctttacttcaaagatggtgccaataaaccctcccatccctgtatgtccgtgatatttatcccatgaagatatatagagagctgcaacagcaatccatgaggtatgtgcaggacgtggggcagctttggggaagaaacaaagctacagaggaggcacattaacagagacttgggaccttcattcccttcccttgaatctggactactttgtgagttccaatgacctataaaatgatggcagaagtgatgctgcaccagttttgaacctggttttaaagaagcttggtaacttccacttttgctcctttagaatccagacctctaggctgtaagatattagtttagcctaccaaaggaggagaagccatatgagagagaagaaagatgccagataccttagctgacgatcagtaccaactgtcaactacatgagagaccatcttggtcctgccagcatcagcggcgctcccacatcactgaaatagtttgaatgagctcaagcaagaccaacgaactacccactgagtccagccaattgacacaattgcaaaaaattataagttgttattgcattaggccattgaggtttggaatggttgattatgtagcaattgataactaacatgaagtgagaaaaaagtgatcaaggagtacataggcctatagaatccaacctgattttcccaaggctaatcagctaataaaggacagaaaggcaattcccctgaattctcatccaggattgaataatattgcaaaggcaaaaatacaagctgtattatttttcttattgttgttgttgttgttgttgtttgtttccaagcaaactctggctctatggcccaggcaccatctcggctcactgcaacctccgcctcccaggttcaagtcatcgtcctacctaagcctcctgagtagctaggactacaggcatgcaccaccatgcccggctaatttttgtattttttgtagagatggggtttcaccacgttacccaggctggtctcaaactggtgagctcatgcgatctaccgcccacctaggcttcccaaagtgctgggaacaagctgtttaatgcaaacacctgtggctgaataaaaccttaacccaagaaataacctgcactggggtacacattagtaccttcattcaataataaattcatagtgacccagaatctggctaatgtccacataacagccctaatttgagtataaaattaatctactaattacccagtattaaaatttgaaagcactatccatatattacatatttcagaagcaaatataactaatcacatgagctgaccctccctcagaaatgctttatatgagacacagtttaatgatatggcttctgactatactgggagcatcaatcatttaacagcatttctttcttttgcaaaattgaatcacaagctattatttgcatgtttactattgatcagtaagatacaaaaccctgcatggtgaattctagtagtttaaattctgggaaatagtttatgaaaatgaattttaggctttcaccctcagaaaataagtcatattatttattgtagatgataaggaaaattttaaatagccttgttttttctgtgctttttttctcacctcccacacttccttccaagcccatatgacctcatgctggcctaagttcctttgctacttcataattttctcaaaagcagtatttgaataacaaaattaagaataaaataaatatgtcttcttagatatacctcctgaaagactccgtgtccacaaatcactcagctcccttcctcaaatcaaaatgctcaacctctgagtacagctgatctcagctagttattagcatgcagctttaacacaatatgattaatttatatactgctttaagtctttgatagacttagagattgatggttttgaaaaacaaaaaacgaagcccttcaagattgcaagggagaaatatcaagttaaagaacagagaaaaaccgcaaagcatcacttgaggtatttgtgggaggtggggcagctttggggaaggaacaagtctaatgaggagccacattaacagaaacctgggacctacgttgtaaacttttcatctacctccctcaagaaatcatctggaatccccacactgcttaccattttctaagagcaaactctttctggtattggagaaaaatgatcaattctgtcttaaagttggcctaggttcaaaacgaatactcttcatggacccagctgacttcaagatcacgtgctttttacacagaaaagttgctgctaaaagaggtcacttttcttgcataagaaagagaggaatgatactaatattttagtctctaatagttatttcttaaacatattgaaaaggatgatacaaagcccagaaggattctacaccagacgaccctagagagaactgattttctacagaatttacacatttcaaacaaaaatacaatgttttcatggagggcacagaatagtctgcaacaatgtgatttatatggttctcttacttttctgacatttgtctcagaaaacgtgcttgaatacattctatttttctgcaaaatgtggataataccatatgttgaaaaagtaaaaacagtgtggttattttctgtgttctcaccatttggatattatttcttactctcttcacatctctttttcactcatctttagaattcttcaaaagactaggctcatgttaggtcacatattggaaaaagtagaattactagaaagacattctgttgagttcaaaagattcaattaggaaaaaaaatcaacagatgattttaatcaaatttgtaagcatgattaaagattatctacaattttcacgtccttatttgctttagtataagctgctatcaaaaataaatttccagttatctattaaactattgaaagacattttatgaatagataagttattctgttgagcttatagcttctttattaatttttacatattcagtaagaaaaaaggcagttggttcatccaaagttatgtctaaataacagtttaatacataatgtacataaacacagatttttctcataagacatcaggattacccacagttctcaagtggcatgattcacatttttaagaaatatttaatgcttcccttttattaaatgctttccacaacattgtgggatgtattgtatttccgaccccttcctatcaaatgtcagagaacctaaaaatcattgtgacaatcatttccaaatgtccatacatttccaaatgtcctccaaaagacaggaacacccagtcccccagttaagaactactagactcacaatatgattcaggaaggaaaacatcttcacaaaattaaaaccactgaaacctctgcttaatttggaaaccataatgatgtgcttttgcaactgtagcattagagtattggaacaagttttgtggtctaatgtagattcatactacaggtgtgctaaatttgtaccatgtgtaaattttttgaaggagtaatttgcatttttggtaacacagaatgtctccagagaagccatgcttaagtctagtaactaaatgtgatggtctggttgtgaatcagctggcctcagatacagttctttttactactttaaaaacttctttcttttgagaaaaagaataattaaatgctagtgtattgactaacctaatttatcctattcagtttcccacactgaggacagagaaaaaacaagcattttatacacctgtctaaagctattctgatcactaaaatttgtgcactcaaatatttagctgcaccaatattgtaatggatcttttttatgttacattgtaggaaaagacaaagaagtagaaatatagaaaggaagttagtaatgggtaaaaaagaaaaaaacccaaatattgtcaatatcctattgctctgcgaagcagagtgctcataatattttgagtttgagaaaccaattacaaaaaaaaactatatttttaaatgctttagctgatggaatggattcatacttcttaattgttctaagagaacctttcacctgctaactctattatgcatagtcataatgcagtaccgagtgaagatatttccattaacaactatttttggtatgcccattagacacaaggaaggacagtgcagtaagaagaccttaatcatagatactcctgacgccaaactagtcatatggccttgcccatctcccaaagagaaaaatactgctactgagcttttatttttttattttattttttttttttgagacagagtcttgctctgctgcccaggctggagtgcagtggtgcaagcttggctcactgcaacctccaccccccaggttcaagcaattctctctgcttccaggcagccaacacacccagctaatttttatattttttagtagagacggggtttcaccatgttggtcaggccgatcttgaactattgacctcaggtgatctgtccacctcagcctcccaaactgctgggattacaggcgtgagccaccgcgcctggccgctactgagctctttagtctgcatcagatcttcttaatgctaaatactttacacacatagttttctcacttagtgtttactgcatgccattatcattatctccactttacagatgatgaaactaagcctcaatcacatcaaaacgcccataaaatttcatgaaaataagagaatgacacttcatcttagttcttgtcctcccaaaaccagtaatcccactctaatcatgaggaaaacatcagacgaattctaagtaaggcacattctacaaaatacttgaccaatactcctcaaaactgtcaaggtcatcaaaaacagggtaagttggacaaactgccacagccaagagaagcctcagaagacataacacgtaaatataatttggtatcctggatggaattctaaatcagaaaaagaacattatgtaaaaactgaggaaatacgaataaagtatgcacttcagttaataataatgtatcaatactggttcattaatttgacaaagcacatttatataagatgttaaagataaaggaaactgacttggtgtaggtgggaaatctctatatagtgtactgtctctgctatttttctgtaaccctaaaactattcctaagttttaaaatatgttttaaaaaactaccatgctgagaaaaaaatttaaagtccttacaaaatggaaagttatactatgttcatgggtcagaagactcaattttgttaagatggtgattcacctcaaattgatatatcaagtcaacacagccccaatcaaaatcctagcagatgcttttagtaaaaatagacaaacttattctaaaattcatatggaatttcaggtgacctagaatagccaaacaacttataaaaaggaaaactaactttgagaactataactaactgatttcaagactaactgtgaagacaatatgataccagtgttaatatagaaaaaaagatcaatgccacagaatacaaagtccagaaagagacccacaaatatactgacaactggttttcataaaagtgcaaagtcaattccgtggagaaatgagtcttttccacaatggtgttaaaacaattggatgcccatatgaaaaaaacaaaaacaaaacaaaacgaaaaaaaactttgaccataactcataccatatataaaatttaacgtgaaatgtaacctagagccaaatgtaaaacacaaaactacacaacttctagaggaaaacatggcagaaaatatttgcaaccctagggtagacaaagatttttttagatatgacaccaaaatacacatcatagcacaagaaattgataaatttaacttcatcaaaaataacaatttctgttctttaaaacacctggttgttgtgtttgtttgtttgtttggtttgtttgtttgtttgtttgagacagggtgtcactccagtcgcccaagctagagtgctgtggtgcaatcatggctcactgcagcctcaacttcctgggctcaggtgatcttccttcctcagcctcccaagtagctgggactacaggcatgcgccactatgcccagctaatttttgtatatttagtaaggatagagtttcaccatgttacccagactagcctcaaactcctgggctcaagcaatccatcaacctcagccttcccaaattttgggattacaggcataagccaccaggcaaggccaaaagacattcttaagagaatgaaaagacaacccacatactaggaggaaatattttcaaggcacatatctgataagaacttgaatccataatattgtttaaactctcaaaaataaataataacagaaacaagccgaccaaaaaaaataaacaaatgtcctaaacagacacattaccaaataagacatacagatggcataaaacacatgaaaagatattcagcatcattcaccattatagaaaagcaaattaaaaacgttaaagactgatcatagatgtttacagttaacatatattacttccgttttgtttttaaatctctattttaaaaagcttgtttgacctggattccattcacctaagggtacatattatcaacatgacttactaccattgatatcaatcttgattgcctggctagttagtatttttcaggcttctcttctgtaaagttactcttttccaactctttacatattatacttttcggaaaaaagtcaccacgcttatttcacacttaaaaagtgggaagccatgcttcacttatttcagggcagggtacatagatttttagtacacatatctttcacatctttcacaagtcagatttatccctagtactgtataatttttatgctatcttaaatggtattgctttaagttttaatttttaattgtttgttgttagtgattagaatatatttgatttttgtatatcaatcttgcaatatacctaatcttgtttgttctagtatctttttgtagatcacattagattttctttgtagagaacaaataagagtaggaaataaaaataattttacttatttccaaaataataataatgtgagaaagcagtcttaactaatgggatgagcacagagtccagttaaagtcatacttctttatgtaaagttaccagtgttgggtaacttcaaaatgggtggcagaaaaatttacatgagaaaataattatttttaatttcctaccctctctaaaaagacatttagcaatgggaggcagtttactacatattcaccatatttaattcattcattcaacaaatatgcctagctacaaatttcatcaaattattttattctatcatgtatcaattttctaactgctaaaagtgtataatttatagtgttagaatgataaataaatacataattaactactcaacatttagtaactgatactaactgttagctatatgctgatcttgctaacagaatacataaaatacgttttaaaagcaaaataacatagaatggagactaaagatcataatgcacattgacgcaattaaaaacaaacattcctacataaactcatttctataattttacctttgtcttagcaacttcactttttgacatagtgaacaactcatatttcacatgtactcaccattgtagctttttaaaaaataatggacatactatacacactcctatattattttatatttcaatgctgaaattttaattaacatatacatatactcaataaaaacaataaaaaatatgactcattctctggaaaatttcattattaaaattactgttattttataatgataacatctcattttgttgtgccctaggtataatgaaacactctttttattataataaaatgcaataaaaagtgttcttccctgtgttactgctgttattttgaattatccttataaattttctgataatgagggtaggctatcatcaaaagatgcctccattaaaatataacaatgatggtaatagcttaaaacttgtattgtacagctgaaaattcatttgtacacatatctcttttcatccacataccaattctgttaggtgaatatacttaaccccattttacagatgtatccccatttatatgacaatgatcataatagcttaaaacttttattgtacagtttaaaattcactttcacacatatctcttttaatccacataccaattctgttaggtaggcattattattatcccaattttatagatgtaagtactaaaaagctaagttgttttccttgtcctaagcaacacagctaattagggaagttaatttttctccactgcttttaatcacattaaactgatccttctattcaacacatgaagttaacattctatgaaaataaaactggaatctctgagtctacattgatcacaaattgaatgtatcctctcaatacactgttttagtcctttatatctttgatagaagtgaacatcctaattatgcccatgagttacatatatgagatgccttcaccccacttcaataaaactctttcttaatgccaatataaaaaatactctacattaattggtaattgtgaaaagagactcagggagagagtctgaatcaacaaaagaggaaaatataggaaggaaagggaaagacaaagaaggagggtgagacagagaagagagaacaaacatccaggagtagtgatgtgaattatttgcttagttaccacaaaagtaataattacactaactctgtgggaacaatggtaatttcacagtagctcacgttactgttatcaccttatatcctgataactgtgaaattaatttgtggcactactgtatgtgtcggccataagctgttcccttggtaacagtattatgctaccatagagaaggaatgtttggcagtaaaatgggcagcagcaagctgattacacagggaaaagcttctatctaaatacacatagcataacaatcacccctggaaaaactacatggcttaccaaaagaggtctctctgttcactgtccattatctgttgactgaactagttcaaatgaataacaagtaatgatcaaattgccagtttatattttacaacagagtcttatctttaaaaaaatgcaaggaggaaatacaaaaatgtaatacatttatcttgctttcttttctatttcctcccctgaaattattactatgctattggaagccatacaaacacatatatacacaaatatacatatgcttcaatgaaaagcaggcatgcagctgacagctcggcaaccctgaggtataaacaaagataccagacatattttttgaaataattttgctcaaggaaattcatttcagtaggaagatcagttactctgctgtctcctacctacaaagttacagaaggaaaagttcaacatttggccaaaaggatagtagcttacatttcttttttttccttttttcagcacagaattttgaagagagaatacactaaaagggaagaacataactacatgacatcataagaagtcctgaattagaagcgtatatttgaaaggtcatgcatcctgagctgccaacagcttaacaaccagaggcagaggccagctttgccagctcactgcttctactcatctttcatgatagtagccaggctgaatatagttccaggatgataatgaattggctgggcatactgtttatattagtatgtatgttcctgtactaaaccaagcatcatgaggccagcactattttgccatttttcagaaaaaaaatatgaacccttcaaaacatagtaagccttttttaaagtatatatttgattttgaaataatcaaaatatatgtagggatatgactgcatcctaagatttatgataagttctgatgagtaatattttctttctacatgcaaggcaaagttaatagtaactagaaagtctttatttggcatatcatagatttctgtcaaccaaaacaactaactctggggaacataacgttctgacaacttcagaagagttaagtcacagacaaaagtttattggatcttagttggctcctacccaccaattctttcttttccaagtggaacataatagattttcaatatttgttaaataattgaaaaaatatcctcaaaattcttttttggccatcttcccaacaagaatatggtcctaacctatatgtagagtcctttgctgtgtcatctatttcttcagaattattctcctaattcatatgtctggatagtctctctgaattgttatagaaaattaaaaatgtgaactatgaaattaatttttaaacttttataaccatctagtcatacacagaataaccacaaatataaacatggtttcaaagaattccctgtgacaatcaagcaaatagtgaaatagtttctgctattatgaatttatcacttactcagtgtatgaccatgggcaaatatcttcacctcaatcctgtgaggcaggtactattattctacccattttaagtatagatttgcaatatttgttaaatattcaatatttgttattataaaatgagtatactaatagtacctacctcacagtattgaggtgaagatatttgtccatgtacgtacaatatgggcataataatagtacctacctcacaggattgttattaagaataaataagataatccatacaaagtatttaacacattattgaaaaattaaatgatcaaaataaagcttgttgttattgttatcttttaataaatgcatctaaagtatttttaaatgtattcacttcagttatttaaagtttcatctgctgtatcacagagcacatatatgttcagaaacatttgttaagtatctatgtaccagataataaaggtggtattgaaaaaagaataggcattgtaacaggcagacaggagtataaagtccagccttgccacttatgagactcccatcttcaaattatggaacctttctgaatctccattttatacctataaaaaggggtagacattacgtctctacttgcttcttatcattaaattaaaattcatattcctttctatggcaaggaaacgagtcctgtatagtcttgtaattcatctccctccaccaaacttcatccacactgacttctttaggccaagcttgttcctatatcaaggtgagcctggaagcctgtacactgttccacagtggtacacctcctctagccctatagaatgcaaaatggaagcacagagacattatacaatggttagccagtcacattacatcaagtaaaaacaacaagttaccatgaagtttatttattggagtggcttcagtatttcttgagaaacacaaatgatgaccctgatttgtatgatcaatcagcaagttttcaaaaaggttactgagtatatgacagtaatttctagagccaaagatatacccgcatgaataagctttcatcctgaaaaaaaaatcaccttctgaaactccatgctagttatctgaaataataaaggtgaagtacaaattatgtgatctatcataacctgaaataaacatatgttgctactctgtgatttggtctttatcccagtctgacccatttcttgagactgttacctcaagatgctctcccatggagctttcactgagaatactttaatccattttcttaaaaatccataacaaaattactaagatctcaatgtcttatcaaaacttttttttgtctcaaaaatgatacatgaaaaagataatcttcaataaatgcaggtaaagtattttatacctgcagcattgaattgttccactggagggtagcagggggaaagaaagttcacgttgcctagaacagaaccttgttgttaccttaaagtgtgttctttctgaattttctaattcaatcatcatctcttccaatgcacatctccaaacctcccatttcacttgttcaattcccccattagtagtgatatttatgctcctcaggatctctgtgtagcaaagtcctttagcgaaggcacaagaactagactatagaaacattcaaattccatatttgccatttattttttgtataaaggtagatgtcttcatattaactgtaaaattagagtaataatggtagtttaaatttaagtaataatacctacttcataggagtgtcacaagaattgagtaaatatatgtaaaatatttagaaaagttgtttgcacatagtaggtgagcaacaaattatagctattattattattgacttctcttattttttcttatctatttacttcaagtttttactgttcaaattctatttttcatcacttcaaataactctttataaagagcccccttgcagttcttccatcatgcctttcttagaatatcctaagtctagatgaaaatatccatgtccacggtgaaaacctatgcagaaaactagcctcatggtctaacctctgtcacagatcgagctctcaacactgcacagcaatggaacttaacttctttggtcaaactcccactctcccattccccagaataactcattaaaactttcctctttctcttccaatttccaagccagtcctattccattccttcttcctcaccagataacctttctttctacttctgtgacaaaacaaagttttcaagtggcactcccaaatagtgctgccaccatctctgtggacctatttgtaactgccactgtctttttttctgtctgttatcatgatgctgtttctgaccctcctcccagtaaacaggaatccccacaagtgtaactagattccatctccttccaccttctgtagagtcaaatgcttttaactttcatctcttctgttgtttcttggagcctccttaataccatttaattatttttgattgttccaatctgataacatttctccctgagtcttacatctccttcctcctctgcacagccaaaaagtaggaaaaagtttgtcatctatagtgacaatctccatttcctttctttgcattcatccatccattcattctacaacctattccaattgttatggactgaatgtctgtgcctaccaaaattcacatgttgaagccctaatcccagtgggaagcctttggtgggtaatgaggtcatgatggtggagccaacatgaataggattagtgtccttctaaaaagaggacagaaagctagttaatctcgttccaccatatgaggacacagcaagaagacaatactctgaaagtcagaaagagggccttcaccaagaacctctactggctccttgatctgaaactcctaacctttagaactgtgagaagcaaatgttcgttgtttaagcgatccattgatggcattttgctatagcagccaaaactgaccaaaacaccaatttagcttctgttcctactcctcaaatggatacagcttatgtcactaattatggccctgccacgagcttatattttactgagagagatgcattaaagatttttaaaatgtaagatatatagtatattagatagttgtaagttctcagaagaaaaataaattagaaaaatggataagaagtgttaatgctataagttgaattccaattttatatggtagccaaaaaaggcgaacctgagaaggtaacatttgaggaaagaactgaaggatgagaggaagtatctgggggcatgcaaatatctgagggcagagggatcagcaaatggaaaggcccattatttttctctctcgtgtttcttttttcctgtattctgtgaaactgttttatggtttgcctcctctcccttattgaaatttcaaccatgtgcagtaactattcactgcttagcatgtttttttccaatttctgtagttcttgtctcaattgtttaatttaaaatgtgataaagattatttattttattatttgactagtagtgtctaattttcatacaaacttaacatatctccttttaatattttagaagtaggatataaaatataaataagaaattaaaattaaaattcatcagtatatcaattgagcttttactttgtaaagggcactatgtctaacagaaaaaatgatgcaaagaagccagattgtagtgggttgaggtatgactgggaggtaaagacgtagagtcacgctgttcagactacatattcaaaaagcttggcagtgaaatgccttccagataaatttgtagttggatacagcacaattctgacagttggctctagcaaattctttcaggtttttaaaactatttaattatgaacatatgaacataagccttaattaagacaaatctttcttctgcctgaataagaactgccaaaatgtcagagggcaagactaaaagttcctgtctgaactcattttacagtctccacatttgcagactgtataatgctccatactaccagcaatcactcagcacattctcacactgttttagggtcacctcttctgcagtaggaactttggacttacacaataagaaatatataaggaaccacagagtcagaagcagcttgtactactcaaagcacaattttccttttggggcctcagatctatccctcagatatttattttaccaagactcccaactatatcttttcaagattcactgtcaagagacacctgacttttgagatcttatcctcccttagtatagaagtcccagttctcccacttatccttcttgccttggttgaactttctaaaacctagatctcttgccattaaaagtgtcaaatttccacaaatccacaaaatcaatcctttttctcctatgctatagtccaagatgttgtcctgaagtaatttcagactatttttcaaaagttctattggatcctatgtcaatttttttgtgatgtttgctgttcgtttaattcacaacatcttttcctcaaactaaactgaactggcaagaaacagataccagcaaaaaactgatacaggcaaagtttaaatgattcaaagtttacttcttacatgccttcaacataaaagtttattaatctttcaaaatgaacatattctctcaaactgaaggtatgaaattattacaatgaaaagaaactaaatatattaaatactgtataattatctcatttatatggctaaggttattagcttatatatggtgtctttaaaataattcccatttgcagttacatttcaaactgccgatttgacgcaccagtcaggaggaatgccacgactcctgctgtgctaaacttactgaaacaaataggaaaaacactttattgtgttttgttcctgttttactattttgtaattggactaccctacaggaaatactcttctttataatatatcactaagttactataataatcttgtttcatgctcttcctttacatatattcctgaattatcatttgtcatgggtaaaaatagtatgacagaaaaaaattgagacattaatcaaaaaggtgttttaaaattactgataatggtgattgctcttaattacatgattgaatgtatattcagagaatgaaaatatggacacacatacttctatccaagtatctatgaaatgggactacacaaaaaacagagagatgagaaatattttgaaaaatgtgacttctccaattttttaagaaaaagattaacagcatatatttcattattaaaagactacaaagttccccttctgattattaaatgaaatatggctgaaaagttaaaatttccttgtatataaagcagtcttgaaattcactcctgtaaactatgacttagggttatatttcattatgcttatatattaccatgcgttacatggttagttttaccaaagcaaataacttttatgaaaagtgctgatatctttattgatgaatttaaagtgttaattcagaaaatacttggcaactccacctcatatgtacctggacttaaaatatcaagaccatttttaaagtgaaaataactttgaaaatattttgtcactgaagcagtgcaattcatttaaatggttttaaatcgaagtagttttatgaacaattgtgctaaatagcaatgaaatttcatttctagtgaataatgaaaagtctcatcacagtctattaaaaaaacaaaatttgttgttatattaaacgttatttttcttgacccttattctcatttgttatgaatatctctgagggaaaaacaagagcctatgtagtgggatataatattcaatttagaaatttatataaataatgcctgttctttatgtattatcaccacttactaaggatcaaactacaagaatactaaaagattttactttacataaagacacatatagaattttctcagaaatagacacgcttgtgagtagtgaaacaattgaaaggaattaaacataatcatgcaaattacttcccataatataaagtcctaaaactatttgtgaagtctcaagatgttaagatgctatacaatttcattaagaaaaataaatgaaaacatttatttcataaaacattaattagacaaattctacagtgtattttgagtttatctatccctacagtatgtcattgatatttatcttcctacaccaaagtcaaagtcatttgattgtgttcacccaagtatagcatactcaatgatacagaactctctccagagaaaagagggaattaaagaaattagaagataacaggttgcatattctagctgtaaaaacagacacttcaggataggtaagtgtttaagtggtcacataaaaagctcaattaaaactaatttaacttcatctcttaggatttgtaaacctattcttttgagcattgaactgagttgacaggacaaagttatccttaattattatttaactagaccaattaataactaattcttaccaaagtaataaattatttcatttacatatgaggtagctgcaattctattatggttttataaaaaagataaatactaattttgcacttgataaaatattttgttaaaacaagcaatctagctacattttgattcgtttaaatgaaatataaattgaaaagtaaggatcacagagattcagaggcttactaaaaattacagtcagtcccactgacagagccagatgcagaaccctgggaatgtaggagaccaactaaaaggcaaagcaaatgaatttggggattgaaatgttgagtctgaagtttttgaagaacaatcaaatgtcaaacaaacatttaaaactgtaagtttgagattcaagagggtgactagggcagagaacacagacttgagagacactgatacacacagtggataagagccaaagaatagaacatgaacatagagtgagaacaggaccaggcacgaaactttcttacgtgtccagattttaaagaaaatataggggaaaaaagacagtgggttaaatattttgcttgaaataaacaaaacagaaagtaaattattttaaaaagcacagttttgtcttcctttaaacataatgatatgtagttgcttatattcaatcaatccatgactttgattaccaaaacaatgtgctgaggtagacacagaaaggaatttcaccttctaggcataatgtagtaagtcacaggaggccagtgaatgttctctctgctaaaatctagaaaaagctggataaaccacaacaccatattttttagaggcataagagatctgagaaagcaaggagaagtagacaaacaaaagttcctaagagaggagaactttcttaaaatgggctaaggagaaatcagcaaaacgtttaatgatcaccggcacaggcggaggggtgttataattggaaaattaagagaacaaacacatctgtttccccactggacacatactgaattcaagaggtttgtgggaggctaaaaaagagaggctagaagcttccaaaatacagaaataaacaaaatgaatgagggttcaggagaagcataaaatgtaaactgtcagacctgaaagaaaaaaactgaccaaattcaaatcatagttggagattttagcaaccctctatcagaatcataaataaatgacagtaatgatactgaagagctagataaatctacctattgcctcaatctaactgatatttatagaacactaaatccaacaattgcagaataaacatttttgtcaagttcacacaaaacattcaccaagaatagaccacatgcagggacaaaaatcaagtttcaaaatataatcttacacattttattttcttgccataatggaagaaaattagaagtcaataacagtaaaatctagaagaaaatgcagttgtttcacatcttcaccaaaatttgggttttgccagtgttcttaatattcatcatacaagtgggtataaaatagtatgttactgtcgttttaatttgtgttttcctgatgactaatgatgttgagcacactctcaggtttctactggatgtgtgtatatcatcttttgggacattttttactcaaatattttgactatttttaaaaattgtacatacttccttttttagaatattttaggttcacagcaaaattcaaaggaatgcagagttcccatatttctgctacccccacacaagcaaaaactccctcaccatcaacattctgaatcagagtactacacttattacaatgatgaactaacattgacacatcattatcacacaaagttcatagtttacattagaaatcaattttagtgttgtatatcctaaggcctttgacaaatgtataataatatggatctatcatgatagtatcatacgaagtattctcactctcctaaaaatcctctgtgcctcacctattcatctcttcatcttaaacccctggcaacccctcatattttcactgtcttttagttttgccttttccaggatgtcatacatttggaataatacagtgtgtaatcatttcagattgatttctttcatttagtaataagcatttaactgtactccatgtcttctctgacctgatagctcatttatttttaactctaaataatattcctttgtctggatgtaccacaatttatttaggctttcatcttctaaagaacatattggttagttcaaagtctaacaattatgaataaaactgcagtaaacatccgtgtgcaggtttttgtgtggacataagttttcaattactttgggtaaatgccaaaaatgcaattgctggactggatagtaagagtatgtttaattgtgtaagaaagtgccaaactgccttccaaagtggctttactaattttgcattcccagcaaaaatgaatgacagtcccttttgctccacattctcatcaacatttggttgtgtcagtgttctggattttggccatcctaattgtgtagtggtatctgttgttttaatttgcaattccctaatgacatattttcacatggttatttgccatctgtatatctttcttgatgaggtgtatgttcagatctcttgcccattttaaaatcaggttattttcttattgttggattttagtgcttctttttatatttttatgtcatttatttatctgttatgtttctttcataaaatttttaaccagtctgtagcttatcttttcatttccttgacagtgtcttttgcagagcagaagtatttaattgtaataaagtctaacttatcaattgtttatttcatggatcatgcctttggatttgtatctaaaatgttatcaccaaatccaataacatctatattttctatgttatcttctcagaatatagtaggcatgtgttttctatttagttctacacttcattttgagttaatgtttgtgaaaggtgttagatctgtgtccagtgtgtctagatttttttttagcatgtgtatgtccagtggttccagtatcatttatcgattgaaatgcctttgcacctttgtcaaagacaagttgattatgtaggcctatttctgggctctgtattccagctcattgatcgtgtctatcctttcaataacaccacattgccttgactactgcagctttacagtaagtcttaaatttgggtactgtcaattctcagactttgttctccttcaatatatgttagttattctgagtcttctgcttttctatataaggtttggaatcattttgtccataagcaagatataacctcctgatattttgattgtaattacactgaatctgtggaacaatttggaaagaaccaacatcttgagaattgtgagtattcctgtccagaaacacaaaagatgtttccatttattttgtttctcttcaatttctttcaccatatttttatagatttcctcatatagattttgtacctatgttatgagatttattaaatatttccttttttggtgctaatttaaatgatattatcttttaaatttcaaattcttattgtgcattgctgacatatatgaaaacaattaacttttgtatattaatcttgtatctggcaaccttgcctattagtaaggaactaataattgttgattagttctaggaaattttttggtcaatttttaggatttcctacatggacaatcatgtcatctgtggacaaatgtagtttcatttatttcttcccaaactgtacacctttattttcttttctttctcatcacattagctagtgctgccagtatgatgccaaaaagcactggtcagaacgaacatccttgccttgttcccaatcttaccaggtcttaaattggggtttatatctttttattatttaaaatatttatttatatatccataatctttaaaaaatataataaatatatggagtaattttattttgtaaaaacactgccaaactgtcttccaaagaggccataaactttaagtgactctttcactgcatttgaaaagttttcatgtttaatttcattgttcagttcaaaatatttttttaatttcccattatttattttctgacctatggttattttgaagtgttaatttctcaatgtttagaccagtatggctaaatatgagagataaattgagttctaaaatataaagtcatggaggcagtagaggggatcaggatcacatagggcattgtcagaattttgactttaagtgcagtttgaaatcactagtgggttttgaacagaagagaaatatgatttgaccaaattaaaagatcactcaagctcctgtgtgaagaacagtctttatggataccagttacaagagtaatcttcaaccatgactgcattctgaaattatctgcaatgggatgcttcaaaaacactgatgctaactgctacctctccaacacatacacatacacacacagacacgtgattcatgcatgcctgtgattctcatttaattgatctgaagtttgtattgggattctgttaaccaccctcaccacacctccagcccaagatgtcagctgttacaatagccagcaattacggtggcttggactgaagtggtagtcttagaggctgtcagtcttttaatattttggatatatttttaaaggagagtcaacaatagtttccgattgactgagtgtagaatacgagggatggtttaaaaaagactagaagagtcaaggactacctaaaatttgggagtaagctaacttctgttgaactacaagacaaatcagtggtcacagggagatgcaggatagctgaggtaccatgtagtatacacaatatcacagaattaagtgtctgaggtaactgtgagagtaggtgactgggttaaggtggagaaccaaaaatactggagaagaattgaaggaatagaggccagctactgaacgcctcatctatgtaggttattgaattaacaaagaatcaggacaaaagttggacaaagcgagcccagagacaaactttataaagaatgaggagtgtgaccaaaggatccataggtgtctacaggaaggatgggtaacaggcaatatgatataatgggaatcacattttatagatttccagaagagaaaggtaaaataaacaagcaccggccgggcgtggtggctcatgcctgtaatcacagcactttgggaggccgacgcgggtggatcacgaggtcaggagatcaagaccatcctggctaacatggtgaaaccccgtctctactaaaaatacaaaaaaattagccgggtgtggtggcgggcgcctgtagtcccagctacttgggaggctgaggcaggagaatggtgtgaacccaggaggcagagcttgcagtgagccgagatcatgccactgcactccagcctgggcaacagagtgagactccatctcaaaaaaaaaaaaaaaaaaaagaagcatcaacgggaaataaaaagggcacttacccatctcgcttaatacaacagatgtgaagagaaaacagcatcatgtgttaaataattatatagcatatcatcctattttccctttaattacacattaaagggagtgaatatttaaatttgatattgtcaaataaacctgcaaagaaacattctactaatgtacactctcaccaatacagttccctatccatccagttacaccagagacctgactgttaattctcttctcccatccttcacattttacatcctaaacatctctccaatccctgcacattacttgagctctaatatccatattagagctctcatatccatctcttaccaaaaccagtatgacaggctcccatgcagactctctgtattcattttagatccttctgaacctttttatttcagccagagtgatatttttaaaaattctacaattatggtgatatatctcaaaagcttaattattttacatacttacctagtatacgaaatactcctagtatagagagtatttagtaatacgaaatactcctagtataaagacaaaatttctcaatggggtttcccaaggttggcccctacctatagcttcaacctcatctcccacaatgtaactccgtaccctctgcgtttttcatattggtcttcagttactttcatctaccccatgcccacaaatactttacatcagaaaactctcatttatacactggcctattttcttagcctatatccacttacccttctttcagacttcagcttgattaactctttgttgaagactcccctgtcaaatcttcctataatttgttgaagactcccctgtcaaatcttcctataatttacactcttagcaacacttcttcctctttgtagaattatcttagttacaattttatatacatttgtgtggttatttgatcagtgccacctgcctgcccgttatccaattttcatgaggataaagctcatgaaaatttgctcataactgtatctccagtttctacttgtactttgtatatgtaagaactcaataaatatttgaaagactaaaccaggtgtaagagtatctccacaaatgttcaatgccactgtgccttcaatggccttacactataattcttaaactagagtcatcccttagatataaatgctagtagtattcacaaatacaaacattgctcaaaacaataaatatttcaatgtaataacccctctttcttaaagaaaacctctaaaatgtcatagattagatctcagccccttgcacataaaaaataactttgtttcgaaacttcagttttacaatcaatcagtattcttaattccatcttaatacacatactaaaatttaaaactatattaaaatacataatcatgttgcaaacatacataacttttcccctattataatctccaaattgtaggctgaaattcaaagtgtatatgatagtgcactgtaactcttagctataaatagttcttataaagcctaataccctttaattatcaatcacagataaagagtctgaggtcattaaataaattaatttaaaactataaaaaagtgatacatacacatttgaaggtatcattaagattagaaaatcactataagtggaaattttagaaaacaatacaacagtcatctctttctggtgataacttctttctttcctcatcagttattatatagctgtgactattttcagattttcctttacccactgcttcttccccactggttttgctttaatcttccctcatgattttagaattaataaatgcatgctgatgacttaaaacattttatgcacatcactggcttccatctaaatactttcaaaaaaccacctcttttgacagtaaatctacccctaggcactaagctttgaaagcaggaattgagggctgttcattcttataccttagcacccagccttgtgcctggtatttgacaggcctcataaattaactgaatttaatgatcaagaacagaaaaagatttgcctcatattgtttttagtaactacaatcactttctgtataattagagataaacctgaaatgtgataagccattcaaaaatattcaatctgaatcatggtgcaaggaatgtgtgtgtataatatttatgtatgtcttcaaacactaaggacttttttccaaagtacatttttaagactgagtaccctaacagtaacacaataatctagatttagtcaagtcaaatttatctactatgctatatatttatgaggatacaaaatataaaacttggcttatggagaggtattcatggtcctaaattatttggcattttaaaaaatactctatttctgggcatcatcatatttaaaatgtatttgtttttataaacaagcagaaaaatcataatcacaggcatacaatgattcaggtatgtctagaaattattagtttgctcatattaattataggtttcaaagagtatacgttagtattgatatagtcaagaaacccttctgcaataactatgtcatctatggaaatatgtgtgacaaaaatatttatcatgctctttaaaaacagacaggtactttggtggaagtactgaaagaacaatcaattctcaaaaaatttcagatgaacagattataatcccgagtaaatatgaaatgcaggacaagtcttgtattaatgccaaagaacaatagactttcattttggtggaatgccccatacaaggaacaactttcagactgcagttaatggtagtgactggctcgaactggctacccaatgtatttaaattatttaatatagcttcctcatatgcaatcatctacctttaattatgtgtcaaaactagtaattattttcattcacaggaagaaaattcttatcattttttcactactaaaaagaaaaaaaatctgattccccaaacagctttttcatccaagctgtttaaatttcaacccaattcttacctctgggtgagaaatgtctcaagcaatattccctcccagaatatgaaattataaacatcatctaagaggatgaagaaatgaaatatgaagaaaaaatatgacaatgacaaatataatgccagtaagtaatttaaccttattgtaaatcatttttctttccccatctaaaagaaaaaaaagaattactctaaactctcctgaaagatagagaaagatgctagcaagataattggtttgtaaacatagcacagatatcaactaagagtattacctctgtggtccaatgacaaacacccatttccactaaaaattgatgttatggaagatctctaaataaaattactactattacttctattccccagccaaaataatgtcccttaaagtgggacagagctataagcctgaagttagaaaacatactaaattaaactaaatttcctagaccccttgggaaacattaggaagactgatctttaaatatctgtatataatttcatgatatctattattttattcctgtattcctttaatgaagctttctctaatatgtgcataaagtgtactgacaaagtacttttatcccatggcctagataggaaacacacagacacacacacacacacacacacacacacacacacacacacccctaaaattttctgagaggtaatgagttctgcaagaggaatgagtctgggttcaaattctggctccttcaattttgtgccatatgcccaaattactttacctctttcattcaatttttattcacctaacctttattgatctcttttggaaaagatgacactgaagctgagagctgaatagcaagaagcagcaaggcatggaagagcccatgtaagaaggagcccaggtaagcatcaggtccaagcctggaaagttttagggatggaaagacggttggtcagaagctttgtgagcaaggctgaaagaggttagacatatggttaatgagtcagaggaagatcacaaaggtttttgcaagacaagttaggagtaaggaatttgtcatttattctaagtaaaatagcaagcctttggagagaaaggtcacaatttggttcatcctggtgatctgtggaaaatggatttttaaggaaagaatgtaaaaagggaaattagtagttcagatgagaggtaaggagggtagcaggggagaaacaaaactggacagattccaaggatatagctttaacaggaatttttatacaactttcttactgattagatgcgcatgtgagagagaaaattttttccacgaattccagatttgtagttcaaataactaaagatgatgctactgccatttactcagatagaaagacttgtggatgaattggttcagtggagggttgtggtgagaaatccaggaatctccagcctggccaacatggtgaaaccccgtatccactaaaaatacaaaaactatccaggtgtggtggtacatgcctgtagtcccagctactcagtaggctgaggcatgagaattgcttgaatctgggatggggaggatgcagtgagctgagatcgtgccactgcactacagcctacgcgacagagtgagaccctgtctcaaaaaaaaaaaaaaaaaagaaagagagaggaaagaaagaaagaaagaaagaaaggagagaaagaaagaaagacaaagagagaaaggaaaggaaaagggaaagggaaaaggaaaaggaaaggaggaaggaaggaaggagagagagagaaagagggagaaagaaagaaagaaaagagaagaaagaaaagagaagagaagagaaaagagaagagaagagaaaagaaaagaagtccagatccagatatcacctttggatatgttaaatttgggttgttatttacatactgaagtggctaagtcaagtgtctcattgaagtgtaaagctgaagtttttttaggggagacatcaaaagtagagatgaaagtatggcagttatcatcaaatagatggttatctaaggaaagaaatgataactacctaggaacagaggagaaaatagtagaaacaaggcattccaattttatgtcctataatatgtcaatatttagacattgaaaagaggaggacatagctgccaaggagagttaaaaggagtggccaatgaagcaggggaagaataaaatgatgtaaagtaacttaagcctaggaggaaaaatgtttcaagaaaggatagtcaattgaagcaaatgctgcagaccagtcaagtacaaattacagatttggcaacacagagcactctcactgaacagacagcaagagatgtccaggtggagtggattaaggtgagaccaggagattagaaaatgaaaaacctttattgacaactctttcattaggctttgagggtgaggagcaaaatggagtggcacctggagaggaaaatgtagacaggtttcatttatttgtttgtctttaagatgcacaatatgcaagtatgaagatgtaaataaccatgtaaaagcaaaaattaacgtttcaggagagagagagtaattacacaagggaaacttttgaaaagactagaggaaatgggatccagatcacaagtgaaggtgttggcctttgacaggagcaaggcctttccagccaccatatgaagccattgaaattagggtttattcccagttcactgcatatctgcacatatcacaacagctgtcaccaaataacatcttgcacatcaataaaacaccaagaacatttacatttttaatttttaatttttttttttttaggagatggattctcactacattgcctaggctagagtgcaatggctattcacaggtgtggacactgtacactatagcctcatactccttgtgactcaagtggtactcacaccttagcctcctgagtagctgggactacaggtgccaaacacattttttaaatggagcttagaatatcctatataccatctcctttcactcaaaaaaagagaaaaaaaaaagaaaatacaaaaacaaaaaaccctctttgtagactacaagaaaagtattcaagattcactaatttattaaatatgcattgactaaatttttaataaaagtaattctttagataattccatgggtataaaacttacaaaggcattaaaataatagaccacaatcaatattttttcaatcggtagcagatatcatagatatgccttagtatagataccatgattcatctacttaaaagaatcataaataaactaacacaatgttgtccttttataagtaccatactatacaaagctaattgtccaactaagagcaacattatactgtttcataatgtaaatgattcattggtggttattccacattttaactataaaacataaacatgaataatcaatgctagttaattcagtggcactagtacctatgtctcatgtttgttgcatattggtgatttcacaagctagattgtctgtttaattcctaatcacactaattacttgaaagagtaatccaggaaatgtgacttattcaatttcaaagaacagcctagaaattagtagatagggcacctcagtaatgttatatagtcatgttcattgataaaattggaaggacttcatagtatttgtattaatctatcagagaaaatcacaaattcttaatatatttctccaaacattatttgaaatttcttctaatggacttaagtcatgtttgctctcaaccaggggtctgcaaactacaacacaagggctaaatccagatggctgcctgtctttataaataaaattttattggaacacagccacatcaacacagccacacctatgcattcacatatggtctacagatgcctttgtacaacatcagcacaattgaatagttgtgacagaaattatgtagcccagaaagctaaaaatacatgctatctggccttttacaataaaatgtttccttacttctactcgattttcaaaagaggcaacacattttttaaaaacaacttgtcagaatgggagacttttttccccaaaataaaataaacacaaataccttcaatggaaggtatttagtacacatcataataacctgtagaaatgctggataagaaattgtattaattatcttctaaatggaacaagctgatatatgagaaatgagaaatattataactaaatgtcaatgtctatcttccagaagagatgacttacaaaaaaacatagggccagctattttattatagtatattgtgacatatataccaaataattagaacgagtaataaaaaatgccaacgtgcttataaacaatattatctgtaaatctattctattagtcttctttagttgtagaaaatgacaaatataattacaaaatacttattcaaaacatgtaaaccactaattttccacttgtaaaagcctgattcaaaaagcaatttactttaaggtttacttaagctttgcaactacattaaaatatgatagtatatacacaacagcttgttaacaagattatcataacattaaaatcataatgtggcacttcaattatggatacttaaaattaaagctaatcctcacagtaccaatttttatctcctaaataattttagctattagctgctcattcaaagtctgtatctaaaatgataagcattctagagtaacgacttagctctgcacttttctttggtagcaaaacaaaagctgcatcccttctttcctagtccttaatatacaatcttttgatactaaggggaaaatgcagttttttcctgaccttgcttggctcagagcttcttactcatgttgctgttgccaatgctgttgtttcaaacagatacattctgtatatcaatggtacatatttcttttctggttttatctttccaaaaatatcaaactatcacttgcaatattaatttgatattttctgcaaatactatgtttgaacaaatgtcacctagtacctactaggcaccaggtggaacaaaccaatgcttagattaatgagtattataatgtatttcataaataaataattaataacaattaattgtgttagcctattaactgatttcattttttctactgtttcaccagatttgtacttgataattatgtaatcaatatttctcacctttgaattctaattcaagtttaaagtgaaggaaaagattctaaattgaaagaattctgtatttataaatgacagttaataacaaatccataaataatccagaagcattgttgccgaccatatggttgattttactaaacactggtaacagctaatataattgttttcttctatttccccaattaaattatatttgggccatttgagcagtgagattggaaactgagtgtcaaatcttgctttcactcactcctaaagtgaatgaatggaagtaatattcctaatttacatggcaaacagataataccaaatgtgtgtatccgtgtgtgtgcatgtgtatatatgtgtataaagacatatacacacattcatattacaaaatgtacatgaaactaattatataaattaccaaatgtgtgtatccatgtgtgtgcctgtgtatataggtgtataaagacatatacatacattcatattactcaaggtacacgaaattaatcacatacattacaaaaattacataagactaattacatatattttctgacctgtatttcaatgatatttattagggcaggtgcatgattatgtaaagtaatcatgcacttttgtcttttgatttcaaaaaaatctgaaagtactcatcctgattgacttcctcatgtgttaggtggcataaaccaaatcaaagaacctgctctggacatggtgaaatatgtgtttttctgtaatagaaatgataaagataacatgttctctgtgcatagaagacaagagaatactcttctctgctgatttggggagtagggctttcaggaggttcctgctgatctatttagtgatagaaaacttggaaaaacataattaagatagaattttagaaatgattaaaatagaaaagagttgaaacattgcttctgaatccaatctcactgctcaaacttttcaagtagttaaaatatacccttatacatgggcatttctgattataaaggaatttgtttttcaacactttgaaaattaaaaaaaagttacaaacgttaaatcatgtattactacttccatcattacataacattttcagaatgtttaaaaaattatttactttccatactattaaacaacctgctaatttcactggaagtattttgttaatactttctcattttatttattttatattcttcttcaatgccactttgatttttccctcatagctttatatttactttgtaaactacttaatcaatttgctaatctcaaatacttagcatgccttgtccttccactcttccatttttaactattttaaaagaattccataaaatttccttaaatctttgtaatcctaatgaatacacctgaaaggcaagggaagtccaaactccaaatgctgtcacagtgcaagttttccttgactgcaaagaggagattttatagagaaatatatccatacatatacacacatgtaatatctatataatacataccacatatagaaatatgcatacacatgcacacacacaaatctctaagaataagataaagtagaataatggccatattattatctttaaatcttattcagaggaacaaaattactcggttcatggtttactaatcacagcttcctcggagtcatggttcatgtagaagtatcagttaaagtatcagtgtaattcaaccattatatttagcaacagatgcaatattaacataacccaaatcataaacagctaaaataatacctaggttccagtagtaacacaacccttaggtcagatggtagtcaacaccagtactactgaatactaacagaggagtgaaattaaagacatacattaggctaatacacacagacgggacatacctgaaaagctgaaaaactacctcttttaaatgtcttggtatctcttttcggacctcagcctttcaataaaaagttagattgctatttatattgcttccacctctaaaagtccttgagttgaaggtaaagaaacaatgacattaaagcaattttaaccttttgactcaaataatatttagaaatgttagacctcttaaaagctactttccaagtttacatggctatacttttatatttaactctgtataaatggctgtttatgatgcacctacaaatagtatacacacaccagtaaaaaagccagcacagataaactgtgcaactcaacatcaccatctagtgacaaaattcttaacacgtgataaagccaagcgaaaaagaatacatttcagagacattctgtactggtagttcatctttatagtactaatgtaaatataacagatctcactgaatagacttcgctctgcaaataaaacaatgcctaatggcaatgttggcactccaaaaataatttgtattcttgccatagagatatactcataaatctattaacaatctatattttatgtgtattaagaaatacactgtaaaaaactcccaatagtatttttattttttttattaatgagtatattctatatgtacctcttctttttcagaatctgacgtcaccttttctcaagttattcaattcaagtaccttccaattgcatatatctattacccatagccctctactgcctgtgagactgaaaagggacaaaaagacaacacattggaggccgaggagggcagatcacctgaggtcaggagttcgagagcagccttaccaacatggtgaagccccatctctaataaaaatacacaaattagccaggcatggtggcacatgcctgtaatcccagctacttgggaggctgaggcaggagaatctcttcaacctgggaggcggaagttgcagtgagccgagaccgcaacaatgcactccagcctggacaacaagactgaaactccacctcaaaaaaaaaaaaaaaaaaatacaacacaatgttaaaagtggccccatccttccctttactgttcaggatttatcacaggggctaaaataggtacagaatatgatagtaaagaaatcaaatccctttggcatgattacagagttgaatcaaccaagataaagaaagaatatgatgaaaagaagttgagaattttacctctaaattcattatcatactataaaccagagatttgacctagagatgatgcacttttttcctgtccttaaaatgctttttctttgattatcattttcagaaatgctgtataagatttccacacccatggcactacaatagactatgtagaagttggacaagatatacagcttctagtattctatatgctaagactgcagtgaacttctccattgaattccattatttatacattacacatgtaattcttgtaagcacatacaacattaaaaggaaaaatgtatacaaacattatattttatatcttatttttattaattttcataaattacaaagcattctctcctctatatcctagttcctcatataaatcctaggagattttaaatcccattttacaaaaaagtaagagtaaaataattaatttacctaaaattacagttggagtctcaaatctgattcttactattgattccagtatttatttcatatttttagttttctccatttttccttcactgtttttctaattattcataatatattcccattacagaaaatatagaatggaaaagcatacgcctcaaaaaattatctttacgccaaccagccagatgtaatagccacatttcattcctattttttctctgcattttttatattcagttgagataatattctacaagcaattttgtttctctctctctctctatatatatatacacacacacagatttattttaaatatatgtaaatctgtgtatatatctgtaaatataaatatattatatatctgtatatatacacagattttatatactttataaatttataaatattgtaaaattctaaatatgaatatataaataatatatatttatatgtaatatatacatttatatatatttatgttatatacatataattgccttgtctattgtcttaatggtagacaattagttcctgtaaaatttgttcagggttatattccataatttgagtatcacattcatattatgcataatttctatggcttctgcataatatattcctagaaggtaaattaatacaaaaaaaagtatgtttgttttaagtctcttaatacttagtgacacaatcctttccttaaatgcagcagtaattttcaatcctctgagaatgtgagaatggctgtctcaccattccatctctagccatctgtgagaatggctgtctcgctattccatctctagcactcaaaaacttcccaccaaactgcattagcagcaataagcaagagattggtgtattttttgtgaaatttacactttttgtttgccattagagttgaatatttccaagggttacttaatcatagtttgccaattatctactgagttcccaatttttaaaatctgtcatacatatggcaatatagtacattgatgtcttttaattttgtgattgtccccatttgcataagttttttaaaataagtttgtttttaattggcacataatagttgcacatatttattggatacagtgtgatgtttcaatacatattagattgtgtaatgatcaaatcaaggtaattagcatatctattacctcaaacacttgtctttttttgtttgtttgttttgttttttgttttttgttttttttgagacggagtctcactctgtcacccaggctgaagggcagtggcgtgatctctgctgacttcaagctccacctccccggttcatgccattctcctgcctcagcctccaaaatagctgggactacaggcccccgccaccatacccggctaattttttgcatatttagtagagacggggtttcaccgtgttagccaggatagtctccatctcctgtgacaacactccaaattttctcacgttattttaaagtatacaatatattactgttgactatagtcaccttactgtgctatagaacaccaacctctccccatttccactccacactactctcccaagcttctggtaaccactattctactctctacttctatgagatgaacgtctttaaattccacataaaagtgagatcatgcagtgtttgcccttctgtgattagcttatttcacttaacattaacattttctaggttgatccattttcttgcaaatgacggaagcttttttttttattattggaatcaaagcttagtgatttcttcacctacttgttagcgtatcatctcttcccccatctcaatctcaaaagtcacttctatattccactggactttgactgtttcatttatttcccttagctctttaaaaatgcatgaaatttcctttgggccatgtgaagtgagactacaaagtctttttttttttttttttttttttgtccaaacagcaaaaacaaacaagtaaacaaacaaacaaaaaaaaccttttataccatttactgggtgattgaacatgtcctgaactacttggggtacttcatcatataataacttcatcagatctttatagtatctattatcaattacagacactatttgttttaaataacacgcagaagaacttaagaatttccatcttcattttgaatacaatcacattaaaagatgtcaaattcttagggaggttttgttgttaattctgttgggctttctaggtataaattatgtctttataaaataagagctaccttgtctcctctatatcaaattatactttttagttttggttttacatctattaccaggttatggatctaccttttactattagttttctaagaaagtaagtgtatctatgtgtgatgtgtgtgaacatggtttagcttcactctggcctctccattgttgagaactctgttaagtgagaggcagtcaagtgtcatattagcaacacaaaaacttccctttagggcagcacagaacaaaccacagccactaaccacatataagtatttaaatttaaattaataaaaattaagtaaaattaaacattcggttcttcagttacactcatcgcatttcaggtactcagtggccatatgtggctgagggctctcacactaaatggcacagatggagaacatttctctcatcacagaaaggtctgggcagcattggtctagatgtctctaagagccacagaaaaacggccaggaattccattcccctgtccttttcttcttaggcacattatatttcagtctagtcttactctgttagagaaggttattcagaattttaaatcccaaaatatgttttttctggcacgtattttcctaagccctgtattttcgtagacatctggctggactctccttctttcttatcccaatgcactattcttggaaatcatatgccttcccttggctacaacaagtatcaaaatactaacaagtctcaaatgcgcacatcaactctcagtcttttccttgagttgttgcattgtattttccctctgcctattgcacatttacacgagttaacctcagctatctcacagtcacctgaaaacccaaatcttcactaatcctctttttttctctctctctacatcaattaatgtatttatttaacgttttatttagctagcatattccagagaaggttgtaacccctcgtcctttttacacaccagggctacaggctcagggcatcctcaagactgggatcaggaggaagcatgggagggatctaaagtgatttgtaaactcggatactgacaagaaaccagattcaagactgcacagcaaagactggccagaaagagagactggatgaggtggctaagaatcctctcttttctgttctaagctcatagaaatagtaaaacctaaataaataaggaggtacccaagatggtgaaaggccccccaacactgcagccacaataggacaatcttcagatgtgggtccaactctgttccagttactcctggctagacacactcaggacaagaacaccactgtggggacctggagccacttaggggctgctaaagagatcaagctaataagaaaaagggatgctccatgttctcacccacaggtgggaattgaacaatgagaacacttggacacaggaaggggaacatcacacaccagggcctgtcatggggtggggggagggggggagggatagcattaggagatatacctaatgtgaatgacgagttaatgggtgcagcacaccaacatggcgcatgtatacatatgtaactaacctgcacgttgtgcacatgtaccctagaacttaaagtataataaaaaaaaaagaaagaaagaaaaacggatggtcccatagccaagctatgccaggccaatggactaacagagaagctaccatgaaatattctgggccagggaaaagactgaaatactcagtctctgggtcttcacctcaagcatattccgaacacattttaaaaagcacctgacccaccatatactaaattgttgtatgctattaattactaaattattccactgtgtttaatgaatccagacattaccaataatgtgtgtctgtgtgtgtgtgtaagtaaaatgtataacttaagcaaacaagtacatttcatgccataaaattaaattctcacttaaattatccagactactgctttgtctcatagaatgggtggttggcaagttattccaggcaggtaatacttgtttttatcatcagttcatctctagttttttaaaaaacaggacatcctggtatgttctaaaatgttatgtataacgaaatttggcagaatttaatcatctcttcatttgaagttaattcttataattcaatttgtttttttcttgaggacaaatttcctacactgattacatatcctttccttgttccttgtattttcctcattcacatcatttttcattcacattgcctcttttcagttctttctgtcttttggtcttcagttcttttattcaaagcataagagttgccaccctctttgtcttcctgtttgtctatgtatttacttcaaaataaatagatataaaaatatagagaataactgcagttttccaagtaaatattggcatgcatgtttactgtatttaaacttatcataataagcatttacaaaaaatgttaaatttatagcagtggtaattttaggataaaccactatgtatggtgaaaattagaaattcattcataatttctgcattagctttttccaaaacaaatattttacaacttatttttaatttgctaaaattttcaataacttaaactttctgagaatatctgattgcattttatatagatacaaattctctattgtgtactcagttttatttttccctcttttttttattagtaaagacattaacaataaaataggctcacttgctccagctggtaatttctcatactagtaatatattattcctctttttgtgacatcataatcatctatacagaagtaccatgtatctttgtgtagaagctactgtttccattaaatttaattacctccccctgtggttttaaatagaagtggcttcaaaatgagggcagcttctattaaatttaattactttctcctgctgcttgcatggtaaaaggaaggttactaaatgagagcagcttctaaactaaagtatatggtaactgtgtgctagcaataacaaaattgtatctaaactacctttctaggaagctcttaggtttatcctttctctcattttaatctctttagccttaacatccttgaaaaatgagcattaagatagaagaaggcgtattttaaaaacatattttaattttataggctaaataaatataaatacactttctttacaaagatattggaaattatgctactcaaatattcaagctcagaacttttaagactactaacatttgttgttttctcactctgtggatgatgagttttatttcccacaaattttcaatgtctaataaaaagcctttcttgattctgatcaaatagatttgaaaaatgcttcactaaaagttatttaaaaggcatcaaatttggggcaatttcatataaatattcagaattactgatgttaagaaatgaaaaaagaaaaaaagtcaggctcattatagaccactatagttgaaaggaagttaattatatgctttgtaatagtgtaaaaatgtaaatcactaaaaatactataatataatataatcctataaaatgttatagaagatgaaaatgtaagtacctctctttaaattaaatattaattaggaggaaatactactcaattaaagcaccattgtacaatgtttatttctttatatacaggcagaatttagatgaacaatattttcattcaatcacacagtttagtataagtataaaacaagacaccccttaagcattttaagtaacaaattaaacatttacattttttactgtgcactgaggcttaacatttatgcagcttcaaaaccaaagtacagcctcaagggaagtctctccactgacaaattaataccttagagaacagagctgaatggtggcaatgaactcatttgttccccaaataatgaagaatgactttttctttaccacatctgtgactgttgctatggtgacccagacttacctcattgcttctcggagagctcctcgctcaccaagagtcgtgtgcttgatgtcatcaaaattattctccagcttctcacaattctgcaacatatttaaaaattgcattaattctctaagatcctgagaaaaattgtatctatgcagttatgcaaaaatgtaattgattatattgatcatggactcatgaaaaatatgcataccactttaattgggtagcattcattaaaattgacagttaaatccaacagtaacaaaataaaaacattttatgatacagctgtcacagaagtctcattatcaatttttcaaagtggagtttcgttatcaatttttcaaagtggataaacagaagaaatgaatttataaaagtaggaaaacttcttaagtttggaggaataaaaattagttctctaaaataatcttaagtatagaaaatccaatttaaactcaaaagagaaaaccattaagtttttgatcaccataaacagtatacaataaataccaagttctaaataagctagcattgactaagatgaagggatagagcacagatataataataaaagtttcaaaatttttgaatcaaaattttataatcagatctttaaataacaattttatgtgtaatatttacaactgcacatatatatttatatacttgaaactaaagttaaaatcttaaaattaggtgaaaattagattagatcaggttcttagaagaattttaagattgagtaaatatgacataagcagtttaaatttcataagtgtttctactttttggtaaaatagcaatactagactgaattttctaaaagtactttaaaaaatttttactacaattctaaatataattatacgtacttaaaactcacttaatctgagagaacccgaataggttttgagggcataaattgtagaaattttcaatttatatacatatatatatgaatcttttggcaccctagatttcttatggaatttactagtatttagttgataaaataactagatttagtgtattacttatttttacagaaagaaaaactaaatgacaaaattttagtattaatatgttctttctattcttgaataagtatcctgaattttacaaaattacagaaattatattaataatgtccaatgtataagaatgaattgatttgaaatatattggtatataaaccactatttttaaccttgatattttttaaaactaagtcaaattaaggcaaagatccttttaacaaacacacacagttatatgttgttataattaaaatctttgaaattaccaaaatgaatctacaataattaaaattatatatttttcaaaaagtccattttgggtatatacattaaaagtatcctcttctgtcttatcttcccacatttttagaagtgtctttcaataaagagaactgcttagctgagatcaaatttgttagttttctaatttaagtacagtgtttttgtgtgctgtttaagaaatttaaaaactttctcaaagttataaatgttgttgattgagaccattaagaaaaaatacacataattttttgtttgtttctttttggccctgaaattcctcatcagcttcctcctctttgccaatcctactgcaatcttttttttatttcttttttttttaattatactttaagttctagggtacaggaacgtgcagttttgttacataggtatatatgtgccatgttggcttgctgcacccgtcagctcgtcatttacattaggtatttctcctaatgccatccctccctcagccccccacccccagacaggctccagtgtgggatgttccccaccctgtgtccatgtgttctcattggtcaattctcacctatgagtgagaacatgctgtgttcggttttctctccttgtgatagtttgctgagaatgatggtttccagctttatccatgtcccttcaaaggacatgaattcatccttttttatggctgcaaagtattccatggtgtatatgggccacattttcttaatccagtttatcattgatggacatttgggctggttccaagtctttgccattgtgaatagtgcctcaataaacatatgtgtgtatcctactgcaatttttaactttacttgggcctccaccactgtagaggaacaagttcataaaagaattaaagaaataacaaaattattggacataaattttttaaggtccattcctagcataaacagcagggttggaagattacttgactatctagtttttctagccacagagacaggagataaacacattcttggattaaaataagagacagaagcctgggcagagtggctcatgcctgtaatcccagcactttgggaggccgaggtgggcggatcatgaggtcaagagatggagaccatcctggccaacatggtgaactctgtctctactaaaaatacaaaaattagctgggcatggtgggtgcacctgtagtcccagctactcaggaggctgaggcaggagaattccttgaacctgggaggtggaggctgcagtgagctgagttcgcgccacggcactccagccggggacagagtgagactccatctcaaaaaaaaaaaaaaagagagagagagaaagtggacacgtggacactgagagactgtagtagccacactgagtagccacactgagcgctcagtgatgccaggaattgaagacagccaaatttctgatttagctgaaataccgtgtttcagagtaccttcactataatgagtagaagcggcaaccttaataataattttatcaggaagtggttaaaatggcatattctgccttgatgtggaatgggaaacccaaaatgagtattaggctaactaacagaagaacaaatgctccatgttttacactttgtgtctgcatgaagtttattatacccaacagaacaacaaaggaaataagtaagcactgtagcatttaaacagttaactattaccttgactaaaaatacttctgtatacagaaattgaaatcaaatctattttttatgcttcaagaaccatatgtagaagcactaagtaacagacacatgatttgaattatatttcagacaatattaggctcttgccatatagaataagtatttcaagcaactaacatctttatctgctcaaacttctcataaataaaagtaagcattaaatatccactgagtaaagggcaaacagattcactgtcacgtttaccaccaataacacttctctaacattaaagacaactgcaggtaaaattgagccagcggcctccaatcaaaatctgttctcagcccactttatatgaacatggatctgagaaaaactgtaaattatttgtaatcaacaagttattcattcttggggattctgtaagttagtataggactgtcccagaatacgatttcagtggtaagtatcacataggggacttactttacaggataggaaagttcataaaaattcaaaaaaattatccatggtagtggcttgtgatttccaccctccaagtgcctcctaatttcctttgaccaatataatggcatgagaaacctacaaccatcacagcagaagaaaggaaaaggcaacagataaaaagagaaaaggggacagagagaatgaatgaacaaactactcctgagaacagcaagcagaagaacaaaaataatcagtgattagtaataaaatactggaacaaaacgcaggcctgctagcctagacaatgtggagcaagaaagtgggaatacacaggaaaaatggaaggtcacaaaggtactaaatttaatgccgaccagacatgccatgtaatataacaggcacaggttagctctaattaattggtagaaaactgaaaattcggaacaatttgtatcagcaaccatggtacacattatagctttaatatataatgtattgtgtgtgtgtgtgtgtgtgtgtgtgtgtgtgtgtgtgtgtgtattaattatagtaaaccagttaacattgagtagtgactctgggttaggtactttttctaggaagtctaaccatttaatctgcatgacaaccatatgtattcctattttacaaatgaggaaacaaccacaggggagattaagataaagcttgcccagggttatacagctagcaagggataaagcagggatttgaacccaagcagtctagcctcagagccagactcaaactcctcgcgagtccgcttctaaagagtaaactgcataagtgaatataataaagttctgaataggccttcctctaggtgtcatcaaatttaaatactgagctggatggaaaatagtttactagcagagtcaaatgtagcagaagctcttgcaggattctgtctacatctgtctggaagtgctatactttataatgtagaaaaatatggaatccaatatacacatttaggccaaattaatacccataaatattttgcatgcaacagtctttatttgggtctgtgacaccaccgtgacaaatataatgagcaattaaattcccaagtgttcagattttggcagcaattgaagtagaaactggaaactaagcatcaaaaagaactggttttggtggcctcctgccaaatgaatccccatgggttgagggaaggtctagagtttcaactgtgatagatttcatagtgttttatatctcatctgtgttaaggattctataaaagtataatgaaacaagtagaacaccaacagtcacatgaaagaaaataatatacaaggagatttcagaacgctgaggattttaaataaaattcactgagttatctttgctcaaattataccaaaaaaaatcacaaaattcaaccaaacacctactgattctggatggaggtggaaagaggcaaagaaaaaaaaaaaaaaaagaacagctagcaaattacattattaaataaaacaaatcactgataattccacaggactttatttccatgggactgaatttttatgttataattatgataactaaaactaaatcagatctaaaatttatatacaaacctaaattgaataaattaggaaaccaattttaacaaatgaaaagtcacaaagagttaatggcatagctactggagtttaagtctcagaattactaagtaacaaaggctcgagttaatgaattaaatttcagtgcagaaaaaaaaatcttgaaaatctattacatgtcaggaataatactatgcacagggatatgaaggtaaataagacaagacttcaacttgctcacatgtagtaagaatacagaggagagaaaggaaataattctcttggaacaagagatgactatgagtttgttacttccaaacctgtctttgaaatgatttacaattttccagattaagagaaaaaaagggggaaggctaaggtaataaaattggctctagcctcagaccttaccattactgtctacaggctaagtccttaggcaagttaattaactcagtttcctcatcgtgaaatatacttaccttctagagctatcaacaagattaaatgaggtaatatatgtaaatccattagtacattcagcaacgacgttttcaataaaggtggaaaaagaggaaagaataaacagaagaagagtatccatgaaccccaactcaatcctaatggatcagattttatatggtgaaatagaaaaaaatgtgcatttttcatgtttaaccaggtgatttttatgaataataaagtaaaagaaagtctttatggatttttttaaactttttggtcataagactcctatgagagtataatgaaaaccatgatccttttccttaaaaaattacattttcacaaaagtacatatgcacaagtacacaatatgctatgctatatacaatttcagtgggccaatacagctcctgaagcccatctatggcccaacgtctatgtgcaacaaattttagtatcagggaggatgatttcacaatggacctagacagcttagaaacggaagttacaaatataatcagtagtccaagaaccttgtgaaacaaggggtccaaaagttggcaaatttctattgctgtttgacaataaagcatcttaagttcaaacatcaaatttctaatttaaaaaaagacacaaaagtcaatcctgttgccaagctagaaatgaaaaccagtcattcattcattcattcaatatttatttagaacataatgggtgctagatagtatgctaatcattgagacaccaaggtttaaaaccttttttttaactccttattttgaaaaaaaaaagccaattcaatagggtaactgttataaggtaaataggcctcacatccattgccatgtattagtgatatatcagcaataattacaaatctcagctggttgaaaacctgcaggatactaaattttgaaggaacctcagagaattatcacaagggaaaccaccactcttatgaaggcaatgataaatttcatattttaaaatatgaggaatatttaaataaaatggcacactccaacatgtactgctacaattctaaggcagttcaatgttggttactacaaagcttttctttaggacataaagtaaattgggaaaaggtaatacaagtacatgcatttctcatgtagttagaatttcctaaggtctaggttcctctaaaaaaaaaaaaatgagtcaattaggtgaacttactctttctggaaaatgttgtatcttaatttttgcactcaacaagaagtctcaaaactagccctgctgaagttctttataagtacaagtaagaaataattactatattcatatttttttaattctagatgaacattctactgtcaatatatgatttccagttctaatcaagagattcatatttcaatagataattgcttttccctttggtgtgtcttaactagtctaatcctttcagggaacattaagaggtaatcatatttagctaatgtcatttcactaattgtggccagcttacaatcaggccctgtctaggagaatcttatatgagtcacagtgaaatacaatataatgcagtaggagaggtaggagctatgcagagagaaaatttgtttttgagtttcatctctacaactaaacagcttatgtgttcttacaaaaatgcttaacatctcaatctgcaaatagtccttcataaaatgaaggtatcaatgaagatgatgaaagtaatattatccactcaaagtgttattgtaaagattaaagtaaataaaaacatgtatgtgaaaatatatacattgttcaaacattattacatatttttaaaagatagaatgaatctcatttctgccttcatagtctgaaagtatgttaattttatttgaaatattttaagatttcatctctcatacacagtaagaattaagtaatattttagtacttttttgagataaattaaaagtttagctacagtatcctacctgctgataattcattcctatatctatgagaggtcaacaaagttcaggataaagtatttgctttttaatcataatttcatatttaaaattacaatgcgtttgtttgcataatgtatggttatattttgattgagtctcatatggtttacatgataatcaaatgaaacacagtatcattatttcaatatatattgtggagttctatgtcccatgtactgccaaccacaaactattatacaaatattgatatttactattttggaagccattataatttacttactcacttaatcttgacaagagggaaggctctccaagagcaatttaaaaatgaaaatctactatttcaaccagggaagcctgctcacctttaagctctgaacaatctgacccatctccactaaattaattaccaccacagggaaaccacagctacacaactgctctctaggatattatccctataaggataaaaaatttgatgtaatctagaggctttaaacttaaaacaatcccttgtccttgatggagtttttgctgaagcatctggcaatccctgctagactaagtggtgtctaagcaaatgaggaaaactttggtatcagggatggggtgcgggtggcaaagtcaaataaatccactgttactacttgaacatcagtggtgttcctctgtctcaattttggatggttaattttttcatctatgtttataggactatcactcacttaagaatgttaaatgtctcatttactcaatccagtgattttgttcatgcatttattagtaacacagaaaacacgttattcttagtctttggaaatcaagttttaatgtatgcttaatctagttaaaatatagaaaagtctatttagatggtatggctgtgtaatgcagtgcatgatgtactgtaataacaccacccagtgtgtgtaagattaaagttagacaccaggtaaactcacagatgtaaacagtcttttctctagaacatacttagaaggatcacttattttaaaaatacgttgtttaaaaaacaattaacatatgaatatgtattaccttaagctacctcaattctctgattggaaaaaaaaaccttgagatcacaatggagtgggtcagttcaaacagaaacaaggaatttactagattagggctctaaaaattaacaatctttggtgtatcatgaattttaaatgtacattacaaagaaaaatatgcaagccaatttaacataagtctcaataaatagtgcctaaattgataaactgatttttgtttacaaagaaaaaatatgcctaagatttccatatactgtacacagttatggaatggttggtactagatagatatcaaataaaaaacctaaaatagtattcatgatcatttatctttaaaagcacatgtgtgcattttaatacatgaggaaagattaatagaaccatttaagtttttgtgttaagttaaaattcagagaagcaatcatttttaagtcacaaaagataaagccttccaatatccttctggttttggaggaataaaggcttttacttgacagttacttacatgaatttgtatcaaaaagagaatttggcagagacttctaaattcataacaattgtctattagtctgtttttaataatttttctttggcatgtaatcctctttaattagattccactctctgttgtttcaagactccataaacgggtgtcttatgtaccagctgctaaagcaggagttactgtctaaatgatattcacaatgagtatttagaaggtttacaattatacccttgctaataaattgtgctattttccccaacaattttaagtgctaatcttcagaaggcattttaaaattagctaaaattctgtcaagagatttacaaaaattgttagcatgaagataattatgtcacagtccttggactccatctctgattgtgtgcataaatcagaaaatgtcagctgtgttttcccttaataattatccttgcagcaatatattatagtctaaactcctattataatttctgtttctggtttctaaaacaccagacagttatttcaaaagtttggaaccgaataaataattcatatttcccagaataataagtgattatcaattctaaaattgtaagtattagcaataaatagatcaatatggaaaagataaactctgttttcataaactctccatcctgaaaaaccaaatgcttgaatgtgataatgactttttaaaaatattaattaggtaaaaatctaacatagcagatagtaggcaaatagaagcagggatctgaatagaattctaaggcacccactattttttattccaacagcacagacacttgaaacacagatgtctgaaatacatatcaagttgcttatcatctgatactatccaattttctatatttcttattaagtatataaaattttgaccctcattttagaagatacaaaataaaaaagaattttttgactttcatccaaatatcaaaaattataagtatgcttttattttctctggttaaacagattagaccagaaatataatttttatgcaagctcagtaatcatgttaaaaacaagtctcagacagcagtctttataataaattagctaagcattttgtttagtatgtttctaatactatcaagcatttcagaattcacaaagataaaaaaatccagttctctaaatactttaatgctgtagcatatcaaactcaggtttattatataaaccatataaatccagatataatagcaacggtatgtggctcagagttgtgggtattcaaagacaagtgaaaaacagaatatattttcctagaacattaggttcacggaaactattttggaaaaaggttttaaaattttgctcatcaactgtaatcaacagagtcagatttttcaagttactcaatattgtgttctttccaattgtgtgtttcctcggagtagaaacagtcatgtaacttaaaaataaaagaacttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccaggtacttgggaggctgaggcaggagaatggcgtgaacccgggaggcggagcttgcagtgagccgagattgcgccactgcagtccgcagtccggcctgggcgacagagcgagactccgtctcaaaaaaaaaaataaataaaaaaataaaagaacttgagtattactactgaagttaacataaacttttcaatcacatcaaatgaacagggccaatgctagaacaacagggactataggaactagaatccgtgatttccgcagatcctcatgaatcaattttctgaaaaataagtttatagccttaaatcagacttccttacaccttggttaaaccaaccagcaaacaaaactttctcctacaaaatacatccacttctttccaaaaccacttcctttaaaaaacgttttagtaacaaacatactattaaccttccttcctttcacagtatactccccaatatataaagcatgttgaaaattacgcatattgtaaatggtttaattttttaacttcaaatcttaatatattcaattacaaaagtaatatatgcccttttataagaactgaatacaaagttatgtaacaataattttctgtctccaacctaacatctaattctactccagtgagctagattactacctttctatagttttccatgctcacacaacacgttttatgttgcagctttttgtgtggggtatgtgtgtgtacttcttgtttctcagtggggtctacttacttaaaaacatcagtcagcaattctttgtgtgtgtgtgtgtgtgtaccacaaacaggtggatctaccaccaggtcaataaatatgactataaaattccaaaaacttctcaatattacatattttacttaacaattttcttaatgatggaatcatagttttatttccctagaattttgctgttaggaataatgctataatatatccttgtacatgtgtgatggtgacttctcttactaggggataaattatggtgaaaatgacaggatctttttttaaccattttgatatacattactagacaattcaccacaagtttgtagtaattcacaatccactagcaatgtatgaaagagcttagttgcctgaaactttgccagtgctagacattattaatctcctacatatgccagttggagactgaaaagcattttataattccctggatactaatgaggtggagcatcttttcatgtgtttatcggctatttacattttatttttagatattgcctattcatatcctttgccatttttgtcatttatgtcataaatatattctcaataattttcccttcacttgtgtagagtaactttggccacacaatagtttgttgtttctctttaaaggatattaagaataaccaaaaaatgacataatgtttgagataaagctatagtggatttttagaggaaaatgtatagcatcaaaatataaatcaggagacaacaataaagtattgaaaattataaagtgtttttttaaatgcacgacaaaaaaaaacccagaacaccctctcccttaatcaacgaaataggagtaattttttaagcccagtgctgtaatattttggttgaatctgctttgggccaaagtgaagcatccaagcggaaaatggggttgttattcatctaagtctaaaccataaaatgtaatacatagaaataatttctgaataactggttgaaaatggaggttaactagatactgtatttttctgggattaaaggatgaatatcaacaatattccttattctttgccacattcaccatttcatcccattattttttatgatgtcttcatttcccaaatatttaaaattaaaatatgtgaagaaaacatcagtagggtaagttttttgtcttatttctttttaattattaaaaaatatgacattaattggaaaaatgaatggagttatgtgcacaaatgatgtgaaatccatgaaaggcagaagcatgaggggatttcactgcatctaggcctggccactttccaaattcaaggaacaacagcctcactctcaaattatactttgtctccaagagtttattttttctcaataggtttatttcagtgataaaacagttgaattatatacatacgaagtttccaaaattataacttttagtccattttaatcaaatgggcatgaatgtggacagtttgctcttctgaccttcactggaagaaagtgtaggtgtaagaatttttctccatgaagaaaaaatgatgctgtatcagaggttaaaaactacaagtaaaacaacttaagttaattgttcaccctaacacagacatttgcacatttggcccattaaagtattcttacaactttgggcatgattcattttttaaaaaatgtaaagaaacagtatatttatggtacatgaccaaaatgctgcaatgaaaatgaaatttgaaaattgaatgaagagagttgattatgtagattgcaaggctcagataatttacatgtgatgaaaattacagtatcagttttaaaattaatggcattatcactcatcattattccctgaactgatccttttatgagattatcacagagacaagagaagattgaccaaaagattagtgaccctttcatctcatcataatccacaagtggcttaacttgtcatcaaaaaatatacttatcaaaatttctatcaacacagcctggaaatattgcactgtactgcttctttgacttaattctgagtatctcttactagtgattatgttgatgtattttacaagcagtgaaaaaggaaactgatggcatctctccccacatgactgtatgcaatcttcaatgctatgacagctcaagaatgataatcgcctcattgctgaaatgaatatctgacataagtatttaatttaaaccagtttcctgaacctgacaggatcatagaaacagtatcccaccaatttacctaaagggagtagcaggggaaaaaaaaaatgtttgttcccagatatggaaaattcatatatcattttaatgtcaaaatgagcaaatcttataggaatctaacatactcaacattatgcttattttttgtttgtttttattattaattttattaaaatagaatgcaatctctaggagacaagaaattttcctgtatttcattcactactgtatctgaagggcttaaacagagtctgacccattctagaagttcaaggaataaataaaaaatatattatatgtagaataaaaatttgcattattattaaaattaaataaagacttcatagatattgccttttgtgggctaagggcctggatcttctctagtagtcagaggcttctttttttactattagtggaatttcactggaaaatttgatatgtagtcccttgttgataaaattcttaaaaactgacttgctacacagggaaagatgttaagcatattttaattttatttttaatcaactttggcgatatataaagtaacatttttatcaaacatattaaatatttcaacttgaactgaatagctatattgttatccttgttagaataattaaatattggctacaatcatcaatagaataacaagtataataaaattaaattgtcagtgcatatgttaattgcagagaggaaaatattctagagcttaattttcaaatggtctttcaaaggaagatcatactaggtggcattcaagttgattttctctctcactaatatatatttatttctatcagaagacattttaatacaattgagtaatccaaatatttcaatgctttctacaattcatacaggaacttatgttgcataatgattctactaaatgcaactattaataccttttactcttctactgatttcattaattattataactaacatcacgattattattttaaacagcttaaatgttgactagttctacaaagttatcagccctctattcactgacacattgctgaaatcattaaactggaaggggctttaagaatgcaataaacgtttgttaaggtgaattgacactagtgcctatttataaagttatgaagagaaaatctatattgtttaaaagatctctaaaaaacaaaattcataacctctcaaggatttaaaatcttcatcttagtacattttttagttctcatctaaagcacttatacttcccatcctcttgttctgcacttggtggagatgttcaataaatatttgttaaatcccatcttcttgttctgtactcactggagatggaaaacagctagtcttctttctcttataagaacccttcatccttaaagactgttattaactccccactcttctagtctcaagcctgaacaatccaatcttttagccttccttcatcatcctgacttctcttaagtctcaatttatacagacgcctatctcagaaaacctactcagggtctcaatttcccttcttattaattgagcttaaaattggaaaagttacccaatgcatttaaccaatttttaccataatcaacaaaatattgctttacagcttctcactatagcaataactcacccctacacctatctatatgttcttttgaatataaataacacttcaactcactagaacattcagatttagtagaagaggctattttacctcatagcaaataatatgtttctcttcagtataggcaacaggattttatcttaacttcccttagcataatctgattgtctggcccaaagccatcatctatggagccttctgaacaatccccagtggacattacaatattgactgtgtgagaaattttattttcctagacaagttagaaatgtgaacttggttttctttaacacttatttatagcattcaatcagactgaccttgtttgatggaatacctaaaggatactcatgtttctttccataagaagtcaaatgttcattaatttagtaagcaatactctaaacactccataattattttcatatgtacagcatttgtatgaatttgatctgtatgaatttcctagaaaaaaatttacaatacttttagagtttattctaaatatttattctaaatattctaggcatctgccctcataagcttacattttaatgaataggggagagatgatacaaatatatacttaaaatatctttttaaaatatgaaaaaatatacatacttcaaatgtttacatttaacactatgtgataacctcagatactatcagagtttatcagatagtgttaaacactacagggaaagaaaggagaataaagtgatagggaaataaagatctattacaaacagaatggtcagggaagacattttcaagatcttaacaaagggaaaggaactgcaaagaccctaaaagagagtcagtatgcctaaaatatgataataaggtacataatggtagaaggaaaaataggagacaggtttcagatcacagagaatcttgccaaaccatggtgatactgcaatataataaaaaatacatattttggttttcatccctgttttctggcacacagctcctataagctttgtaatctcagaagtcgtaagtgtctttttgtatgctgatgagatgactgatgcctggaggctcctgtacagcttcagaatgggggctggttgccagtcaatcaaccgtgtgattacagagttggaacttttagccccatcccctatcctaggagaagggagaggggctgaagtttgagttaaaaatgaccaataatttgatcaatcatgcctacataatgtaacccttataaaaacaaaagaaaggggctcacagagctttgggtcagtgaacatgtggaggtgctggtgataacagcggtggtctatctggagtggctgctgtgaagacaccagctgcagctggggaggtatggctggaggaagcatggccagcgctacaccctccatagggccagcaggagccaggtacaggtgggagccccacacacttctgagttggcagggtgggagccttgccctcttgggtgcggctgcagccacccagctgtggctccagacctgggcaaccctgccttctcaggggcctgggaaaccccccactgcccctgcagtctcagaagtgcctgctcccactacctggtctctccccacccaggcacctgctctgattttggagcaaagttgtgcctgagcccaggtgctgtcgcaacctggctgggtgtgcacacatttgcagcagtgctgacaggccagctgtctctcaccttgtgcccctctggactttgggtaccgatgaacaacagtggaaagcagggggtgctgaggggtgctcagcatgggcctgcaggcactcttggcacaaatagcctgggcactgtagattacctgatcaatggcagcaatacgcagacagcctcaagcatggaaaggggcgggtccccagtgaagccccaccttcaagccagggacttcctgaagcatgagggctggactgtcagttccaggtggagtccctggagttagaacttacagtgctttttctggacctgcccacagccacctatagaccaatcagcacacacttactcccttctgaagcccatacaaactctggactcagccagactcagagacatcaggacaaccagctgtggaaaggagctacccaatttgggtcttcaccactagttgggacgacctgcctacagaaagaagctacccactccaggtctcctttctgctgagagctggacactcattaggacgacctgcctgtggaaagctgctaaccactatgggtctctcgagtactgttctgtcacacagtgaagctcctttctaccttgctctccctccagtagcctgcgtacctcattcttcctggacatgggacaagaactcaggacccaccaaatggtgggaatgaaagagcagtaacaaaaatagggctgaaacagaatcctcctactgctcgccaggttgtgggagacatgaaggagaggagagctgtggcccttcagggaggccagacctaggggttacctgatccagggctgtcacatcctctttggggctctgtggctcctgacatttccaagcttccgggcaccatcacattcccctcatccacgtgtgggtgcatacagcagatgccgcatgtggtacatctgatccagctgcagcctcacatggagccgggacctgtaccagtgcctggagctgcccaccctgctgcagcagcaagcatccctggctgtgtgcaatgggtggaccccacactcactcactcacacacctcttgccactctgcaactggcttgccctgggcaggtatgggatccagactggtggtgcgagccgagaacagcctgctgggccgagtgggcagaatgagcccaggtggcatgggcaatactcaggcagaaggcgttgttgaacacagaggtttccggctggtgaagtgacacctcaaggatcacgtgacactgggatggtggcacaaccaagacaggacatggaagctccgtgtcttttttccccataccttgctctatgcatctcctccaattggttgttcctatgttgcattcctttatttaaaaaaaactgggaatctaataaataaactgttttcctgagttctctgagccattccagcaaatgattgaacctaaggagggtgctcttgcaacatctgatttatagatagttgttcagagacacaagagacagcctggacttgtgtttggcatctgactcgggggaagtcttgtgggactgagcccataacccccaggatgtgatgctacatccaggtagatcgtgtcagaattaagttgcagaacacctagttggtgtcctcagagaactggagaattacttggggtgggaaaaccccacacatctggtattagaagtgaagtactgagattggtatgaatataaagaagaaacaatatttgtttattttgttcaacaatgataatgtttgcatttattcaaattacagtatgaagtctttacagggaaatagttatgtagcatcattgtcttaaaatcataggaaaacaatcacatcatactttctattttttaatgactattatttgttcacctatgtttaacttctcaaaatgtacaactaataaaacattagttcatcgtatgttttcataacagaaatattcagtaagaagtacagattttcaaaaaaacagcacttttcagttgtgaaattcaaaaccataaagtggagggagggatggctgccccaggtatcatttttagctattcaccttcaaatcccacttacactttggaacttttacctaagaatcagtcatttatttccaacggattgccatgaatttagaactggactatgtgaatttagaactggactatgtgaatttagaactggacatggagttttatatttttcctcaaaataactgtctttcttcccaggaaccacaaaataaatttggaatacagtgactgctaaagaataagaatataatctctacaaaaacacgtcaaataattactcaaacaaaaactctctccatttacataatttcttaaatagaaggaatatgtaacatacaaactgaaaataaatgaaaaataaaagtgttacaaacttaagcaaatggtattatgtcttcaacatacctatgaagcttaataaaaatatttaaaatcattctttgaaaaaggattcctagtgccaaaaaataaaaagtagaacacatttcaaacacaggcatattctaacaaaataacagaaggtattgtcaggcagggaataaaggcatgctaattttatctgcttaaatgaagggactcaatggagcctgactctatttattgactctgatacttattgacaattataaaaaacaattcaattatgtttaaaatttaatattaagtacttacagaattaaaatatagtgtatgacattaatcaggagaaaaacttaaaatttcagcaaaaacaacaaaagaaagaaatactatatacattgtaggggtgggctgcgagctaatacagcatttgaatgcaagtccaaatatgtaaattaaaaataaggttaaacttttctattaaaggaaaagattctcagaatcaaaaataaccaaataaagcttactctgtcatacacaagctatatctctatatcaaatgccagaatttaaaaataaaaggatgggctatgtgaatgcaaagcacatgattgttttatattcataaatggtgaaacccacaaagaacatacaataataggaaactaaggtgaaaatatagcatttaaaatattaaaatattcaatgttaatgaaaattgttatacccctctaacgaacaagagaaaatatcacttctttttttttgagacggagtctcgctctatcacccaggctggagtgcagtggcgtgatcttggctcactgcaagctccgcctcccgggttcatgccattctcctgcctcagcctccctagtacctccaactataggcgcctgccaccacggccggctaactttttgtatttttagtagagacggggtttcaccgtgttagccaggatggtctcaatctcctgacctcgtgatccacccacctcggcttccaaaagtgctgggattgcaggctgcacaaataccacttctatttaaaaacatttaagaaacttttagtgactattttccaaaaatgtcatattgagtgaagtgaagtaaattcagttcatcttttaagaggatgtgaaagtgttactttagagtattcaggaagttggactgtgaaatgcaattatattttatgttattagggcaacagatgtattagttttcttttatgcgtatctagcatgaaaatatcaagcacaattattatatacaataatgcttaatttgatatgaatcagtgctattgcatcacacttataaaggaaagattatgttgtataattaagtataagcagaatctccctctgcatggcaccattaaccagcatcttgagtattacacttgttttagagaagctcaaataaagaacaaaggttttcagaggaaaacaatgaagaaaggtttcgggatttttttctgtgtattataaggagattaggagtcatatgtctccaaacatttgaaattggatcaatttaagcttgtctgagttgtaagtaatgactgaaatctaaatattagaaagaaaatctgtatatatcctaaggaaatactcttaaatacgtgaaatgatagtgattacaattacaccaattgaggcattggttatgatagcaaaaaacaaaacaaacaaaaaaagccctgtataaaaatttaatgattagctctagagcattagataaccaaattaccatattattgtgatactgaagtcacttaaataatgtgtagtataatacaagattatgcaaaacatttgcatattattttaaatgaacaaagttacaaactaggaatatacactacaatctcatttttaaataaaaatatagacatatagaataagattaaatgaacacacttcaaaatgttattgacttatttctaggtggtaggatttcaagtgattctatttgcttttgttctatgtatatgtatttcctgaattctgtacactaaaaatcctttagtagttaactcttactgagttcttactctatatatggcattgttctaagcaagtgctttatatgtcttaatttgtaaacacttcaacagccctgtaaaagagccatttctacattcatttttttttttttcgccagctgagaaaacggaagcccggagcttaaatgacttgcctaggtttcctgagtagaaactgacagagcctagatgtgaaccttagaagtttggcaccagaaccagcacactccaagcactccacaaataagaactgtattatctttcataattttcaaagaaccttaataataatgataaaaataaaggaagatatttgattaattttaagtttgccacacttgccattcatcacaaagatcagttctatctttatttctacaaatttacaaattttatttctacaaaattacaggaaacaatactggccaatattcctcagcagtgtttgaatagagcttttcctgaagacatgagtgtcttctaaacttttaattttgtgactttaacaaaaacaaaatatcacatgttgttgttgtcctcaggagcactaagaaatttcctgcctgagaagtaaatgactgaggggaaaaaattatagaccattatggcatgctaataatccaaattagataaacaaacacaagcaatggaaaggaagaaagagcaaatgcattcagcagagaatggtgataaaaaataatggacagctcattctccacagctaaaattgcacaagctgagctgtctaagggaaatgagtcatctgtttctcaagttataagggaatcttacagaatattttgagtttgaatagctaacaccgcaggcaattgaaataggtctccaaatatctgattaaagtcatgcatgattacagctggtatagaatatttttgtacctttcttgcaaatggtaaaatgtaggttaaatctctaattttctctgttacttaacttctaaagtaggtattaattaaagaaataaattaagatatgcttaactaaattcttagatatgaaaatgaagtatgaaactttttattagtacattattcacttttacaatgcttcttaatgaactatttggtcctttgattcaacagtccttttatctcatatgaattctttaaaacaaatggattttctggagtagaatccggttttaaatatctaaaatatcagcctcagaatgccagagtgactgaatagaaggaaaaatgagaagaagaagaatataaagggtgctgtgcaatcatgacagataaaaacacaggagatcacagtaaaaataaaactaccaatagtgtcatctatagaattcggtcacctattttttccaacttaatttgatcgagcaaattgcctacaaaaaaaccatccagcaaggtgatttttgtacttcattgcttataactataactccaccatctgttctataaatgatatattaaaaatcaaatcaatggtgatttttaaaacacatgtcctttttaagaatatgatatattatctcccatgattccttaccaatttgctacttcacagaaaaaaatgaattgtcctctggtttcttaaattgtctatgtaataaaacacagtaacacatactatgaaaagctgagggtaaaacagaactttaggatctttcataagttaaatatgtcataatattttgtcatttcacaaagcaatgatgctcaaggagatattatttgaagaacagatagccataatctctattaatacaaaaatatatagggaaggacattttcatttagacttttatacactatgataagtttctaacaatttataattttggaacataaattatcattgtctaattaccatatatatatatatatatgtcacttctgttgccctttatttaatactcttattcaaataagtaagtggaaagtattgcttatgatgaggtcagattaggattctccttatttttatgttagtgtaatatgtcacttcattctttattcctttcaccaactatatgtattaaatctcctagatgcacatagtgcatgtaaggtcaaggtcaaataaaggtaaaacacatgaatggcatacagcatcacggaaattcaagaaaatatagttataatttaaatatgcaggtgcattcggacctcccctatgtagtcttttcaaatctctacataatcataacattttacagaaagtttctgtcccgaagtccaaatatgatatttaaccctagtcctccaaactcagcaaataccaggccaacttttgaaatttctaccttggctaatggtgacagtagcaaagaaaaaaaaaaaaagaaactgggctctaggctctaaacaaatatatgtgaaagttttctatcaattataatgcactatacatgaggattttctgtctacatttgtctacatgtttgtgtttgtgtttaattcaggaaaaccaggactgtaaaaaagaaaatgcttaaagcttgcatctttgaaccaggcagaaagtgcagcaaaccaacatgacacatgtatacctatgtatcaaacctgcatgttgtgcacatgtaccctagagtttaaagtatagaaaaaaaaaaagacataccagagactgtgcaatttacaaaaaaaaaaaaaaagaaagaaagaaaaagaaagtgcagctacctgatgcctgaaggaaaccaaatgaaagaatgtggaaattaagccattcaagcattcaaggaccagcactaggaaatttcaagtagctattacctagatttaaaaaatcagaaatccttacattaaaaactaatcatttgaattctgttttaatttactttctattttctcttaggtgggataatcatacctgattagtgctattataacataacagtgcttattatgtgccagacctaaggagtcacatacataagagttattatttactgttattactaatattagtatatattactttcatcctcattttataaatgaggaaactgaggactagacagttgaagtaacctcctcaacatcacagagctggtagttttccaaaattcagttttcccatctttaaactgaagaataaaacataataacatggaatctattacagtaattcttattgtattaatgatgatgttatccaaattgtacaagtggagtgtagccattgagcaatgaacactgcatttttatcagtgatttccattgttaaactgctttgtataatgccaactatttttcgtcttactcaaattcaactgatctgatgctcatatagcaactttctgaatacaatttgactcccaatagattttcttcttcaaggatgatgatttctcaggttaaatcaacaacatatttataatgatgatgtgttaccccatgaagctgaaacacaggcaaaaaatgatgttcgtcacaattcaaatactcatacacattttcctcattataatttagtaagctggcacactggaagctactttagcaagacttattcagatgtatttccctcagggatacttcaccaatttattattgaaaatcaattggctgtcaatatccaaacccctttgtatcatgacatcacttctaggcagaagtctcccctgatacccagggagcccattctgagtaatggttgcacagaagggcatcctagcacttgggcatgtgtcaagttgtttctcttgttttactgtagcattctgtaggtctccctcctgcactaaacattatgagggcaggaactgtcctctatgtataaatgtctgttgcataacccagtgcttgttctatcatagtttattatatggtaatatcagtttcctgaattaacgctcaatatcaatgtactgaattaattattgatttatatttaaatcaatccttcagaaacttctatgctgttagttcagttatgcacagtcttaagcatatcttcattcaataaactctctgggtattgtcatactaagtttctgaagcaggtgaactgctctgataaaaacaattaagcttgtgttgccaaatgtgggcttacttgataaacatcagtctttatgatattgctgagcacaaccttaaggctgattttgttcctaaccaagtgtgatacatattacactacatgtggcctagagtctataactagaatattacccaaatgaagattttcagtaaatctattaaaccatatgaataaattaacagctacagtttatttaaaatttagtattttccaaaatgttttacacatcatcttcaattatcttcagactaacacttttactaggaagtagacatgaaggacatgatcagataacaagagatcatcagataatgcacagaagtcaagtgacttgtctaagattgcgtagttaacataaatagtgttctcccactttccagtattgttttgctttacaaaactatactcagacaattaaaagaaaatgttataataaaccagtccatgtggaggcaaatctgtctcatccttgcaaaaaatacttatggccaaaaaagaatctcatataagaaaaaaaatgaaaagacatttcttataggaacagaattaaaatattgctttgtctcatcttcctgtctgttgctcacacatttgactgctgattatattgttaactcttcagaataaaaaggaaataccaattcaccatttctattatccagaaaatatatacataaaaagaaaacattcatattatttaattgtttgcctttttttcttgatttttcaagcctctatgcaaataaattttggagcaaagacagagatgtgcaagattctctgataaatttagaaacacaagagatttctgcaaaggaattcatgaaaatatctgtatttgcagatttttttacagatgttgagactttaataagcagcatctttaatatcatacatcaatttccaaaagtttatttagcttactgcatattctcaatctgatactcaatagtagctaaaaataacatataatacatttatgtaatacatggttatagttcaaagagccatccactacactgggaagaagctcaggtgccccaacactcctaccatgggagcagagagagttctattcagtatcaaatgcccccagtttaagattctgaacactagcatgtagaaaggcttttgtgtcagaaaacattttatcacattcaggaagagtttaaaatcaacttagatagcacattgctgatacgtgaaaagtttgaaaattctactgaatacttctcttccttagttttgaaagctggtattagtgaagtaagttgaaactcttggttcagccttccaaaccactcccataccccctgcttatgtacattcaagaccagccaaatacaaacaaaagagggtacagggtcaggagattcttgtgcccatcatgagcagggtgagatgtccatggccacagaacgaaaagtttattaagagaaggaggagcactggccaagcctaggagatgcaaatccaacgcagtttatgcttcccaacagagaacccatgaatgctttatgggtatgacaagaccttgatcccatcagctaagcccatcacctcagcctcctgcatatctcaggggccaggtgattctattatagtctctgagtgtcaggatgtgaaggaggtgggaaagctgtgttctactgtttgcttccccttcccaacctccactgaggtctgtcctcattgccaggcacttgttcggttcagagaagaattgtatacgtgtgttctcgaaagttcatagtggtaggcaggcttctggcgacctgagatagctcagcagtggcctcgggagtcacagagaacgtgttgttggccatggtgctctgtgtcaagctggtcctggaactgctatgacaggtgacggtagtgctgccagaggccctaagcccaggcacaggtccctgcagatttctggatgcaagtagggacaaagaacagactactggagtttttgtcactttagaagaaaaaacatatttatgagatttgtctcattcaaaaaaaaatggccttaaatcaactttggtagaagacaaacttaagaacaaattattagaaattcacaaactggaaatctttaataaagcactagaaagccccaactctttacttgggcttatattaaagactctcagaaaaggaccaaaaaaaatctaaatgtttagaacaatttaggttggtagcttaaagacagaatgtttcagtttttaggagattcatcgaaacacaattcacgtagctgcaaccaaaacagccttcgaaatacatcagaacaatgaagaacaacttcagacagcattgaaagacacttcggataaaaattccaatcttcagggaaacacagagctgctttcacaagaagctgaagagtggaaaagggaagagggagcaaacatactaagcagaataaaatgctagaaaattctaaaatgtgtaggaaacaagttctaaaatatgacaagtctgatcaagcttctgtgtgaacacaagttaaaggtgagagactgggctactgttcttggagacgacgacatggatgctaagaacttggatataaaaatgcaacagaaacggagacatcttagaagatgaatcaaaattttgaagaatcttactaatggagctgagttatttagaaaatcttgattcaaaaaacatgaatgctcactaaattaactgaaagaggggaggtcatattaaaagtctgcaaactgggaaagcttcaccgcactcagaaacaaactaacaggaaaacgcacacagaaaggagaggcaaaattgctggtggaaatttcaagtccttcttgaactgaatcaaagaaatgaaatatattttcacaaaatatcctatttagactgtgtttaccccataaagatagaggagaatcttcccaagggaggtgaaaagatcagtcatgcatgtgaagagatggacacctataaaatataagcctaaaagtttttagaaaaaaaaaggtcattggcctattatcaaagccagattattttcaatgagcaaaatactcaaataacaggttgacagttctgttgtgtgagtgaaaccttaatcatgtaagaaaacaaaatgcctgcacataagacaaattattaacaatttacatgtttcaaaaaatatcctaatatccttgatattccaagtgaaacatttagcagagacttctgaggaccaccagggcacactctggctaaccagatctctgatgaaggaggagtatcaagttgtgaaggtgtgcaaatgcaaggcctcatgcgtgatatggaccggatgccacccactacccagcccaggctcaggactgcataagcagggtccttccaacagaccactccctcctgacataggaggtcctccataagcgcaaaactgagtttctcctggtatctctggcattggcagatgctgcagacctcctttgggctcaactctcccactgatgtggagtttctggttcaggttctggtgctctgaatctatcctatcattcattctgttaaacggcagctattacaaagggatccccagtagcaggtactgagaagaggatcctctccccaacctcctattctataaagatgaacctctccaagaaccctatttcccagaaacttgccttgcccagtacatcttcccctgacaacaagaagggtctcaataccagcactggattttgtcttcagaccccatagcctgaaaaatagaagtgagtcaatttcctagctatcatggagtatatgtcttaaaagacatacactgaaaatagcctaaacatagaagtgagtcaatttcctagctatcatggagtatatatcttcctccatgtttcctggcatacaactcctaaaatccttggaatctccaaagtgctttctttttgtatattaatgttgactgatagcatcaggataaggctggttaccaaaaagaccaagccatgattaaaggattggaactttgagccccatcccccaacttccaaggatgggaaaaggagctgaaggacaagctgattaccaatggccatggtttaatcagtcacgcctatgtaatgaagcctccataaaaacccaaaacgagaggattcagagagcttctacatagctgaccacatacagtttcatggagggtggtgttcccgagggcatggaagctccacaccccttcttccgtagctcaccctatgcatctcttcatctgtatcctttgtaatatcatttacaagaaacaggcaagtgtaaacaagtgtttctctgagtcctgtgagctgcttcaacaaattagtcaaacccaaagaggtggtcatgggaatctcaatttgaagctagctggtctgaagttctggagacccgacttgatactagtgtctgaaaggggtgcagtctcgaggcctgagccttcagcttgtgcaatctaacactatctccaggtaaataatgttagtctgactaggaagagactcaactggtgtctactgcttggtgtatggggcttcttggtcaaacaagtcttctgtgtgaatgattgctgtgttgtatgagagcagaggaaaaacaaatgttggtttgggagtttttctgaaacataagttgatcctcttccaatgagtctgtttctaaagattcagaattatagcaaaatgcttttctcgtctctttacttaaggaattttaacttcttcccttttatttcttctgctattaagtgattatacagtggctcaaatggaagcttgataggactggaatctgtaagataatattttataactttagattattatttatatatgaagtgcataactaaattgcttcaatcttatttgatttgtaggccacgaattcaagtgtttttgttaagtctgctaaaataatccagaaacacaacaagtgtcttcaaaattatgattttttgttttattgtgttatggctatttaagtaattaggaaaccttgataggattacaattctaggatagtgttttaataaatgcagcttatttaaaagtgaatttcatgaataaattgcttcctttcttctacttccagatattataaagatagtacatctgtttttcctgtttgactagtcccattaacattggctgtaatcagaattttgtcagggaaatcttcagttaagatgcttgaaactcaaactttatttctgtataccaaagactaaatttaatcaagttatgatactaatatatttaccaaaataaactggtttaaaaaaaatgaaactacgtaaacatacaagcctttggggaaaaaataggcattactacctagtacttcattcaattaagtattatcaaatctttgctactgtcaaaacaattttaatagtagtcataatatatgcttaatgaatatatacatgaaatctttaatcccaaatgcagaatgtgtttgacaaatattatgtagcagtagtacttaattttgattcagcataacatgtcatgttacagttctatgaatttacaattcatagaacttaatttaactactacttaattttactcggttttcaaatttttactcaactttttctcctctgttatttctagtggtaatttttgataatttccctcctttttgaatcatttccttctttgttcttaaaaataagtgatttttctgtgttatgttttattcttcagctttaagatttctgtctgtttgcctattacacaaataactctaagcaatactctttttaaatataaaatatgtaagcttaaaaaaaagaatctctatggtatgattgtgttgtctagcaacaccattcaccacccttttcaataaagagcagcgtatggcagatgcatctgaaagcaataactaatatttatttggagttctgagctaaggaatccaggaatgatcaacctggagattcattccttatctataaagaacatctgaacctggcccctcatggggaacatgggctgtacaggggatcaaggccctttgtttcgggttaaaagttgtcagatggaggatgctaaggggagaacgctaagtgaaaatgctatataaactgcatgttttttacaagcggtagcagttctcctgtacagcccaccaccactggaccaccctatatgtaagttctcttggtaaaccctatgtgtccttcactagctccaggtctcttctttggtctcttgaacatggtgctatcactactgaagtcaacaggctccagcaagacaagcaacgacaaggattcctttctctaagtctctttagtatactagtatgcaaaacctttcttttactcattatttaataatagtaaaaataaaaataaatactcacgtatttactcattataaatgtaaacaaagatataaatgacaaagatatgttccactatgaatataaatatttgtaacaatttaataatttttcctcagattttcataaatatgggagatagaaattctaaatattaggctgggtgtggtggctcattatgaatataaatatttgtaaccatttgatatttttccatatttttctctgatagatcaaacgagatacctcagattttcataagtatgggagataaaaattctaaatattaggctgggtgcggtggctcacggctataatcccagcactttgggaggccaaggcaggccgatcacttgagtccaagagtttgagaacagtctgggcagcataacgaaaccctgtctctactaaaaatacaaaaattagctgggtgtggtgatgcactcctatagtcccagctaccccagaggctgagatgggaggatcacttgagcccaagaacaagaccctgtctctacacagataaataaaattctaaacattttttgagatcacatttaaacatatcttacttactacgggaaaacaattacaaagagatgcaaaccatatttgtactaaaaagtataaaagagaaaaacataaaattagcttactgtgggacataaggtattaaggtattatgaaattttctaaaacaaatgaaataaaacatatctatagtggaaaccaacacatagcagagaattatgcacaaagtaaaaaattaaatacacaaattccagtaaatatgaggcacctgagtactggacaaatctttaagttaaaaataaaatataaccagtgacattctcagtgcacaacgacattccatacaaatgacaaaccagaaactgaaatttgcaactgaaataatagatacaaagtcagttaacagaaaatggctaaaactatttctaacctaaaatactgaaaacaaaagccatataaaaacaactctagtaattaaaaaaatcacattatatgaaacattggaaagcattactctaaagatatttaatacacaaagaaaatgttttgtcctctcaaacgataaaaagctacagggtaaaaaaaaaggagggacttaaaaaagagatcaggacaacattttttaaggtttatatatcttttgagataaaatctagctaaataagatgaggatgggatgagagaaaggcacttatagaaaactaaaatgcaataatagaaacataaatcctttgtaagcattagaaaatagaactgacgttacagacagaaagacaatttactagtatcacagatcaatttgagatcatttctcaaaatacaccgcaaaaaatagacataaaataaattaagggaaaatgataactattttgtactagtaaaagaaattcaatacatggatagtggatatcttaaaagaataaaacataacaaatgatgcagaaacagtaagctgagtatagcaaaagaagatgctccttaactcaggaagaaaaaaagactttgtatcattgtaaagacttaccaagttttacacaaaagtagtgggaaaatgtcattttgagatataacttcaatgaattttaaacaaaaaaaaataactgtaaaataaaagggtgataaattcaaccaaattaaaaataagaacatttattcatcaaaatttaaaaagagtgaaaagatatgccacaaactgagggaagatatttgcaacacataaaggtaaaaattatataatttgttatataaagtgctcttcaatatcaataataaaaagacaatataacaacaaaaaaatggacataagacatggagttatggcacacaagagaaacatgcaaagccctaagcataaaacgatgttcaaactcattagattcatcccttactagtaatttgggaaaagtcaaattatgaatgtattgagatataattttacaccccaacgtgaaccaaaatttagaggatgacaatactaattgttggagacaatgcggaaagggattaagattatttctaaaatgttgctgtggaagtataaatagcataaacaatttgacattctgctacaatgttctacatttgcagcctctatgaccccctacactctaaagactcttttccacatatgtaccaggagaaatgtataaatgtaaataaaacaaagatgtcataaagtaagaaatgcaaaacaatgaaaatattcatgaatagaagtgtagatcctaaaatccttactattatttaatcactgacttagaaaattagaacaatctcagtttaaacatagttaataaggtcttaaagataaccactattattttttaaaggggaattttcctcctaaatcactacagaagacaataaaatataccagagtatatgtacgataaaacagaaaacagtaaaaagatttaaaaacaaactcataaaagcatttaacacttgatagaaacaaatttatcatttattactatgagtttaaatggtttccagtcatcaataatagactacatttttcacctggaattatatttaaattcaaacatacactaaggagaaacaagccagacacaagctgagaaatccaattaaagagaaaagcatagagaaaaaatatattaaataagcaaaaagaaaagccacaataatatactacccaagtatgacaaaagatacctctttggagactatccaacctaaattccctgaccagtcaacaactcttacttctccctattttatattcaccagtatctaaaattttgtctatttgtttatttctttattgttcatcttccttatctacactgtgcacactgtgtgatatgacttgttcaaacagagacctgacagtattgtttaaacaatgtaactcaaaaactcaaattaattggtatatgtcaaacataatatcccacagttaggggatatactttactctcaataaacattagaacattaaaaaataatgacctaatattatatcaaattaaaaacattttatagtcaattcaaaaaaggcaattattctatactttctcactaccatgtaagtgaatgagaaaatgataacaaatatagcaacaggaaaaacatgcccatttggacaaaatcatcacatcaatctcgaatatctactaggcaaaactgtaatacgaaaaatacttttcaaaaaataaaatgagaaaatgtttatacccaagacctatccaagctgtaatcattatttttttaatcttagtgatatattttactcaagaagttatgactgttaaagcaagaaatgataatagtgaaatataataataatgatattaatcattaggataaaatgtgatatggtatgcattgagggcatccagcagaggaacatgacctaggccacagattcagaggttaccctcccctttctttgataaagaaatgccatatgatcatcagaatatgaaaaaattacacacacataacagcatttatatctataaagtaaaggtctgaaaaagggaagggaaacagcagttactatttgggagattataaattggtaatgcctttctagagaataatttgtcagcattcactgtttaaaccaacaattccacttctaggaagctatattagagaaccatgcagatatatacataagaagatatatacagagaggtttacggtcacatgatttgcaatggtaaagactcagaagtagtaaatgtccttagaaaaagatgattaaatatataattacatatgtatattatagaatattatgcattcattaaaattaatggaatagatcaatatgtactgcccacaaatcagttaaattctgccttgtatgtaacaactagcagaagacttttctagaagtctttatacgatgaacaattcattataacgctaagttacaatgtgatatataattatatataatattggagagcaaccaattttaaaaaacccttcaaactagaataaaaataaaataattaatgcatgtaacacagtaatatagatctgtccagaggcaacttatctctagagtcttaataaagcatgaaggtgacattggactaaagctaatttatataaaaccctggaatacagaccagcctaatttggcaagagcactcactgatttcgtgtgaaagggagattctagagtcaataaatatttttaagcacacaataaaatgccaggaacttagtaggtaaaggaacttatatccttgggaaaaaagacaagtaaacgagcaatattaatacaatataagtaagttttaaaactgtataatgtgattatttataagtgtctgttgtctgtctttccgtgactagaatgagagtcccatgaagcaaaacttttggtctgttttgttattttccaaatgttaaggcagtgctaggcacttaataagccctcaacagagattgattaattgaaagaaaaaaggacaaagaaaagcagaagcgggcagagtgggctatattagagggaggctcagggggctgggggcctgggaaagattcattttccagaaggtatgaaatcttagttgaagcctgaaggtcaagattggattcagtaaacatatttgaatggtgattgttttcaggcctgagtcaaagagatgactctaggccactaaggagtggaattgatttggaagaaaggaagttacatctgaaagaagtctagtaggcatctctctcttttttctctctctctcccctcctccccccacacctctgtagataataaatcttgataagagaaagcttaagacagatgttagataaaaactgaggccaaggaagagatgggcagaaggaatactgaatagtgaggatggcgactcgagaagctgttctaagaagaaaaatacttcgagaaggaaggtatccacagtgccaaattatacgaagttctggtaaggaaacacatggaaatatgttcaccagatttattaatagtaacaaagaggtcatttgaaactttcataacagcagtttcaccggtgcagaggaggtgaaagccacattatggtggctttaagagtaagatatgagagcctggcatttctagagaatggatagtgtttttgaagcctgattctaggtgagggcaagagatttatttagctggttatatctgtgaatgcttctagttgtaataacatactttcacttttttttttgaagtaacaaacctaggctatgtgtttgtagaggaggaaatattgctgcagaaggagagggaaaaaatgtctactgccttgtatgtgtctgcttcttccataggctttgggacattctcaccagggggtttgagaatcaaacagtataagacaacttacacaacaagttggtcaggtaaagacttgtctgcctattatttggattttataggaaatttaaaataaacagctctaacaagcagagtaagcttgttgactgaaccatatgagatgcatttaatttttctcaccacaggtgttctcaagcttctatatactctgtgcttgtggttgttctaagataatatttctgaaaatatggaaatatctctggggatatttgaaaataatttatttcaaagaatatggaatgttaagacctaaaatccatgatttattcaatactgggtattcattcatttatgtgatggaaaagttaccatagactttccatctacattttcttattgcatcttgttctgttccttcaagccatcctccttcaccctctgattaaccacacagttccattcttctcacaatatataggcagtaaatttttttctaaaaataacagtaaatgtgtgtgtttaacagtataagaggtagatctcaaatgagcgtaaagatcaataacaattatgtgccaattatactatgaatatgtaattggcagaactgtatgggcagaccatgaagactgagcaacagcaattctgatcgaaccatgccctaaatgtctctgcctaaaaccccaggtttttaaaagaagcctaatacaaacaagtacctaaatgaattgaaaatatcaacactggcatatatttgaaattaatatatacaatacaacttctattttttcattattcattgaactattgagctataagtggttatatacacataggtgaaacaaagaagactaagacacaattccctaccctctagtaactcaaattatctttgaattaagaagagtttactatattgtgaggttttctctaatttgataatagaagagatggaaatgcatgcagttacatggccacagacagataacttccttacttagcattgggataaatcctcaaaaactaattccaaaagtatatctaaaataaacctctattttccattcattctcctaaccaccttgccatagactttgaagtggaagactttcggttcagttgagagatgccacaggacggctcgtgcagagcaattactcatgtggtggctaagcatggcttccacaagacagcttctttactggccttctgttaatgagttagaggtatgacaacagatactgatggatgtgtttaaagaagcaaatgaatttgaaaaaccaaactttaaatgtgaacttcaatttttatattgtgtgactgtattttttatatcattgattagatttgagatagtagcatagtttagtctctggaatctttgtttcattcatttaagtagccacgaggtgccaggtattgttgtagaccctgaagttacagttgtgaacaaaactgactaagctactgctctcaggaaacttgaaccctagagacggaaagaggcattaggcaaaacagtaaagatagagatgataataaattctgtagagaaaataaaatgtagtcaggagtaataaataaaatgtggttaggagtaataaggaatgctggatgatgaatgttacatatgatgttgcgtgttaggaaaattcacactgagtagctagcatgtgatgaaagtaaggaagtgcagtatgtatataaaacaacataaagaaaaggtagtgcaaatgccttgaggcagaaggccgcaggaagtgttcatgaaaaatcaaggaagccagaagacagtgactaggagcctgggaaaacaagcagcaggagatgaggataggggcttgtaggctataataggaccaggttttattctgagtgacacaggaagacaatggaaaacataatctattttaggtttcaaaataataatacagttgcattttttttaatgtctgaggacaaggggagaggcagagacatcagataggagaatattagagttcaatactgtcattagacatggataacagagggtcactttagagaacctccatatctcaaacataaacacaataaatttattaaacgagtgcctgcttctgtcagtctgatattggtattaagagctcacgtagttctaaactctgtcctaactctggacctcagttctcataaccaaccgttcagtctgcagtgaacactcctctacatcttctgtcttatgtactcaaaaaaggaagaaccatatgaataattgtgggttatgccactgttgatacgagaagaaaactgctttgaaatgaaggaaagatttgagttgtagaagcctttaggtaaatgaaaaagcaaaattaactactcaacaaaacactaacaaaccaaactcaacagcacattaaaaggaccattcaccataatcaagcattatttacccccaggatgcaaggatggttcaacatacacaaatcaataagtgtgatataccacattaatagaataaaggacaaaaaccataggatcatctcaattgatgcaggaaaaaacattggacaaaactgaatatcctttcattatacaaatactgtaatcattaggtgtagaaaaaatgtacgtgaacacaataaaagccatgtatcacaagctcacaacgaacatcatattcaatggtgaagagctgaaagcttttcctctaagatcaggaacgagacaaggatacccacttttaccatttctattttacatagtactgaaagtcttagccagagcaattaggcaagagaaagaaataaaaggcatccaaaacgtaaaggaaaaggttcagttgtgtgtttgcaggtgacatggtcttatgtatagaaaacccgaaagccaacaccaaaaatagttcaaactaataaacaaattctgtaaatttacaaaatacaaaatcaacatactaaattcagtaacatatctacacattaacaataaaccacccaaaaaaaaaagaaatcaagaaaacaatcccatttacaagtagctaaaaaatatataattaagaacaaatgtttccaaggagttaaactatttatatcatgaaaaccataaatctttgaagaaaacaattgaagaagagaaacaaaaagtgtaaaagttgtcagaatctaaatggagtcaacggcattaaataccttgacaaatggggccacagtaggccataaaggaagggttctcacatacactcttgataacatactatcttgataacaagaactatcacaaaagacttcaaatgatatctgtaatttattactaaaagataaaatattattcgaagaaatcaaagctaaatgattaatcatctgaattaccaattaccagtcattaccaatatttaggtaaaactaaaatattaataataaaaagtactacttagtgagcatttaccatgtgctaaactttgtattatacccttttaaaattcctcagttcatttaactctcaaaataatgtagttagattaccataattatcaagatttctatttaacagtgaaagaaactagagctagctagttaaggtgaagaatcacacccaagatcaagttagtaaatgtagagacgatttcagtttgggcatgtgtctctgagtcagagctgattatattataccctactgcctcacacaacttaatcgtaattttaacatatcccataaaaataaaacacctctatctaggtcattaaaacttgacatataccactgtgctccttaggattttttggttgtctatatctcaaacatgatttacatagtttaagccaataaaaagagtctatccaagagtatctcacaaaacacaaagttgcaaaactctccctacacaaagccatgagaaacctgcgcagcttctttttctatgactgcctctatcttctctctcctcagcctggccttttctgattttcagtacatgttgcaagtggaaaatggccaccctgcagcaccaagctttcattttattcctgctcaaacagcccagaatgaaaaagaatctcttgtcatagatatctaggagagaatctgatttccccagcctcggtcagttctctccatcagattcaagtggccagaatgagggccagagttaggtggtacaaagaaagcttcaagggtctatgccaataaacttgtggatttgtgtggtaggtaccttcagaagtatacatcacagtcaaatttatccagaatttgtgataaatattcctatcttctaggaaagaatcctataaataagaaatataataaacaaaggaaacaatccaaagaggctgtatgtgagggggtcagaatgtcaccgcaaaatatgtcaccttggtataaggaccattttgagctgaaagcacttaagaaacaacaaactgcagaaagagctctttgctctttgctctctccctatctgcctaaaagcagacataaatttccttttgtgaaggtgttcccctcccttcttccataccaggaggagaacaatcctttatcactggatacagaaagttggcaccaagatggatttgcacaaacaaaccttgctaaaatagcccttatcttccattggtatccctcatatatttatcttcccacaatttatcacccctagaatcccaaaccccttttcctttgtgttatcacttctgcacgatttatctccctttattaaaatggtatgtaagcccctgggtttaactccttctttctgtcttcatttctttcatgtgaaggtcttgtgcacatataaattaaaatatgaacatcaaatacaatgtgtatgcatgttttcctgtcaatctgtcttctgtcagattaattcacatgccccagccactgaacataagaggttaaaggaaaaggtttttcttcccctacatacattacacataaatgtagtatatacagttattgatatttggagctccatattcaaatattgatgttggaattttaactactgattcaatttgcaaatgctgaatagatattaacatttttaggataaatcacatgaaatattctggggaataggttagtaaaatctaaatagatattagaaatttgaaagaaaagagaaaataaaatattccattctgtctcactaatgactactgaatcaaagcatgaccatgcaaatagggtataacacattttttttgtaattaaagcaacttcaagataggtaacattaaaaatatcctggcttaatgaaaacaaaaatatgaaatgcagttaggatgtgtggatctttatcgtgttatataaaaatacaaatatttcaaaattcataaacttcaataacggagagctatgacagcagagttccacatttttgttcatattcattttaagtgcatgactgcaggaaggcgtttctcatgctatttctctgtggtccctgatattcaaagtagtacatgcaatattaatgatctcacttttgtgagtatacagcatacaccacattcccacctaaagaaaagctcctcaattcctaatcatttcaataggctctaatgtaatatttcctacattggaaatcacagcactttatttaaggaaatcagtttggccaagtgagctctatggagtgcagcctgcacagacgtcagttcaaaggatcagatgtcaaagtgctccctctaatgtcctttaatcatcactccgattagtgcatgaataggactgtgattaaaaacgctgctgccattgtctacctattcaggcctctagcattttacgtgggttccaccgattagtgtttgaataggggaacgattagaaagacagctgccattgtatgcccattcgggaaaacagcaaaactcacatatttatttgctatgagcaccaaataaatgttttgcaaaggtaaaatataccattagactctaaagacaattttgctgatttcttttgttcagagcactgtattttcccatatgcaaagatgtttcttatttgcaaatacagtaatatgcttcattaatatcttttaaaatatacatattttgttttcatagaaatagtcttaacacacatctgctttattatatactacttattgacctataatacatcatacaattccagtttaatatttatgattatgcaaagattttctgtgtaaacaaattcaatctatttggttccagatcttttggatcccttctcaatattcttggactaatacgtagtctataagaacaacttcttctcccaagagaaatttccttgtcagacacggagaataaatatttcactcttgggccattctaagagagggaacacatttcaggttagcagttagtagccctgcaggagctcacacaagagagcttcggccagagtggaattccccacgacaatacaaacctctatcctatgataaaaattctccaagaccaaggcatcatgttgaggctttttggagaagggagaaatacaggcaaaaaaaaaaaaaaatcacagaaaaagaatccatccatatgcaaatataagacagtgctcaaaaaaatttttgtggctgtttctctctctcttctttctgtttctgtagaaatatgctactaggaaatttctgggcaatagaggaaatattctgtcttccattaccatcctcagtatcttgctgctcagtacttctccatggtttttccatatacattgttctctatccactatcatgatgtgcttccatatgtagtaacagaaacctcggagcatcccccttataaatgctgataatgataagcaataatacttacataaggttatatatatgccaaccacgattttaagaatactatgcacattgactcatttactctatcaggtagatattattctcttaatttagagatgaggaaatggagacagtaatggaatcagaaatttactcaaggtcatactctagtaaatggcaaaaccaataattggagctaagcagattatccctagagcttactctcttaaccaaactctctactgacaactgagctctttgggttccactgcctgccctcataaaaacccaacctcaaagataaggaagctgtgaagggaaaatttttcttcttttgcaaataaagctaattgaaacataccttacacaggggaaagttttttccagttcagtttaaaccctgagtagataactatattccattaaccataaagttgtttaaaaaaatagagcaccctgcttaaccattattaaaatttcaaaccagtgaagaacaaaataaaagtaacaaggctgatggctgacaattacaaacgagtttaatttgtgtgtcacatggatgtggagaaagttgcaatcagtctgaaataaataattaaagcaaagcatttttgtaacagcctcaggaaattaagagttaacacttttcttctttttagtcaattatcatcttattacatatttctgcctggagaataaatctctgacaacactggtccatgtgtggaatgaagcactaggaaaaaacatacttttaaagagggatactaatatatatcaaaactctaaattacagcatatcacaaacaaagaatgtgcctttttaacatataacatgcacttctcaatgaaataaccagactatagaacttttcgagaaaaaaatatttatcatcatcatcattgtcactactctgtggagaggtcctcagcatcatctcttggtacttttcttcatgctccagtctacgacttcagccatgcagtactgacaccgtttcaatcccttaacttcaatcagtatgctcccccatcttcggactttcagatacaagttttctactctcgtgaaattcctctttttccttccttccttccctccttcatctttattttcagtttaaattctggttcctcagggaggccaaccttgaattctgagaccaggctacagtacttcagctgtaactcccatggaaggctgtactgacgaaacttgatcgtgaaatgaggttaacacctgtgcaaatgcccacttagctgtctgggcaaaaaccgttttgtccctttcccatgacttatcacagtggctggaacatgttagatcttccattaatatttagtaattaataaatatgtacaatttagattcaaatatttatactatataagtttcaaagtgaaataatttatatgtagtggtgttacagaaatactgaaaagtgtgatgcaataaattaattctttaagggggttcattactccagaaggtaacttatttccagcaattgaattaatgcccaaaaatattcaggagataatactcacagttcatacttcatatatatatataaacaacggaaaccaatcaatagcttcatattttacttgctgtttcagggtatactttgtattcttacagaaatctaggtgtatgttagtagataaaacttacataaaaattcttcaaaagaatatcaaaatacatttttatatatgtgtagattgagcaattcacttatcttcaccaagcttcgtatttcccattaataaaaagaggattataatcataataattaacaaaacaacagtaatagttctcatccaccagaatataagttttggaagagtaaagtacacagttgtattctcagcaccaaaagcagtgtttaacacacactaagatttcagtaaatattcaattgttatttattgcatacttactacatgtgtggcactatttcaggagctgaagatacagttgtgaacaaaataggtcttcacagaccttacattctcgtggggagaaaatgactaaacaaccaaacaagtaaaatatgaaaaatagtatgttagatggcaatatgttctatgaagaaaaataaagcaggaaagggagtataaggagtaaatgcatgaagtaatatttgcttcatagagttgttcatcaactaatttagttattataaacagcctggttcactatccaccatcctcattgtcttcatcatcaccattatcaccggtattatttgagatactgttacagagtacagcactgtgtcacacagctaaatcctttgttagatgcactccctacatcatagaacttcagaaaaaatgagtgaaatgtatttgcttctcagcacagagatggaaagaatatatgagaaactgaatcatataatctaaattaggtatttgtatcagatactcaaaaatgctttgtgtacattaaacatatcataaattcataaggaaggagaactacaaatattttacaaatcatgaacatttatgccacttatgtttacataatttacttgcagaactaggtgcatacagggtttttctcaaatcaagataccataagcaaattgatctctctatacaaatgtctaccaatattttcagttaaattaatttgggacaggaaaataatatatttgagaatccttaaaaatgatgtgattcagacactcagaggaattgctttttattctggaaatacaagacaaaattatcctaaactaagttgaactgcaatcttgcagttactaggactattgttcatatacctatgtttttattttcaaagagtttccttttcatgaatttccagtgctatggaaagctatcacatctaccaacaacattaataaaaattggagaacatttgcttcggtcaaaatattttctgccttctctctgtacatgctttattttatagtgccaaagacaacagagatttttaagatatgttatttttatatactaacaacaacaaaaaactgctaattaaactgatacaaactttcttatcagattaactataaaatgaatcttaattccagagatgtgaaactgtgataaaatatgcatcagagaattgatcaaatatggcaagtaccacaatgacataatgattcattgtttcatgcagaaatgaaaatcaaatggcataaaaatattaaatgaatgtatgttatacatttgagtcttcttttattctatgttagttacaatacagtgttgttgataatagcatttttagtgtcaagaattgccctgagttttcttgcctagatgacaaagtgattatttttgctaccaacatagcaaaagaaaagccaggcaggaataggcatgaataattcggtttttgacatagtcataatcagaaaccaatacaatatctaggtggaactatcataagaatcatctggatacagacaggatcttggatggagatattcatttggctgttaataaacacatagatgggcattaaaactatggagtgaatgtagctatcaagagaggcataattgagattttccactgttcccatcttgaaatctacaactagactctaaactttctacccaaaatgcctttgcataagcagccagttattattttaaaataaatacctgttgtatgtcagaattcatacaatgaaagactccacctcaacttcaaaattacaaggtctacaatatgtgtaaatgagctttatactctgaagggatttctaggtagtcacatttcacagtatatttttccctctctaatttttttccctctgctgaaattttaagctcgcattttctttaaagtgttattttctttaattttcctaagacacacacgcaaaattattaaatttacacattaataatatctaacatttgttagaaataagaaagctattgcccagtaatgatcacttaaaatatacttacttcaaagtaaacttttatttttctaattcattgcaatgttctcaacaaatgccacaggaaaattgtttttaaaatgtatgtatgccatttatgtttacataatttacttgcagaactagttgaatacggggtttttctcaaatcaagatgtcataggcaaactgatctctttattcaaatgtctaccaattttgagttaaattaacttggggataggaaaataataatatatttagtaatatattattcacagtaaaatcataccattatcaagtgttccaaaacactcaataatgcgtcatgactggtagtgcaattcagaagttaatgtaatgaccaggaaatcccacagagtgagccagcaagtacttctgactcaacctggacatccaaatccatctgggtcgctactgcggttttgcagttgctactgaagtttaaacacctgtggagacactactgggtcttgaggctggctggtacctccaggacagtggaagccctttgggccagtaacagggtgaagtaagtgaggcactgaggcactacatttaagttggcactcagttttaggatcacgcaagtaatgtcccagcttcccaacatggggttcctctggcattgcctgccctcgcctacctttctataatctttcccatcccaaataggaacttactctgccatctctccccactccaacagccttcatttgagaacttgctggatagagggcaggagatgatcatcattcatgataaattcaaattcaaaatcagtctttatgaggtggttgtagttttgctaccatcccttcccattccacctagaaatttatacctattaggcagagaagccactgggttttcatttcttgaaggaaataatataactacagaaagcagagaaacaaagggtgtttcttttggacttagaattttagaagtcacgttttcagaaaaattgaaaggacttcagtgattgacagtggatttaggaggaaatgggtgataagttaaaagtaacttttttcctccactcccatccttcccacccagtctatataaatatttaatggacagagagacaaaatgaggaccaaaagcaaagtgaagggcccagagatattggcagatcttggagaaagaggatcaatgcccagctccttaggctattctcagagggctgacaaataccaggtgtgggtaaatgaaagatggagaatctgtgactcgacaaacgaagccctgggagagtagattgaaccatgaacttctctgaaccccagtgttgagtggaacatcagaatgactgtcatcttttcaagaatggcttcaaagtagtagagaagtgagggatagaaagggttctaatgaatgaaaatgaaagatgactccaaagtccccatgatggtgaccagtgggaagatggcatgaaaaatcagctgggcttacctcacagcccacacttgccaccaaccctcataaaacttaggtatcagctcgcagaaataaggggtgagggggacaagcagggaaaaatgaatactacaagtgacacacaggtttccactctcacagatacttacaatagaattaagttcagttacaagaaaataaaagaggtcacgtgacttgcatgcctgagtttctagttggatatctgcatgctctatacaaacactgcatttttcacatactgaaagaggtatttagttgcaaagaatctgtttttatttttttatttcagaaactcaactactgtctatttttggaagaaaataattgtcaacaatcaaaaaagcaagctcatgcttgagaaagtattttcaaatatcatataacaggaggcaagggtagaacaggtattgctttcttactgggtatctggtgaaaagtttatttactttggagcttaaaaataaaaattcatattgtgaatttgatatgtcaatggagggacatatattctccatcaaatttaacagatcccagtagctggctatccatgaaagcgtgaatgagattgactgctagttgtactaattaagtggatttcatctcttaatagccatgtaaacttgagaaggaaaaatggtgccagcagacaagacaaacattaagtataatttccaaaagtataaaaattaaacgtatttggaacataagaaatattattagaaaaacatattaatctatccttcctccatggaagtcccctactatgctcttgtggttctcatctcacctctcatagtgcttatagctaaattctcatctctgcctgccttttccatgctacgttcagtaccatgctgagccacattggagcctgaggcaaaaggaaaaaggtgtgtgcctatatatatttattattattattgtttttctagattactgagtctttgttagccccttatattttgaacctcaggccagtgcctcacttgcctcactctaatttctgccctaatcccaaaggtctaacctgcaccctctttccactttacacactcttcctgggtaactctccccctaggcttttagttatttacatatatcctgatgattcaaaaattctttatctccatcccagaccctttactaatcttcaacttttgcagtgatccacaggcacaagacctcaaataatccaaaagtgagtttagtatttaccctcaacttatgctataaacaagtaaacatacacataaagtcaactcccaaatcatatgtgttttatctcctaaatcaattcaagctcatcctccctcctagtcttcatcacctgtcttccaactttctaaacccagtcccagagaccttgcctcccatcttttcattaaatccatggtccacactgaaagctagactgattcacctaaaggcaaatatgatcaactcacactgatcattaaaacgccttaactgttcttccttcaaaagagtattattattatttattggtatttcagtcttcttcaaaacaatgtgagaacttcttggcaaggcctatgtcacataaatttcaatgtggcaagtggcacagacaataaatgtgaaacaaacgagtgactgagattgtgaagctcatgcaagaaaaaaaaattatcaaaacccatatattatttagttattttcattgtctacaaggaaaataagtcaatgattttcttttatttccttattcaaaaaaattctactaaaagagctctctggcaattgcataggttcagtctctagttctaccattcagttgtggaactgtgaataggtttcttatgcttccatgtgcctcaattccctcatctatgaatggatgataaaatataatgtatacctgacagggtgcttctgaagcttaaataaattacttcacaaaaagcattgcaaattcttaatatacattatagcttattctcattgtatttttttttatggtgagcaccttgtatgtgtcatgcatttagaacaaatttgctataattcttaaaaacaagtctaataattggctaattggctgtctttaactgcctttccttttaattttcacctagcataagttttctgatttgtaatattttctggtcttcaaaaattgctcaggaaaaatgagtgcaaaatatttatgtaattaggatagttcaacattttcaaaaatggcaaaaataaacagcagttatggaacacctgcttaaaatatactggaaataactgcttcatgcttcattaaccagtataaacatgtttgccagtttaaatcccctactgaagtcagaatttccaattagtactagaagaatattaaactaccaagtgaagatattcctgggcaataatttcagaactgccattcttaaggcacttttaccggtcaaacacatgcttattttctaagaagcctatgatttacttattaaacaaaatttgtatctattttaataaacgattttagactacttattttgctagattttattcacctctgagtagcattcaatacagtgcctgaaataagatgcttcgagcaccaaagaaatagaaaaaaggaagaagaaggcagatagtaagagaggactatataatgcctcaagaaaaacttctataattgttgagtccaattataactctgttttgggtaagtgaacataagaaacatatagcctatatatagatagatatctatatatagagagagatatatgtatatatatcaatatatagatagagagacagtaatgcaggctagaaatataaaggaatcttcaatctaaagatagtattaaaagtaaggagataacgagataaccaatgtagtgactattttaaaagaaagaaagagagtttgagctctgggcactgaaatatctagggatgagaggagaaataatcaacaaagaagtgaagaaaaacaagaaggagatgtcagtgaggtaagaagaaaactttttcgtatctcatcagttactggttactggctagctagtggggataaaagttccagcatcctacttgggtctttatgaattgaaaaacaaaccatatgttttggtgacactttcattcaattatttatgccagcatgaagaggataataacaaatacgtaaggagcagcattattcaaccacaccgagaataactttcaaccctagcttcatatttcacttttgggaataaaccttactgctctgagaaattcatgaatgtcacagagagtcttcaaactaacagacatcagtgcaataaatctgatcttataaatcgagattactattttaacatagatctaaagctttcattttatttttctactaatactcattacagaagacctgaaatatacaaaagtgccaaaaaatataatcaatattaatatttcatttttttgttcttttgtgcatatatatataaaggtatggttatgtgtaagtgtacacaatcactattgaatacagtgatgttaaatcctttttccatgtaatgcagatagaatttatccagattattatttcaaaaacatcttaatgactgcacaatataccactgaattaatttactctaatttgcttaaccatgacccactggttggaattcagtgggatttcccctacatttgtctccattgagtaaataatgcctaagataatcctctttgtgcttaattctttatctatattcctaattctttccttcagatatgttattagaaaataaattactggtgcaagtgtttgataattttaaagtattgttatgaactgaactatatctcctcaaaaatcttatgttgaagtcctaacccccactatctcaaaatgtagctatatttggagagagagtctttaaagaggtaattaagttaaaatgaggttattagggtatgtcctaatccaatatagccgatgtccttatttggacacacgcacacccaaagtgaaaaactcagggagaagacaccatctacaagccaaggagagaggtcttggaagaaatcaccttgatctgggactcctaacctccagaactgtgagaaaataagtctctgttgtttaagccacctagtctgtggtatcttcttgtagcatccgtaggtataaatagcatccctaggtatagcatcacaggtccaaatgaatattgtcaaagatattgtcaaactgcttttataaatatttgggtcaatatatatttgacagagaaagtggacctcactgtaccttggttattatttttaaaatgataaaataaactcaatttataggatcacattatgagatacaaatgctaatttccataaaataacaacaacagcaatcaaaataaagaaagtctccatttcgaaataaagtcctgaccataaatactttgaaaacttataaatgcgagacattagggaagtcacatagtgtctcttgatcatagttctcagacctttaaaaattagagatttaggcttgatagtctttaagggctttctaagtttaaaaattatatcacactctggggactgttgtggggtggggggtggagggatagcattaggagatatacctaatgctaaatgacgagttaatgggtgcagcacaccagcacatggcacatgtatacatatgtaactaacctgcacattgtgcacatgtaccctaaaacttaaagtataataataataaaaaaaagaaaaaaaactataataaaaaaattatatgattcttttttcagtgttattcaattgctcttatcattaaactgcgtcatggcttgtaagtggcctattccttgaacaatctgaatcacactggtttccttttagagacctctactagaagcatcatgatagaaaacaaagctcccaaaactggaacaagaaaaactgaattcaaaatccatgtctgtaattaagtgactatgggatcttttcatgtaacattgtttctctgtttctttttcttttttcattcaaaaaaaattgcccagtggctggtgatagaaaaacttaaaattagataaatacaagcacacatgagcacacaccctcagtttccatcctcaaagagttcataatataagaaggaggaaagaagtacataaactaaaatcatacattctataagaaagtatatacacggttccaattgagctaatgttaaactaatactactgtctcactcattaatttgggaatgttaatttggggtaatctggggaaatcagataaaaagacatttctttcaaaatttaaaaacgtatataactttaagatggaatttctaacatcacctttaaggttgtacttatatccgatctatggtgtcagtttcagctctataatcacctcctatatacagttaaacaaagttctagcaataatctcagagaaatgctgttttgctcctacacctcacctggaaatattaggtgttcatagaacatctaatgttcatatattttgtgagggtgtatttttaaagtccacagataccagtgtatctatagctttcttcatttagactatatctttaacatgaaaactcttctgtatcattgtgtcattaggcaaaacaattttaaaacaaattttaaagattttgaaaaaagaaattttggcaccaaactaaatttacaggttgcatatcccttatcaaaaatgcttgacaacagatttgtttcagatttgggtattatgaattttcagatttgggttactcaacctgtatataatttgtatttcaggagattttttaaagcagtgtaattaaaaatacactttcaaactttttcaaatattaaatatttaaaatatttttaaaatcacggctgtactttaataccttatttctaagtgtatgtaaaatcttgccttacaatgtgtggagtgaggtaattttcagcatgaaatagtgtatcagtggtacttacaaagcagttcttatcaggatttcttttccaatgtttcttgtctaatttcttggccgaagtggaacgcagagttgcatgagtttgtgttcgaggatttaaagccaggatactctaaagacagcataaacaatgtgtaaatatatggaaatatgttggcatttgtttaaacttatttttattttatttttatttattttgagacacggtctctctcactttgtcacccaggctggagtgcagtggtacaatctcagttcactgcaacctctgccttccaggctcaggcgatcctcccaccttagtctcccaagtagctcggactacaggcgtacgctaccacacctggctaatttttatatttttaatagagatgaggtttcgccatgttgcccaggctggtcttgaactcctggtctcaagcgatccacctggctcaacctcccaaagtgctggggttacaggtgtgagccaccatgtctggtagcatttttaggaatcaaactttatctaagatttcctcttacaggcccctaaagaaagggttagccaggaaagaaaacttaggaatcacaaaaaaaaaaagatacatgtaaatcagaagaatgaccccaaatttgcaagattgtgtttaataaaatcaagtgaggaatcctatatttggttttccaaaaaaaagttcagtatgggaaaatcctaatacaatgaaaatttatatggaaaaagtgagaagatatacttgtcttagaaaaaatctaataatgttatcattgatataatgacatcattatatcaatgtatatcattatacattgacaaaaagctaaaatatatgtttaaaatgttgcatggctctcaaacagcttacattaatagactaatatggggcaaaatataaatcgagtaattgttattgtattttctactaattagccagaagcaattcttgaccagaagaaaaacttcaagaaaaacaaataaatataatcaataatgaacaacataccattatttcaccagagaggaggaaacatggtagtagcacatgcttctgtctaaccaaattaacattattacctaccatctttcaataatgattatgtgttgaaaagttagatgcaacagctgaagaaaagcctggagaaaagatctgggagagacacagtgtatttcagtaggtgaagaactttcacatggaagagagatttaatttgttttgtattaacacagaaccaaggctgtggaaattaatggaggaagatttggattcagatataaattaaaaagtggcagctgagattgtattagaaatcattccagctgacattactgcagtcattttaaatgatgttcatttcaaaagtcttcttccatgaagttacccctaactaatctagatccatttttctgtttcagatcactgaaacatctctaccacagtatttcagtctaaacagtaactgctgctttaagaattttcttcccttctaaactgtgaatgtgttgagttgcgggattcctgacttttcaaaaatctttcagtttatgatatacagtaccaggtaggtagcatatgcttattcctgtaaaatagtaattcaaaaatcataaatataatttttaattcctagtactcttataactttgagtaaaccattgatctttttgatctttgatttcctcacatgcaaaatagggcaacacctgaatcagaagtaaagaataaatgaaatgcatgatacaacatgttttctaaactacaaaaaccctaaaaattgaagtgtagtgaaaatggaatccagaggctatgtgcaacagtaatcctctgtccatgatttgttcatgtagtggccaagtaagaatttgaaggggacctgagaatgcaattcctactagatttaaccaaatccaagatcaccttccaaatctagattccatgattctttaaaaattattgggtcatgttcatcattttcacatataaaaatgaactcttattgagatccacagagaactatcaaaaagaccacaataaatgaacagataaaagaattattatactattaacaacagacacaagctaaaaatgttattttccacctctactaatgtaattccacaatcaacatatctaaagtaatcattttctaggtgatatcttagctgattttataagagtatcacatgctaatatgaagaatttaaaaatcataaatgactttctaaaataaatgttatacttagtattcttagacaagaataaaatcagaaaaagtcacttcatttcattctgcatttgatttaaagtggtaataacaatgctttgtgttttaagtttttagagtttaaaagttcaaaagctttcacatccattatgtaacttaacttacaaacagctactactctctcaatacttaggatgagcaaataaattgagggtgattaagtaacctgcttaagatctcacagttaatatgcaaaaagaattgaattggaactctgtttttctgagtatgggacttatattgaacctgatccaaagatgagggctatatttaaaagtcactttttgagatataaggtaggaaacatttttaaccacatgtttaaataatatcaatttgcacctgagtagctcaatgaaaaattaatttcaaaccctgtcttgagcaagccagtaaacatgaccattaagaggtcacctctggaatggtagagtaaggacctctgcagactgactcccataaaaataaacatataactgcaaaaatagtaaaaatgaaaactctttgaagtctctggaaatttgccttaaggcaaacagcaaatgaagaaacaataatacatgaaaatctgctaaaactggtaaaaggagtgaaggtctatggcatttgaagtataacccacaccacttcagtccagtgtgacagtcattctacctcagatgggtatagctcaaaacacagagctcgctctaccccagccaccagttgagggctatggtatctcccagagaggggtaagatgccagcatttctcattttctctctcccccatgctacacagagacaaaactgcaactgagtgcagctgagactaaagtgcagctgacaggtcaggagttctgttactccatccagcccccactcatagagccaaggttctacctcaggaatatcatgccaataacaccagggccctgattatccttgcctcacctcacttactgggtagagattgcacacaaggaagagcaagctgagaggactagaggctattgcctatacctagtactttgctcataaagcagaaatttaactctgagagaagtgggccattgtcactatcctcagctctggagcagtggcccagagatttttcccagaagacacaagccataagaacagagaggtccccccaaaggaactgactttatttgaacctgtatgcagggaagttcaaacctaagagtactcttataaacaataaaaatgttcatgtcaaacaattaagaagagggaggtagcttcctgaaaacaaaaaactgaaccataaggcaggtagttcataagggaaacccagggaaagaaacataagatgagttctcctggagttacaaaaaacctcaaggactcacctcaaaaactaccactgaaaaaaggcccaaatttaactgaatcacactgtggaacaactcatattccacagcaaaagtaataaagaaatcaaccagaagccactggaactaagatctgggtgtgacattactacaggcagacatcttaagagagagatcagagaaaaaggcaaagagacacctgataaaaccagggacacccaagaatgactgcacatatccaaggctgcaccctgtgagaatgacatcagcggttcacacagaggaaaatgtacatccctaaatagtatatccaggccaggcataatgggtcatgtctgtaatgccagcactttgggaggctgaggcaagtggactgcttgaggaattcaagaccagcctgggcaacacagtgaatccccatctctataaaaaatacaaaaattagccgggcatggtggcatatgcctgtggtctcagctactcagaaggctgaagcaggaggatcgcttgagcctgggaggtcaaggatgcagtgagctgtgaccatgccactttactccagcctgggtgacaaagtgagactctgcattaaaaaaaaaaaaaaaaaaaaaaaaaagtatatccagtcgctagtaacaagtcgccctcctctagagggggtttagtgtccggcaagaatagctacattatgtaagatgttcagtcttcaatttaaaaaagtatgagccatgcaaagaaacagaattgtgtgatccatacagacacacaaaaaaaggagacaacagaaactcccattaagagggcccatgtgtcaaatttaacactttgatatggtttagctgcatccccacccaaatctcatcttgaattgtagttcccataatccccatgtggtcatgggagggacccggtgggagataattgaatcatggggccagttacccccatgctgctgttctcatgatagtgagtgagttctcacgatatgtgatggttttataagtgacttttccgtctttgctaagcacttcttcctgctgtcatgtgaagaaggatgtgtttgcttccccttctgccatgattgtaagttccctcacgcctccccagacatgcacaactgtgagtcagttaaaccactttcctttataaattgcccagtctcgggcagttctttacagcagcatgagaactaatacacacttcaaagcagccattacaaggaaagtatgatgacaatgtcttagagagtacagaatatccatatacagatataaatcacttaaattattttaacaaaaacaacaagcaggcattctggtcttgaaaaatacaatagctgatatgaaacattcactagagttcaatagtagatttgaactagcagaagaaagaatcagcaaacttaaagacagatcaagagagattacacaatcagaagaccaaagagaaaaagaataaagaaaaattaacagagcctcaatgatatgtgatacaccactgagcaaaccaaaatactgtaatgggattacctgaaaaagaaaagacaaagcaggagaaaatacagaagttacactggcttaaaatttgcccgatttattttttttttaataaagtagaacaaggtatattacactataccttcaggaagctcaatgaatgtgaagtatgctaaatgtaaagagatccacacaaagaacatcagtaaaagggctgaaagtcaatagcaaaaagaaaatcttgaatgtagcaaaaaaaaaataattcatcatgtaaaaatagtttcaataagtttaacagtgaatttctcattaacaaccagagagaccagagagaagtgggataagacatacaaagtattaaaagaaaaaaaaatgtgaaccatgactcctatacccaacaaaactatctttcaaaaaatacattcccagaataacaaacaataagagaatttgttattagcagatgtgacttataagaattactaaaggaagttcttggccaggcatgatggctcccgcctgtaatcccaacactttgggagtccaaggcaggtggatcaccaaggtcaggagttcaagaccagcctggccaacatggtgaaaccctgtctctactaaaaatacaaaaattagccaggcatggtcgtgggtgcctgtaatcccagctactcagaaggctgaggcaggagaatcacttgaactccagaggtggaggttacaatgagccgagatcacgccactgcactccagcctaggcaacaagagtgaaactctgtctcaaaataaatagataaataaaaatgaaaataaaaagtgaaaaaaataaaattaaaggaagttcttcaggcagaaagtaagtaaccataacttactattcacacgaaaaaaacaaaggtcaacagtaaagtataggtaattatgaaattataatagtataaatgtatactgtcagactagataaaaagcaagatgcaactatgttctgtctttaggagacacactttaaattcaatgacacaaatatgttgaaagtaaaagatggaaaatgacatatcatgcaaatagcagcagcatgaaagctgcagtgcccatactaatatcagaacaacaaacttttaaagaaacaaaaaaatttactagaaataaagaggaacattttatcatcataaaggctcaatctaccaggaaaatataacaattataaacatatatgtgcctaacaacaaggcccaaaatacaaacaaatttgaaaggaaacaaatctttaaacaatactaattaaagacttcaatactccacattaaacagtggatagaacaactaggcagaagaccaaaaaggaaacagaagacttgaataacaactataaatcaacaagacctaacagacatccatataacactctaaaagagcaaaatacacattcttctcaactctatatggaatcttctctaggatatattgtatgctagatgaaaaaacaacttctactaacttaaaaatattaaatcatacaaaatagttctccctcttcaatggaatagaattagatatcaataacagaaagaaatttggaaaattcaaaaacaatatgatgaatactgtaaacattatgctaagtgaaagatgtcaactacaaatatgacatattgttgataccatttatataaaatgtccagaataagcaaatctatagagataaaaagtatattagtggttgctcaggctggcggattagggagaaatgagatggctactataaaaaggataagtgatttctttttgggtgaagaaacctgattatggttatattggcacaactctgaatacactaaaaaatactttgaattctataatttacattggttaattgttgatttgtgaactgtatatcaataaagctgttaccaaagtaaaaccctattaaattctacattcagtcgatttagccatatactttattcactgtaataccactaaaacttcctttattagctcaatataaatgtaacaagattatttttagtaactcctaaatattacagaaatcatatttcttcagtctctcaagttagacatctgtgtctttttgaagaaaaatatacaataaagctttaattttaagtggtgtattccttatgatgaaataatactaacaggacctattttacaaagccagtattagaagattcaagtaatctcatgcttatagaaaaaaagtgaaaacattttcttattccagaatataatgtttgcttatctattcagttttcaaccattactaatctcatccattaattcaaattgagaaataaaaagacacatttttttaaagtagttattctaacatttaaagcaaaccagccaggtaacatgcaagaaagatggctgcatttattttagtttttatttccataatccatattgtgataaatgatcatgtttatctatgtcagcatagcaatataacttttgagaataaacattctgaatgtaatttattggctacttatcacagctacttttctttcacatagcataagtagaaagcataacataacatgaaatattgggttaaccttttgcaaaaaggcagtgagttgaattcaatggatcttgggtaaaaataaattggattgtgcaaaatggttaccaaggatttggcttaataatatcccaaatgaaatgtgatataaaataaaaatacaagacatgagtggttcagagctgttaaaaataattttccaaagcaagactttaaaaaactaaaagtcaatatcatcaataactaagcagctgacagataatacaggagagttctaaattgcatttttcctaagaaatggccaaaggcacgttccaacaggtcacagagtcccctctctggatgaattgagcactttaagaagcccattaaccctttcagatacagggtacattacttatacagggagatttttctctcatcaaagaatttgacttgtttggctttaccaaacattttcagtaacacaataaagatacactggttattccagacgcagaaaaaaaaattagaaaaaatttaattgtactaattttacctagtttaagaaatgatggaatattatccagggccaagtataaatgaaatcaaataagagttatatattgtcaccgtttggtctgttaacactattctgtgaagcagtggaatgcggaaacatacaaactagaattatacatctaaagagagtttttctgtattaccattgagggcaaaaaagagaagcctgtattgattacaatcacaggccctcatgtcacaaacaaaatcactaaatcttaggcctaaaacattggagcttcagtattattcaagagcttgaattccaattgcaggaagctacttgaccaacatgtcctctttcttaacatgtggtattgttttatatcacaatagtaattatccaaacatagtgtaccattaagcttcctttaccctttgcattcgaacttataaacaaatttttcctattcaatactggtaattacttgctataattctgagccattaaaatgatacacatgttgctgacattttgtacttacatgcttaagatgataaactaagttttgtcttatttaaattatgcttacatttttctttaatggcttattctgagttctctataagttatctcctactttccaatgcatcaagtaaacaaataataataataataaacatgtttttcccatttctttcataattggacagaaatactttgatttcaatataacattgtgctgtggtgccaattttttatcaataaatattctcagctaacagaaaaacagaaatatctattgattaatgcttttgacgagtatttgttgccttatccaggtaacaatctaactaaggctggtcagtggagaactaaatttttcagtttatttgcttaacagtctcttgtttaaaagccccagtctcagccagttatcccacgcttctccatgtctctcattagtcatagtgtagagtgatttaattaatatctcagaaattcacaaaggtatctttggttcttgaataagctcagaactgatacggcccatctcctgctaggtagggaacagaagaggagagaatgcagctttattttgcatcctaggttcacacttgagatacaatcaaccttagagtctgaaaatttcagaaacccatggtaatcagtcctggtcaaagacttacatttacctaataattttttaaatgtacttccattctttgcccagacacaggtttctaagcccctaggttgttctacttttccaagtaacttatcatactttttttcccattttactagctctgtacaaaggccaattttccctttatgcacagtgggtaactcactgcagttgattaaaaatttatgaaggaaagaatctctgatagtcctaaatcttacaactttcattttgttaagtattcactaagcaatatgcatagtgtttgagattaaatttgggtttctatcttagctctactattcttgttggttatttaaactctcaagctctctactccttcaactgtaaaatggtgattagtaatagtacttaccccatagggttgttgtgatgattaaataagataatgcaaaagatgtttagagtggtgcatgcagtaagtgcttaccacatgttatctatgtatgtaatagaactaggttttagccactattaacccaatgtatactcatattcctatattgtcaattctgaatgtatacatgggaatcatatttttaagtacaggaatatagaaaaaggatgaagacaacaggtgagaaaatatctataaataaggtagtacaaaaaatagagatgtatctcagaggaaaccaaatcactgactgagtcatgggtctctgaacttatcattgccctaagccctgcaatttcaaaggcagactgcctgaaaatacaatatgctttttgcaaattaatatggcagtgtggaagggtcatgaaattcaaaaacagattttaatatccatcgcatatatatatatatatatatatatatatatatagcaatggagatatcattttataatccatagaactgtatataactcatgggtctttggtcccaacatgtttaggtaaatttacattacatttccttcccaggaagggcatgtcagatgaaaaatgatgaatttgtaaaacatcaaaaaatgttatcaactgaaaataaatgaatcccttcagaatgctcatcatatcgcctggaatatttgattcatttctactgagcatatagttaacacaaatagtttacacattttaaaatatcatgtctattatgtcactctcacactcaacaaggtaaggtgagccagaggaagctcttcgtctgtctttgcaaggcccagtgtgtgactctccttcacttctaaaatacacaccacacaacaggtgcctaaatgatctctatgtgaaaaaaaaagtctttttattgtctttcagaaaagattgacaattcaaacacaagaataataacatctgatattaacctcacaattcttaatacagaacagagcatgccaaaggtagtgactaattctgacatagacaatttagtctgttcaggcttttataacagaattccataagctgggtggcttaaacaacagatctttatttctcacagttagagaggctggaaagtctaagatcaaggtgcctgacaatttggttccaggtaagaatccttttccctcttctgactcactcacagccacctttttgcagtgtgatcatgttgcagagagagaggatgagaatgagagaaagctctctgtagtcttttcttataagaagcactaatcccactatgagggtcccaccctcatgacctcatctacccctagctaccttctaaaggctccatcttcaaataccacacattggaagttaagtcttcaacatatgaattttgaggggacataaacagttcataacagacaaggaaaggattccaccacctgtggaagtatgcaaatactattaatattgggcatcaacttaaagtcacctttagcctaagagttcaaatggtaccatgttgactgtaccattttattttatcaagaagaaacttcagaataaccaaaggagatattttaaagtattgcttaatttaagaaaagaaaagaaaacaatattaccaaataatgtaacactagctattaattatatatctttattctttaaacaatttaaacagcaaaacattaataacatatatactttatatatactgtttgtatatttttattataggaattgagaaataaagtgtcaaatgcaaacacttataaagagatatcaaaaatatataaaatgggataacctatactgtactttattttaaaatttcattactttaattataaactattttcaatttaatataatgtggcaaagcatccatatattacatatttaaattaaaaccagtatgtagaaaatgtgtaactatgaaaatacacgttggaatatcttgcatttgcaaaaagttgaacatatgtataaatttatacaaaatcccaagacagaattatgtgaaaagaaagttgatagggattattacgttaccaaaaaaattcaccagttcattgggtaagaaaatctatattttagcatttatactttttttcattcaaaacaaattagtcaatttacctcaaaacttgctttacagaaattgcctggctcctatgtaaaattggccttagagggcctttttcaagtagtatgaaaagtattatgatttacctttaatctagtaccttttgtgtataaaatactctcatttacaaaagacactgctcacaagaccaagggttattttagttcaaaagaggctaagtgtataccagcatgctaaaattatttaataccagtcaacaaatagagatgctggaaaacaggacttcaagggaaagatgaaagcaggacctgggctaactgagtttaaatgttttacaaattaagtaaatagaggaagtagcatgattttcaggttcacaaaactgtaataaatcatagcgtgactagttgcccttcatctatatggttaacagctaaaaggaaatatatatatgggctggcaagtgacttatgttaaaaataagaactgatatgataaaaatgagttttcatttctggattttattaattgaaggattatcatatctattttttgagaaggatcagagtagagcaaggagctgaggagttggggaattgggtgagttgaggagttggactatttaaaatcatgaaatttatgaatttaaagttcatgcatacaattactatttaagctacttttatttccttaataagtaatattttgtattcttaattaatacactttgtttcaatgcctagagagaatgctttccatttaaacagtagtattagctgtatatgcagtatggagtcacatcaagatatcccaatttttttaccaaaaacaacctaggaattccaatttaagagaacaaatatctcacttaaaataatttaagtttatacctaaagcaagatataaaaatataacacccaatcttacactgtaattacatactatttgacctaatctagcttctttccagggattaataaaattaacttggcatcttttttgggtccctaggatttagtatattagagttggaatggactcttagagattaacatttgatttcacgtcctatttagaaatcctgttccaaacactcattgaactatatcaatcaaattaatcaaaaatgacatagtgttagtctcttatataaagctcacataaatggataagaaaacaggaaaatattatcagataagctggaaaagggcatgaacagatcacagaagaatgcatacatatctccaatttaaagtgaaaaagagaaacattcagctacccactgagtcttcactttcctaccactactgcaaatgctcttgtcaagtctcaccgatgatgtgcatgttacccaacattctttgtgcattgttaggttttacttctccccgtctcatatttaagtgactttatttttttcttcataggtaaagtattacttttttacaatagctttattgagatataattcacttacacatgattcacctattttaagtatataattcatgaattttagtatacctacaaagctgtgcaaccatcaccatagtcaattttaaaacatttcatcaaacatatccctgccaaaaacatgtacccattatcagtcacttccagttttccccaaacctccagatttaagcaccattaatctactttctaactctttggatttgtctgttttggacatgtcatataaatggaatcatacaatatgttgtttttttgtaaatggtttctttcacttagcataatgtcttcaaagattattcatatagcattttacttgtatatgtgttataaaccccatactttactgtttaatttaaatgaccaattctcttaatgaggtttaaatagtaagtaaaaatcatatatctacctatgtagttaccatttttgcaattatgtaatccttggtgcaaacccctatttttacctactattgtttccttttgcctgaaggatgtgatttcctttaatatttcttgtaatgcgggtctgctgcttataaatgtttgcaacttttgtatgcctgaaaaagtctctactttgccctggtttttgaactctaatttcactggataatagaattctacactgaaagtttttgttccctgatactttaaatgtcttctcacttgcattatttccaacaataaatctgctattgctttatctttgttcttctgtatccagtacacctgtttttttcctctagccgctctgaagataaactctttatcactagttttgaccaatttgattatgatgtgcctcggcgttgttttctttatatttcttctgcttaggtttcactgggcttcttggatttacaaattcatttttacaaatattttcttcttctctcctcccactgcttcactctcatctctggggaaattccatttacatgtatatgaggccactcgaagttgttccacagctcactgatagtcttttcatttttttctctctctgtgtttcattttagagtttttattgctatgtcctcaagttaactatcttttcttctgcagtgtctaatctgtcttcaatattatccagtgtgtttttcatctccttacagttgccatctttagaagttcaatttgggtctcctatctattttgcacacctctacttcattttttgaacatatagaatacagttataatgacagttttaatgttcttctctgctaatttaacatctgtgtcggctttggatttgtctcaatacattaatttttatcctcattatgggtggtattttcctgcatcctttcatgcctagttatttttaattggatgatagacattgtgaattttaccatattgggtacatgatattttcgcattcctataaatgtttttgagttttgttctaggacataattgaattatttgaaaatgatttgatcctctcaggtcttggttttaagctttgtgaggagggaatcaagcagcatttgctctggggctaattatttcccactactgaggcaaaaaacttctgaatacccaatgtcgtatgaatcatgaagttttccagtctggctggtgggaggaggcattattcccagacccatgtgagtgctagttccgtcggactgttctttacgcagccatgggtcattttcccacatgcgtatactaatcattactctgtggagtactcaaggggaaccctctgctgatctgcaggtttctctctgagcagctctagcctctctgttgttctgttctacaaactctagcttccttggtctccctagactttcagctctgtctctccaattgaaggattccaccaggctttgtgtggtttcccccttctgatctgcagcctataaactctctcaagaggataaactagaaaaatattagggtttccttcatttgtttatgtttctcagggaacactgtatttcattgcttgatagccagtatcttaaaaataattgtttcatatattttgtttcttttttattgtttcaggtggaaatgtgtacaggaaagaacctgataggcctgagttgctcaaatcctgagcaatatggtttgactgtgtccccaaccaaacccaccttgaactgtaataatccccatgtcacacgggtggggctaggtgaaggtaactgaatcatcagggaggtttccccacactgttttcatggtagtgaatacgtctcatgagatctgatggttttctacatggtggttcctctgcataagctttcttgcctgccaccatgtaagatgtgcctttgctcctcctttgccttccaacatgattgtgaagccaccccagccatgtggaactctgaatccatcaaacctctttcctttataaattatccagtttcaggtatgtcttaatcagcagcgtgagaacagactaatacactaagcattcccaagaaaggcttgttttcagaagaagtggccctcagctcactcctaggaaccaagctgtgactattctgtcagacaagagtgttttgttttgtttttttttttaatgccaaaggccttgggccacgttgtaacagttggctagtttacattaacagtgtgattaatgatgagtatctgctttttctctggtggtctgaaccttgaataactgaagtcagtcacacagcactatatgtatacatgactaacacgcaattaaaaaccctggatactaaggtttgggtgagcttcccttattggcaactcttcacatgttgtcacacatcatttgctggaagaattaaatgtgtgccatgtaactccattgggagaggacaactgaaagcttgtgggtgacttcctctgaactttgacaaatgcgccttttccctttgtttcttttaatttattctttcaccataataaactataaccatgaatacaacaacttctatatcctgagggtatttatagtaaatcaattgtgcctggaggtggtcttggaacccccaatacaaaatgtacatctattccctagtgtcccaccttgagtgtatgcagaattccagtaagagtatcatactctagtggccactccttcacatggcttaattttatagagcacctggacaaacaatacagaaaaattttcaaaatggcaatacgtaatttctttactcacttttatataggaatcttaggtaaatgtattagagattgatacgtggtcatgggaccatgggctttaaagtagaaaaagttaacttatcacagatactcctgaataaatcagctgcatcagaatatctcagatttccctacacatctatcaattatacatggataggccttgggaatcaatcagtttaacaaatgtctgtggcagactttgcagctctcctgcctcagtatgcactccatccttccttcttagtagcaaacccctattacattttgggagccatagttctcagctacagactataattcccaggctttgacaagccattcagctaagtaccaggaaataatatgcatttagaagtgtgtatcttttaaggagtctcattaaagggagaggtataccttgtttttcctgttcttctctgcttttggagctctagctgctaacttcaacagagaggtgaacttgaggatatcagaatggaaagacagaaacctgttgacaacaaaaaggtgctatacgcactctagtatctatctctggacttcttttacatgaggaataaataaagttctgtcttctttaagccgcttttagcaatttttcccatgttataccccaacacctggtttttacagtgcccaaggtgattctggtggtcaactaggtatgggaaggactgatagtccaatcaacaaggcaaaatattcaaaaccagggtgcatggaaacttcaaaataaaagcatttggcttatgtacttaaaagataagtgggaaatcacatcagcttaagtatttttcttgaaatccatcaaatgtcaaaaatcctaaaccaaaacttactcatttcaaagaatgatcaatggaaattttattgtgccagcacaaaaaaagtaattcattttcatctccattcattgactgctaataggtttctccattttaactgacataatttttttacaatatagcataatgatgtgaataaaatatatccaatgctcctttgcaaactgttttttgaaaatctcccatgcacacaactccctccccaaaatccacacttccaaccagtctgttaaatccctccctcctatcaagccgcagtagataacacatttctgtgctcccaagatacaccatgcaaaacaccctatctctattaatattctaacttgatttctggatgtgttctcagtctaatatatacttcaacaataagacagtttagcaactttttatcaaaattttataatgtcttttattcgaaaaaaattatattaaaaaatgatataagaacattttttaatgttcttatatcagatgactatttggtaatacctgatgttgaatgagagcttacagtatgccaggcaccccttcaagtgtttttcaagtacagatgagaaaactaaatcacaaggagattgagtaacttccccaggaagtaacagagattcttaacccacatattttggcttcagattatggactgttattcactactctgtacttcttctatgggcagctaatattagtttcattttaatgtagtaactcaacgattgctgcatattcactgtaaatactgaaatcaattttgcgctggtgcagctacagaaacaagacctgaaataagtcagattaaagaaaagtctattatatgctgattaagccacaatatataccaaacttcctggtacacattgcttatatagtgttacttcaaatgaaaagaaagagacaaacctcagaaatattgttaaggaagctctagcaggacttgataacaatgagtataggttgtaaagagacagaaaagtaaatacacctcccatattaacaatttgtgattataaggggaatagtatgcacagaaaataaaagttgggatagaaaactggcttagaaaaaaatatttagtactgtttggctcatcacttgaataatggtgtcatcttacaaatgacatataagcagcaacaataacaaaaaactgacagtgaaatacagcatgtctccagtgcctttcaattaattgttggatttgaattaagttcacacatcttgtctaaaaagctaagatttttctttaattgtaaaaaaatcacagatgctctggtatcaaaaatacatttaccattcagaaatgtcaggtaatgctacttccattaaaatagaaattctgggtttaatatttatcaatttataaaatagtttacatatattattaaaccctcaaattcttgtattccaattgaaatccacatagtctaaaattctctgcttatatgcctgtctgccccactagcctttcagcttactgagtatgatgactggctattacccttctcagtatctccaggaacttatataaggcataaatatagagacttgcaataaattgaattgtatctccttagagtgtaagagccacaagggacctctatttacagatgcgcctagtgaagtaaaagaacaatccatattaaagactgagtcaagattagaaccaagtctcctaactctatgacatcaccacactcatacaaaaatatcactacaatgaggctcctgaatactttgaattatccatgactttacattgcctacgagcctacttctgataagaaaccatacttgaaagtagcataagagcaagaattagaagatgcataaataatatagaccagagaggcataagaggtcagaagttcagtgttttggatttactgggtaaaactggttttctttaatttccataggaaagattacaggatgcccacatgtcaagtaattctttaatcattaagtttgctgtttccattgaaatgttattcatctcaaagatatgtaaattatcaccatcactttaatacaatgcttcctacactttctctgtcattttaaagattaagactgaaaataaattaaaagcaggggtatgttgctatataataagaggtaatttcatcaaattagtaacattcagattctaatgagatttctttattattttagacacagaatattttcctaaaggagcatactaaacaaaacaatctaccttttaagacttttcttaaatggagcataccactagaaaacaaacagctattatttttcatttcaatctaaataactgcaataacttccaggtgtttagaaagaggtacctcccaacactacatagttccacgctttctttaaaccttcctaacacttagacttactcaaagatataaacattattccaaaggatgataaatattgcatcgtaattaaggttactgggctggcacagaagagaatttgacttaatgggagacttctgtgatggaaattaataagtttgccacttaattacaaacagtgtgggttgtgagcaacattcatactatttacacacttgttaagatttaagtaagaaaaggcttgataatacatctcttatttactacgaagcaaaattaaaacttgaaaactagaaacaatctatatttaacaatatcacaaagaatgaaatagctccgatttcttttgctttaaaatttgttttactgaatataatacatatttatttttaaaagttttaatccgaatgaatgataaccccctaaaatgcaggttatagagctggatgaagcatgtgaaaatttttagaaacgtatgtaaatggtgtttctcacaatttatggatcagttctgtctatcaattccaaatttgagtttttgtcataaccagaatcttgaaatggtcaaaacatgttggtctagcaaatcaatatctaacatggacaacgctaagtaaatgtccttggttattaagttaattatatattaacatataagtatgtttaatatcaacagtatctttttaaaactattccttagaaaatctttcttgatactgtcttacaattcatcttttttcacattcaggcccattgtttggtaattttaaattacttcaaactatactagaggaactaagaaatccaaatatctagagttttaaaatgttaattcaaactttaggcagccttttaaaaagctgcctttccaagactgctaggcaaatggccaacaacaacattttaactgtccaaaaatctgacggctgaataaaaatttgaattttactagcaaatgaattaagagaaacagctaaagtgttgcttctagaaagggaaataggagaagatggagaggggtgaggtgaaagctagacccagtgggcactggagagaggatagctaacatctatttccaactccctattcttagggagggcttaaaatcagcaacagaggctgtatttaccccagggtaatcaggaagggctacacatcaggatgtcccttctctgcaccatccctcccctaactcccatttactagtttaccatcatatcactgggaggaatagaaccactattccacaaagttgtttgtttatttttaaatgtttatgatatgcatgtactatcatgatggaaatcaaacacatttaaagatgtcattattaaaacaatggaataattcagaaatgattatacaggatccactgggtggcaaggtaatcataacatttcagtgacaatatcttaatcataatggaagtgtgggagaccagaatataccttcccaaaatatgaagggttattgcactgaaggcagttaagaagaaacacaggagagttctctggcctccctttatttgcctaaaagcagtagatagatttacaaagaaaatggtatcctgcccacctctctaccaaaaagaaaaaaggttaaccaccaaagacagctttagacccttatcagcctagcaacagtaccagaggaatttatattaacaagttttactaacttttgtctgccatgcatttgccttctcctcaagttgccatcctttgtcttttcagttctctaaaaatgtactgttctttgttgaaggagctatttcaaaaccacttctgggaaaactactcattctctgggtatctcccatgtacttgtgaaatatatatgttaatcagcttgtttacttttctcttgttaatccatctttcataataggggtatgttccaactaagaacctactgaaagttattactcccttacagtttgtactcaaaattccatatcaatccaaatcagttgccatgggtattaaaaggcactactgatcttgagtaatagcaagggcacctgcatagtcaatgtaatctaatttctccaggaaagttgacttacacaattaaagttaccaaacctaaaattatatttattttaagcccaatatatgtttttatggaagtatactattttagaattgataaaataaagaatttcatagattctggatttatttcactttcagattaactgagaactagactagaattgctttgttttgaacactgtagtgcaaattataattacccaatatgcacctctaactatttgctcctgtagcataattaattcaaaattatacaggactaaagatgcaaagggagcaagggttagactaatataaaattaaccttagatcatatccttgtcattatattttttcagtcctcaatatgaactggttttcttgacaatgacatcattatcattataaagtagaaataaaaagaaaaatgtccttcagtcaagggctccagtgaatcagttttataacacatctaaatgtatacagactttaaagaaaagaaaacacgatatagaatcccaaaaccaattccagtccggtaatccagtttgcctatttctttttccaaatttcccaacaaataaagattctgtcctgtcagctgccaaagtggccggcaaaggacaaaactggtcatttgacatgatgtagagaagtgattgatgatatctcatcagctccctccactgcaaccatctggcctgtggattagacgccattcataccttgcttcatttacacatgtgaaggactccttgaagaaccgaatattaaacatcttattgagaaactcagtgaatacatacggtcaggaaaaatgaggtaacttttgaaggacttcccacttctatacctctatgattcctaattttcatgtcatgtattttaatgtctgaataaacagcaatgtaaaactgagctcatattcatagattttagtttccagttcactactgactttaatcaaaccatttaacctttctatgtccttggtttcaccatttctgaaacggatacatctttttaagactggaaacatgttcttaagtagggaacaagaaaaaaaaatgctctgagtgcatagatccatgatgatccctattaattctaactctgccagctcctatacttacacctgcctcacacctgacccatttcagccaggacagccttccttcacctgtccttggaaaatgatcacctaattcattttctggcccctaaattactggatattgaggtgaaggtgaagggaaactgtaacaaaacttatatgaatttctttatcatttattaaatataatctaaataatggtgtaaaactaaattattaagttgcatgaatgtgaatttataacatgcttattttaactcttacaccataattctgaaccatcatccccaagtacttatgactttctgtcttgatatataattattggtgaaattgcctcatcttctgttctgtatcaaaagcacatttagaggagatgcatttatctttctaaccagactctaagtggtacttaatatagttcccaagatacagcaagtacttaaaaattacttataaaattgaactatggaataatatgttttgttggtaacttaagctttcgaaaaatgtatacaggagtccaccctaatccacggggatatgttccaagactcccccagtggatgtctgaaactgcagatagtattgaaccctacatatatatttgttttcaatgctttttccgttgtaactgagcacttctcatgaactgtaacttttacagcctgtggtgcaactgcaaaacttgcaagaatttctttttccttcttcacagcttcagggacagaagattcattcttaccatagatcttagcaatctcagtatctttccttaagtaaagaattttcacattttcacttgaggaagcactttactgcttctctttggcatatatgaattgtctccatcactactgttgcactctagagccattattaagtaaaatatgcgtttcttgaatacaaaggactccaatattgccacagtcatctgagaactagcatggttactaagtgactagcaggcagggagcttagaaagtgtggagaccctggctggacaaagcgatgagtcatgggctgggcaggaaggagcggaacaatgaaagatttcatcacattacccaaaatcgtgcaatttaaaacttatgaattatttatttctggaatttcacatttaatattttcagacctaaaactacaaaaagcaaaaattggatgaaggggaactgctgtgtttaatttttagtgtgggttttaaaaaattatctacctggttcttttccatatttgataacaaacatcttttcccttcatataaggactgtgcatatctggaagttaagcaacttcatgatagtaacagcttacatttgcatttgttcttaacttatttcttccaaacaacaacattataagataagcagaacaaggatcacgatctcgattttatagatggggaaattagcttaagttcacaaagctcaaaagtgccagaaccaggactttaatagcatatttaggattcttcatatttaggaatagtcaaccccaattacttccttcaactacaaaaatttgaatttaataaatactgtctcttacaaatgttagttatccccagtctcatttattcctaatatcaaagtatctgaggtcctcccctgcttcctcctccctcccttccttacgttctttgtccttcctctttccttccttcctttcttccttccacaaatatcccagctcctttgcagttcacatcaaaatttgtattcattttcttgggctgccattaaaaaaattacacaaacttagtggcttaaaacagaaatttactgcctcactcattctcaagtctagaagtctaaagtaaaggtgtcaaccttgtcatattccctctgaaatctgtaggggagaattctttgttgtctcttctaggttctggcaatccttgttatcctctggctggttgatgcatcactccaatcactgtctgcatagtcataaggctatcttttcatttttttcccctttctttttggagacaaggcgtcactctgttgcccaagctggagtgcagtggtgtaatcatggcttactgcagcttccatctctcaggctcaagcaatcctcccgcctcagcctcccaagtagctaggattacaggcacacaccagcacaccaatctaattttggtatgtgttgtagagatggggttttgccctattgcccgggctggtcttgaactcctgagttcaaacaatccacaccacttggcctcccaaagtgctgggattacaggcgtaagtcatcgtacctggcctggctgtcctttcttatgtatcttcccatcatatttcctctgtgttctactccctataactcagtgcttctgtcatctaccaaccccagggggttgccaccacaccctctacccagattcagtgagaatttaacatctaattctctatgtcttcaactccactcaattttttacaccagtcttagtgacttcaacagactcttggctcatttagcatctgcctctttttactcaccatctcaccaccaataattcttgttcttccaccccactgcagccaccatcacccttggttatagtcttgactttaccatgattatcgcactatctctaaaagctttatttcaaacataccactccaatctttacctctgacaacattccactttccaagaattatctgaccttcctgaaaccatcaatccatggagcgtatcactggtgttttcagtagtcatctcattctcctatgctgacgtccctcagatcagcttccatgatacactattatgacttcttcacaacatccttaattccctactcttctctcactccaactttattgcccaagcaaaactaatccacttaaacttatctctttacatcttatttgcctgaacccaagcagttaaaagtggatggagaacaatccactattatgttcactgctctcatgttcaattcttgactgcaagcatcaagtagaaaataaatactgcctaacaatcctactatacttattattttcattatcctactttacagaaaatctattcatactttcacctgttcttcaaacttttacagcctgttttcctctcaccctcagttggtaatcctgcctcatactcttattgagaaaattaaaaccatccattggaagagggaacttattttttgttccgccacccaatgtgccacctctgtctcaccacctattctaaaccttatattatcaatcctattccctctcaccaaaagaatccctttatacaagtaattatcctgtctatgtctttcaactctagtttccccactgcaactcttcccttaatatatgtacctgctctgttatccctctccagctacttccctattttctgttcccctttacaggaaaacttttctccagcatttcccaatgccattgtcttacttcctcacattctattttcttctcaaaccatttttattaggcttctttccccaatggctattgtcaagctcacactttttcaatgttactaagttaaaagaaatctttatgccctcaactaccctcccaacagcagacaagaaagttgactatatacacatccttcctcctcccttggtttcttggctatcttctcctcttcttaatgcctaaagtcctcagtcccttgttgagctacgctgtctttaagtaatcttactcagtcccaagactttaaataacatctttatgtcaataattcctcaatttctatctccagctacggcttctttacagacatccaaaagtttactttcagctgcctacgtggtatctttactgtgctatctaatagtgatttcaaactgaatgccattacatattaaatttgtgttccccacacctcttactttttttgtttaccaaagttcagtcccacctctttgatttgctttcatttttcctcaaaagcccctagcagacttcttatgatcttctagatttcagttcaaatgtcacctctacagggaggccttctctgactaccatgtgaaaaaagaccctactagccattctgcatcacattttcttggtttatttttacaaaagctcatgatattatctgaaattactgtatattaaagaaattttttttactattgttcctccattagaatgcaattttattgactgcagaattcttttctgtcttgtttgaaaatgtgtttacaacatctagaccagtgcttagcacattaggaaaaaattaatattttagatttaaaaaaagagagtaaattcctgtgttttaaagaagactaaaataacatattgtcaaagagataaatcactgaagtcaaacaataggtggtagccattattaataatttaatacctaatattaattgcatacttgccacatgctggaactattaaaaaggatgaatctgtagtattttcttcaaccacacaacaatcctgtaatgtaagtatgatttctatccccacttttacaatgagaaaactgaaacaaaaaatgtttaagttatttgccaaggtcaaaactagtaagtggcagagctaggctgtgaacattagcactctaattccagagtctatactcttaaccacaaatctatgctgtccttccactacaatcagactaaatattaattatctgttactcatcatcaataaatattataaaggacagaggttatcagtctactgctgtttctgaatttatctgaggtttggggagattttatgtttccaagataacattcattttgttgtgatctcatgatacattagcatctagttttcttaaaatctgttatacttctacttttcttatttgtattcttatttacatttttttattttactcttacattaaaatgttgttaaaataatttgtttaaaataaaacccaaaatattttaaaatgtggaaaaatgtttaaaatttaccaatattcaaacaaatacaaattaaacgaatcacacaaaagtttcacctaattgtttatttaaaaaataatttttattaacacttgaaagggtatcattttatacatactcatacagctgctagcagctatattaattagtagtactatgtagacatcaacttgaaaatatttcaaatccttaaagtagtcatacctaccattgatgattcccttctaggatcctataatattgtgatcttaagcataaaggatgcttaagttttgtttcttactgtccagtcttggaatgaaaggggtgatgggcactaattttcatgagctacatacaaatttttctctgcaaatgtttttatctctttcagaaaagacagagccttaagcataccaatgtctggagtctgggttgcaagtaaactttagctttaaaatgtagcaaaaatcaagagtcattttggttggcacacccaaggaagaagtatgttttgcttcatttaatttgtatgtgggagaaaaatgtgttgagtcaaaagtagttacactcacggaccctttcttctctgagtaccaggaagaaaaaaaaaagaaaatgtacacacacatgctagtgcatatgcacatgcacacacatgacaacccatacttcaaagtaaaggcaggctaggataaaataattctttgagaatctggtctgccagagtggtttgttcttggggtgagggtgagaaggctgggataatataaaagtttccatcacataatgagacagctgcagttagtattacatttactcattctagataacaacctgagatttatccattcacgacaataatctgaggtttatgaatgttccatccaagataacaacctgaggtccaaccttactcttccttttctcccagggcagaaaaaattaggaaccatgcacgctgtcaagccattctccagaaagaaacgctattatcagcactgagttaaaaggaagtcacatccacatcaaagggaactacatccagatgcctgcccgttctgttacctagaatcagtgttaggaagatgaggcaaacggttaaactggttccatttccattttgctccttctgtctttgcaccccaaaatggtccccttttccttttttaaaacatatttttaaagacacttaattcagttgaagcatgcaaacgagaacggcagaaccaaaatgcactatatatcattgagccaacactctcaagtgtatttccagcacaatgctttaagcaaataaaaaaaaattgtgctgaaacattgttcttaataactgactactaaaaaacaaggtaaatgtatgataataagagagaggcttgaatacattttgatatctccactcacaaggaatgttacgccgtgacttaaaactgaagttaatatgaatataaagaaatgcttttgataggacaagaaaacaaatatcaaattatatatgactaaaagtatttagggaaagattacctcgtgcacaggaaagaaatgtactacatcaatattacgtggatgacttgagtgggatgactatgtatctttggggtcatcttttgattttagttttttgtatgttttaaatcttctgtaataatcatgaaaaataatttaaaaatcaaatcggggaaataaagcataataaaagttaacacttttattacactaaggttacactaaaagttaacaggaatgaacattttgtggtgaacggtaacacacgttacccctagagatctgtaaggggaactgaatgcctttcttctttgaactgtggagaagtttaaatttttaccccagcactcctcaatatttggcatagagaaatatctgaaagaagtcccgcaaagctctcaggtcactgtggtacaaggagtcagattagtatagcttgaattctggggaccccattgcttatgccatggttttcacctacaatcatcaatcaacaaacacactgaagaaattggcataaagagtcccatctcctttttcgaatctctggtcttaatttctagttaaagacagcataatcctaaacatacaaaatgtaaatttgttaattccagatcacccttacacagaactccagccatatatagtacgattgaacttttcttgtattctcaggcgaaatttagatttagctacttcatcagattaaaaaagaaaaggcagcaagcagacattaaaaaagtttaaaatcaggtgaataagcacatgaaattcatacagctggtataaatagtacactcaatcctaccaagtatgtaaatcgaggagccaatatctcagcatttccttaatatgaacacacaccaggtcacatttccaaacaatttcaccattgccatattttatttcaaaccatccttaaaagactgatcaacagcaaactcactgaagatcagaaaactcttcacagtggctgaatgattcccacaaggtcagagagcaagggatctatggcatagagcaaaattatccccaggcttatcctgtatcttgggaaatgtacttattttaattaacaaatagtaaatacacattctactattttgctggcaattttcacacgaccttttcattaggcatggtaatgtttctataaattttaacatgctacaatttttcatgtcagtcttaaagaatttcataaagattaagatctaccgggtgagtcaattctgtgtaggtacactgagttgtaagttggaggataaagttttgggagagaagtaaaagtgctgggggctttgaggggttgaggtggaggagaaccagcagagagaggtgaggaataaaacatgggggggaggaggaagtgcagtcagggctccatccatgatcgcctcctatataaatcaggcctggagttgacatgtaattttgtgtgggtcccctgagaagtggccctcagggattaattattgatgaagagatttttcttcaaagtggctcagtcaagagtgcctcaaggggacattcataagtgcttataatatcaatttccaagcacctgggaggtagggacacagattgtctctttaattattatgatggaggtaaagtctagcaaaaatgctgttacacagccaaggtaaaattctcaaagaaatgaaattattatagctagtataaaaagtgtaatatatgagtcatctctcagtaagatcacactttaccttttcctggtgcaaaataggttatctccaaccaactgtttcctaggagctaaaagagttattcataagcaaatgcagtgtgtttagggatgcttaaaagtttagaaaaaaattgtttttgaagctaatatgtttgcttagaaagaagatgagtttactccagttagcacatggaaatacaagggtttgttttaattatgtaggaatttcttttcagaaaaaaattaatgtcaaatgccttctacatttctatgagaatgccaaaaaataattttcacctatgcattagccctgatctagtctcaaaaacactcagaaaaacacagaagaatcaatccatatgtatgttgcagtaaaaaaaggatggggctagcctggatttgaatcttattaacctacgtaatagatgtgaatagtcatgtataaacaaaacctaggccatatacttcctttgtaccatctgaaacttacaccagtgggctcgcagtacaacaggtactaaaaacatatttttagacagaaatgaaatgaaatgggtctctttaaattgatctgaatttcagaaactccccaatctccctcataatattgacaaatgttaattcagtaactttttcacaatagatatatgcaacatttataaatctataatgcacctctttcataatcttttaacttcattaactcctccctttctcatagattctaacagacttcaataccactagttgattactagagcaaaaacaaattcttgccaattgatgtttatataatgtacatgatagacgcagtaataacatttaaaataagtgtaaccaattaaaaaagcatatatttatgtgacaaatgctgtctgaagcattttgtgtatgtgactccaattaatccttatagctattgcatgaaatacataggattaaattcaattcacagaagaagaaatggcagtccaagaaagaagctgaccacagtcacacaaataaaataaaatagtgccaggattctaacccaggtctgtttaaatacaatgttttctttttgtactaaccatgaaaggaagcttgatttggggagatacaaaataaataacttcatataaaagtacttaattcctcaatacatataaatatatatgtattcatggtgaactggctaaaagttatatgttgagtttgaatgcagatgtttcatatgtactagtgtaacattttaattaaaagcaatggaagcagtaataattataaaccacaggaaagacataatcctattaagagttatctcagtagtataattggctccaggatatcagtgaacacccacatgactgatatttgaggccaaaaacaccttctgtcttgatatggaggattatgagcaaatgaagtccagaaggtaaatatgtcacattttaaaatcaaagtcccaattatagataaaggtgtaatcttacaatgccttattaaatatttttaattaaggtggaatataaacaaaataaaattttctttacagttttaaggactgaagggctctgcaacatatttgtcatgcattcatacagctgagaggcagaaaaataaattggccaatcctccattttgatctcctctttagctgtattgaagcctggattatatcaaatctcatcagattttctttgtcatgatattttacgacaatcttttttcagtctcattgtcttctagttttagtgttccaaactattacttacatttacgctaattattagaattctcccacagtgatcagacatctttattttactaggggttccagctttcagcccttgtgttgttgccagtttatacagagtttggtaagatgctgtattcaaatagttaaagaaaggtatgattgcttaaagatcttccataactgaatcagtattttgactctagatcttcttagtgtccttatcaattccttactgttaatattcatctttttttattattatactttaagttttagggtacatgtgtacaacgtgcaggttagttacatatatatacatgtgccatgttggtgtgctgcacccagtaactcgtcatttaacattaggtatatctccaaatgctatccctcctcccgaccccacaacaggccccggtgtgtgatgttccccttcctgtgttcatgtgttcttattgctcaattcccacctatgagtgagaacatgcggtgtttggttttttgtccttgtgatagtttgctgagaatgatggtttccagcttcatccatgtccctacaaaggatatgaactcataatctttttaaaagtgaatttttcttctagaatgtaacaaaggaggctaccaaattccagcacactttacaattaagcaatcagtcaacaccatttgctatcattaagattaagcagatccaatctaaaaatcaccctccatcaagatccatcattagtcattaatctcccagattttaattaaactaccaaaactattcatctgaattcatatgcaaaggatagaatttttctttaaactgcccacaactttggtgggccaagctgaaaggttcgcttgagcccaagagtacaaggccagcccgggcaatatactgagacccccatctctattttaaaaaactgcactgaaacacatatcaacacactcaactacagaaatatgcagtaccttaaaactacaggaagctaccattagaatcagtgactcctcaaatcagataatcagacacatttctactatccagctaaactccttagaaaggagaaacactttaaagtaaaactatggcccacaaaacagcttaaagtaggaagtacaagcatgttttcaacaactctaactcacaaaatagttttaaaaagttaaagctttaaaagtcttaatttatttaagaatatatttccaaaagatctgcagtgcccagtcaataaaaggaaggagaaaagaaatgactgatgcttacacattcagtaaaaatatatccatttaaatcaataaacaactcatggctttgtataaagtggaatctttattatcttttttggatccatgattctccttcctccccagcagcaaaggcaattatgataaaagatgttctgaaaatttttttgccatctctgccaatttataacccatgactttccttgtttcaaaatttgtaaagtccactttctccaagtctttcccattatgcttctattttccaaattcgctatttttaatctcattttcctagttaatcatacagaaaattcccaattaccttttcaaatgaatagaagtcacagtatcagtaattccgaaaccatttctgtttgacttaaaatgcatttgattttgtggacaatggactaaaatccctttttcatttagggtaaatgtgaattaagtttataaccctttaacattcactaactgatcattcaaggaatgggccttgtgattgtgactgtggtagcagtacagtaacagatagcaacttggtttggctacaaatatatatcaaaagtactagtattcaaatagttaaaagcttgctgcagctgcatacatttcgtttagatatatatactttcaaagtctattctcattatccttgccggtggaggggaacaaggtcttgaacaaaagagtactgtttcaaaataattctcatttcctttcaagtgtgcagatattcacaatatactggctgtaaattcaatctaaatgaagaagtgctgttaagttactgctgaggcctgggaaagtgaccaatgtccaatactaaccttctttgaaaccatcccaggagagtttgtattaaagtcatcgttgacaaaattcagactgtatccaaacagtacactcacaaagcaaaataacttctaaaagcatataactactattaacggactttaaaatgctaatcatttcattggaagtgattttcctgagaataagatatatttttctgttatctttattttttaacatttttgtcctttttcccaacaagatgctgtcaacttgtgacatttgtttattatccttagcagattttccatgtgcaattcagagaggctaacttgcccaaacacacagcttaaagttagacctcaatcagaggcagttggtttcagaagccaggctctgaaccacattaatatatctgaaaaaaaacatgatttctcatgcaacttctatgattacaacaacaacaacaacaattctgagtaatgagctaggtcctattaccaagtaacacatcctttccttgcctatctcccagcccagggatattccagctatggagtttggtgatctgattgttttccatgttcctaaccgtcaaatcctgatgtgatattggattcagactagaaattatgaagcaggcacacaaagcacctttatatatacctcaataacttttcccccagaaacaaagatatttcttggctgtttcactgaaacctgaggttctgtagttagctcatagggaaaagtcagtcactattagagtaggttgttatcatcaccttctgttcttttaacaattgtcaagtacttttcacatttatcaatgtgttcttatcacattcattaactgcttcataccaatatttttaaaatattacttgcttatccatgtatttgaagctaaaacaatgatcacaatcagatctctagacaatggttgtaatgaatttgttcaagaaaagcattcaaatttgatggaaaactgagcctttataattcattctaattcttcaacacaaaaatgaactttggtaaatcaataggatcaactgaggcatttatgcttgaatgtgctcccctaagcttaatgtatttttcctcactgcattatattttaatgattaatttcatgctctttcatggtattctagctcatgaatcacgggtattactttgagggaaaagtaaggtgctgtgagtgatgaaagatgttactgattaaagtgttgcacatatgaactacataagagctgaaggtgtttgaacaccagcaatctagattaaaagtaatattaggcaaactggccatatagactaaggttgaattgagtggagggagtgggaaggatgggcttcttaaatgttcttagttgaaacaatatatgaaatcaagcttggcattcaatgtttcactggcatctttctcctcagtagaatgtaagaactgatttcgaagacaactgcagagaaagaaatcagttaagcagataacacaccattctgaaattaaagagccaaaagccacccatcctaagtcaactccgatatcttaaatcaatactgccttaatactgtcagaagcttgtttttcgacttagtaaataaaattttttaaaaagttaagtcaaagtcacaaggaccaaaaaggaatagactaccctaaatgaaatatagaaaaagacaagtatctattatcctgcacacagatgaacaactatttgttaaatatatcatattgctcaatatcaaaaagtcaactctccaaaacagaaaccaaaagtaaactaaccagagatgtccacataatacactttggctcttgttactaaaatgatttttcaaaccaagttatggagcctggagaaaacaggactacttcctcccagaatataaagtttcttcaattacggaggcaaaatgtggcaaaagcagctattttgcaaacaggtggtttgcaaaacttttacttaagccgccaaaaggactgacgaaaggaaaattttgttatttctaaagaaaacacacacacacataattttctaccagagtagaagactcaaataaagaaaagccccaaacaaaacagaaaactaaaaatcagtttgtcttagctcaaaagtgctgacctaggtttagtatgtgtaaaatcactgttgataattaaatccttttcatcgcatatattaagatactagagagaaaggaaatgccatgtcgtttcaggtaggaccttatttacataaaaaaagattttttttaacagaaacggagtgcaagagggaatcaaaaaccgttgagaggagagaaaaatacagttagtttttctgagggcactgcatttttcatgttctgaatacttcgttccattctctccatgttaaattatttcataaacaatactatgactagaggcgactgctacagctgacacacagatgttttatttctatgcttcacctttgcaaatagcaggattcagctattggaaatgggggcagtggaggtgtccagaaacgacatacaggaggtgaaggggtagaacgtgtgggaaatgggcactcctaccccctagagtccacctctctggaactccagtgcttcttcagtcactgacattcagaggaggacaagacaggcttcctgaaatctcttccgaagtaaacaggtcccgacgcaaagggcaacccctccagtagcggaaagtcctcccctgagctccccgcctgcccacgcgggcctgtggctccgcgctcctccgctcccccgcagagctcccacgggggaaactttcccgcgtctctcactctccggggtgcgggggccgcgggggcctccccggcacctacccgcagagcactccccaccaccccgccaccaccgacgagccggcgcgaagtccgtacctcgatgtccgccgagtccttactgagcacaggggccatggcagtgcctacagtctcgagtctgccagtgacaaaccctccttgcgtcctcaagctccagccagagagccaagtgacagcagccggagcgcgagtcgaaaacaggcagactagggccggcggcgcgggggcggagc

SEQ ID NO: 94 - DNA, 83552 bp, Homo sapiens
gaggtgtcttgggcccgggcggctgtagaggcggcggcgcctacgggcagtgggaggagccgcgcggttccggctgctccggcgaggcgacccttgggtcggcgctgcgggcgaggtgggcaggtaggtgggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcgggtgagtgtcctgggacagggcggtgggcgggaggggacaggccggctccactcggcctggaggaggggagggtgaggggctggaggtgttgtgggcggattgggctgggcgggcgggcggctccggtgactcagggtgagtgacgaagtgataggggtgggggcgaagcaaggggatgcagtactgggggcgcccccaggtatggcggtgcggggagccgaggggccagagtagggtccgagaaggaagctagggttagagtaggtgcacctggtgtggacgagagactcgcctcctgagagctttgtaggggccttgcatccttaagtctgggtgtatttggggttgcgagttgaggattccaagtgatgccttagttaactcagtttgctgtggggatagaaaacgggacttcttcagttagctgtccgttttgattaccagcaggcctaacgcctctggttctctgagatatacctccatccccgttgtgttcacgtagtgtatctgcactgccagtatattagacataggggttgtatttaagaatcaagtcgatgcgttttcagggacgtgcagtgggtacttacgtgtcgtcaagattaagttgcatgtgtgtaaatcaaaattttgtgagcctttctttctcagtgttgtttcaacgactacccgatagggtgagatactgcaaggtgaggagactagcctagttacagttttaaattctctgatcttcactcccttactatggttacaagaaaaaacccagttctaagttcattgtgttaaatcattttctatcagtgacgcaaagtgccccccttcctttaaattcagttgtggtttgaatttttttttgagataattatgtttaggagcattagaaacgtgaaatgttagtgtgaccataaaggttggagactgagaagtcacagaaaacccagctactttggcttgccttactgcttgtccaggtagaagtaaattgctttaaaaaactcaagcagtgctaggttgaaattttaatgcatacttttacattcctgagaggatcagtgaagatagcaaactctcaaactacctctcttgttttgatttcaaagaaaatctgagcccctaaatgttgtattgatttgatgtaaggacttttttttttattattatactttaagttttagggtacatgtgcacaatgtgcaggttagttacatgtgtatacatgtgccatactggtgtgctgcacccattaactcgtcatttacattaggtatatctcctaatggtatccctcccccctccccccaccccacaacagtccccagggtgtgatgttccccttcctgtgtccatgtgttctcattgttcaattcccatctgtgagtgagaacatgcggtgtttggttttttgtccttgatgtaaggacttttaaatttgctgccatgaagcctctggcctctgtttattattagcttgactgtatgcaggagtagtttattggagttatattggacagtatgataactttgtgtttaagcaggtaaaactgattaaggaggtttttattttaaatcagtaccaagaaacgtgtggatattttttaaagtttgtagttgtcacaagagctgttttgacttgaggatggtcagccatgaactttgcaaggtgagaaaaaagcttcctttgcttttttttttttaaacccttacctgtaatttgatgaatgagatgtttcactttattcttttattttatttttgtttgtttgtttttgagacagggtcttactctgttacccatgctggagtgcagtggcacaatctcggctcactgcattctccgcctcccgggttcaagcaattcgcctgcctcagccttctgagtagctgggattacaggcatgtgccaccacacccggctaatttttgtatttttagtagagacggggtttcaccatattggccaggcatgtcttgaactcctggcctcaaatgatgcgctcgtcttggcttcccaaattgctgggattacaggcatgagccactgcgcctggccctaaggctttcaataaattcttattaattgagatcatcttctccaatgagtctatgaaaggtaagaaattagtgcttctattttcccatttgtattagtttgacacatgtaaataggcccagttagtaaatgaaaatcattgtaaactcctttgagaagaaatcaaagtcttgctgtacttcatgaatttagatagcaaattatcttggcttattgctccagttattaaaaagaagagaataaggacatacagcttctttagtgtttgactgcaatttttccaagacattcaaggtaacattgtcttttaaaatctgtgaaattttgctgcggcgcaaataacctcttgcccattgtatactggtctttgctcaatgaaagctttctaatggtaccttcatttcaagcctcatttaaagacaatatcagcactctaaattgtaccaaattcctgtcctctgaaattagatgttaagattatgtgtttgtatagtctaaactgatgattgtggtattacatagtcagctgctcattaatatagatgaagctaaaatgagtcacggacaaggatagttaataaacaggttggctaactagaacacctacctgattttaaaatagaaaatccttcctttataccaagaaatgtgagaacattctgcatttgaaaaagttttcttttctctccaatcttctgaagggccattattacatagcatttcctctatccctctacacttttcttttcttttttttttttttaaatagagacaaggtctcaccgtgttgcccaggctaatcccaaactcctgggctcaagtgatcctcctgcctcagcctctcaaagtgctgggattacaggtgtgagccactgtacctggctccactacccttttctaacaatatttctttccagtgaatgttgactcatttaatagccagcattttttttagtgaaaaaattgccctctcttttcaaagatgtgtatagtgttattattctgttaagcttgatctcagtgaaaacgtgtaatctctctagatctaataacatttaatttttttctaatttttattttattttattttatttatttatttttttggagatggagtctcgctctgtcacctgggctggagtgcagtggcgtgatctcggctcattgcaacctccgcctcccaggttcaagggattctcctgcggctgcctcccgagtaggtgggactacaggcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagttattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatctagaaataaaagattaactctttgcatatttggaatagctgcttcagtgaagaagtatgtaggatttttcttactgtgaacaagtcttggcaagacttgtttttgaaagaaatgcaagattattttagcaatatactttagtaatggttctgaggaaatacaagtggtatcttgagggttggggggatgttagctaattggtcttagagcttcagccatggcacctaatcctagggcagctgatccatagcttggccaaagagagaaaaaaatagagcatgctagcctggtgccaaaaaacccaaaccaaacacaaaaaaccctcagaaatttgaatgagaaaatatggagataaaattggtcagcactgggaactgaagctggagttggagggagagtctggcgaggccagaactgacaatgtgcaaatgaaagatgtgaagaagcagaaactgaggaagcaaaggagaaaggagcaactctgcacagaaaaattctccccacaggtccttagttcatgatggctttctaatgcaactgcagccctccttttacaactttagtgtctgttttttttatgattgaaatgagcctaatttaaacatagattttaaaaattccagtcttgcttaagatttcaaatataaccagagatcattcaaactgagtttagtaaatattgttgaacgtccgtaatccaggcacatgatgctgtcgtaggcacagagaatgtagaggtaggtaaggctctgcctttaaggaattaagagacttgtggagggaaggacatataagagttacaatagaaacaatttaatttgaagtacctatgtaaggtatttgcaggaatagacgttggggaggagtttggggtgatggaagccttcctagaggaaatgtctgaggcttttaaaggataactaggagtttgcctggtgaataatgatgttaggtgggtgttataggcattaaacaaccacatggtaagtttgcagaattaagatcactttggctgttagtctcatattcattccttattaggatataaagtatgaagtgggcactgatgagaaatgaggctaagaaagttcacaggggctagattgtaaagacccttgaatgtcatactgcagagtttagactttttctcattgatgaaaattctaagtaagagaaatacatgatcagatttgcattttagaaagataacacttgaaattagtatgggagatggattggtgatggatgaaactaatttggaggcttttgaagtagtccagatgagatattttaaggagagagaaaagagtgtatggattcggtggaaattttaaggggtagtatcagtagaattaaagatagtcttgtaggggtgacgggagttggacaactcataggtttctcgtttaagagagactggggaatgtggaagagatttgtgggagaagttaattaattggctggaacaattcactgaattttgagttctaggtgtttatgaggcattcaggaggaaatgtcagaaagaatggagcaattatttattgtctgtctactctgtgttgcaagcactgtgcttgacagctaacctatgtaggaatgtggctgagaacgataatagaaacaaaaatgacaccagtggccaaatacagatcacaaaggcaaggcactaaaactaaattttaaaaatatagaaatacagaaagaggctgggtatggtggttcatgcctgtaatcccagcactttgggaggtcagggcaggtgaatcacttgagcccaggaattggagaccagcctgggctgaatgtggtgaaaccctatctctacaaaaaaattagcctgtagtcctagctactaggagggcgaggtgggagaatcacctgaggccaggaagtcaaggctgcagtgagctgtgattgcaccactgcactccagcctgggcaacagagtgagaccctgtctcacacacacacagacatacacacacacaaatatatatatatatacacacacacacacacacacacacatatacatacacacacatataaagttcccctgtagtctctcactcccaccttattttattttattagtttatttttatatatttaaagggtacaagtgcagatttctttctttcttacatgtttgtatcatgtagccatgaagtctggtcacttagtgtacccatcaccggaacagtaaacagtaaaacccagaaaattacctgtacccgataggtatttttcaaccctcacccccctcccaccttttgtagtctccaatgtctactattccctctttatgtccatgtgtaccctttgtttagctctcacttataagtgagaatatgtggtatctggctttttgtttctgatttttttgactagggataatggccttcagttccatccatgctggtgtagaagacgtgatttcattattttttatggctgtctcactcccactttctagagatagccattgttaacagttagggatattctatatcatatcggtatatttataagtatagatatgtatgtgcatacacacacacagacatacccttttatttttccaataaatgagttcatatttccacacatgcatctgcaacttgattttaaaaatcgtggtcatcttttcattccagggtagacagacctctttatagttggtaatacagtgttctacagttgttgttgttgttttaagagacagagtctgattctgttgcctacgctggagtgcagtggcatgatctaggccctctgcagcctcaaccactctgggttcaagcagtcctcccacctcagcctcctgagtagctaggattagctcacgccactaggctcagctaattttttttaatatgttttgtagggacggggctggtctcaagctcctgtgctcaagtgattctcctgcctcggcctctcaaagtgtagaaattacaggcatgagccattgcgcccagccaccataatatgtttaatcttttttcggattgatgaacatttaaagttgtcttcatcaactcactatttcaaataatgttgaaggaacctccttatatttaatacatattcttgtaaatatggtcaaagatatgcctatcttgaaatatgatattgtttcccaaaagagcttaatttacattcttaacaacaggactagtgaagcttctgccttatattcccattgcatgttatctgtcttttaaatttttgactgtcagattggcaaaaaatggtaatttatttttacaagtatcttttatatattaatgatcatttgtatttcttctggattgttcctattttacccattttctattgtattatttttcttattaatttgttgacaggacattgacattttgttaaagttgccagcatttccccaatctgttgctagtctggagtttttcgtttttatgtcatcaaacctgtcctttttaaaaatttccttgatagtttctggatttactgtcttaggtaaaagtgtttttcatctaaaaatattctatttttcttctattatgcaacttttttttttttttttttgagacagagtcttgctttgttgcccagggtagaacccagtggcgtgatctcgtcttactgcaacctttgcctcctgggttctaacaatcctcctgcctcagcctcctaagtagctgggattataggcgcacgccacaacacccggctaatttttgtttgttttttgagacaaggtcttgctcagtcgcccaggctggagtgcagtggcacgatcctggctcactgcagcctctgcctcctgggttgaagtgattctcctgcctcagcctcccaagtagctgggattacaggcatgcgccaccatgtccggctaattttttatttttagtagagacagggttttgccatgttggccaggctggtcccaaactcgtgacctcaagtgattcacccgctgtggcctcccgaagtgctgggattttaggcgtgagccactgcgcctggcttattatgaaacttttaaagtgattatcttttcagtgaatctggtattttggggtttagtcatttatagggtactgacacaactttttttttctccaaaatttattctaataccattattgggcagattgtcctttcaccactgatttgaaatggtaactctgttatgtactaaatttcccacaatgtgcgtaggtactttctattgtttcattgattttaggggagagatctatttttgcacataccactattggtttaattattgtaatattatagttaactttgatatatgttatggaatggcttgattcattatttaattttttttttttgttttttttttttttgagatggagccttgcactgtcacccaggctggagcgcagtggcgtgatcttggctcactgcaacctccgcctcccaggttcaagcgattctccagtctcagtctctcaagtagctgggattacaggcaaggcgctaccatgcctggctaatttttgtatttttagtgaaaatggggtttcaccatgttggccaggctggtctggaactccttacctcaggtgatccatctgcctcggcctcccggagtgttgagattacaggcttgagccaccgtgcccggcctattcctatatattttataatcatgtgcttttgtgaatggggtcttcttgtagacctattacatactgttttctttttgtatgtttaaattaaactttccaccttactaataatttaactgtcttagaatttttaagctagataatgtcatctgcaagtagcaattttgcctcttcttttctatatcttatttatttatttattatttattttatgttttttgagacagagtctcactctgtcgcccaggctggagtgtagtggcgtgatctcggctcactgcaacctccgcgtcccaagttcaagtgattctcctgcctcagcctcctgagtagctaggattacaggcgtgcaccaccacacctggctaatttttgtagttttagtagagatggggattcgccatgttggccagactggtctcgaacgcctgacctcaggtaatccacccaccttggcctcccaaagtgctaggattacaggtgtgagccactgcgcccagccttatttatttttagccataggctagaattttctagacagtattgaattatagtaataatctcttatcttagtgaaatataatagaaaaatttctgtcaattaaagaaaaaagcttttaaagaattaaagttagtgttattcagaaatgttactgaggccgagtgtggtggctcacgcctgtaattgtgccactgcacttcaacctgggtgacagagcgagactctgtctcaaaaaaaactcaactgaaaaaagtggaacaaaagaaaaagaaccatgataagtattttgcactttttttttttttgaggcacatttctactctgtcacccaggctgagtacagtggtgtaatcacagctcactgcagccttaactgcccaggctcacgcagtcctcctacctcagcctcccaagtagttgggactgtaggcacacaccactatgtctggctaatttttaatttttttgtagagacaaggtctccctgtgttgcccaggcaggcctcgaactcctgtaccgaagcgatcctcccacattggcctttcaaagtgctgggattatggcatgagccaccttgcctggctgcactcatttattttcatttatttttcattttttgagtcagtgtcttcctccatcacccaggctagagtgcaatgacatagtcacagctcactgcagcctcaacttcctgggctcaagctgcacttatttagtcttcatgataatactcagaggcagatatgattatctccatttttcagataacattgagacttactaacccacaatacaaagctgggtgtgtttttttttttagagacagagtcttgctctgtcgcccaagctgaagtccaatggctcgatcatggctcactgcagccttgaactcctgggctcaaatgattctcgtgagtagctgggactacgctatgcttggctaattacaaaaaaattttttttagagacagggtcttgttctgtcactgaggctggccttgaactcctgaggtgatcctcccgcctcagcatcctgagtaggtgggattacaggcacgagccaccttgcccagccaaaactggaccttgaacttcaaagagatttctcttttccccttactacattgacagggctttataacattgcttttttactttattgttacattcatatttcacaattgttatttttgaattcactatcttcttcattattaaaaggtggaaattgctttatgaccttttttataattaataatttggggggtgatactttgagattatatgaatactctagtcccccaaaacattttgcccaatggtcttaccattcatggataatcctgcctaaaccaattattataatggttattgcaaataaaagtattttttcgaatagcctaatttagaagaaaagcttacactgaggtagcagaaggactgaatgtgattcttttgggggtttatttttaaaagcaattagtcctaaggaaaaactttataatagattctatattttagaatataggcacattgaaagcagtttgtcttctgaagctcaatagcaaaataaaaaatgcttaaaaaaattcagctaaaaccatatctaaatttgccattttgggaatctttgtgataaagcagattatattctgttgaggatcagtggtaaaataatttatgctagtgctgaagttaaactggaaaaaacatcatacgtgcataatttgttttatacctttagaatgtaatatctttattttgcagttcatttttagctttggtactgtaacaaggatctggtgattgtggaatgttatgaacatagtggtttcgcaattactgagagctaagtgtttatataaaactcccttgaatgttttagttcctggaacttaaggagtggtagttgataaagcataactccttcattgagtctctgatgggtatctatacttaaacttttttttttttaaacagaatctcactttatcatccaggctggagtgcagtgacgcaatcacggctcactgcagcctccgcctcctgggttcaagcggttatcctgcctcagcctcccaggtagctgggattataggcacccaccaccatgcctggctaatttttgtatttttagtagagacggagtttcactgtgtttgccgggctgatttcgaactcctgacctctagtgatccgcccacctcagcctcccaaagtactgggattacaggtgtgagccaccacacccagcctatacttacactttttttttttttttttttgagatggagtttcgctcttgttgcccaggctggagtgcaatggtgtgattggttcactgcaatctccgcctcccgggttcaagcgattcttctgccccagcctcctgagtagctgggattacaggcatgtgccaccacacccagcaaattttttatttttagtagagtcagggtttctccatattggtcaggctggtctcgaactcccaacctcaggtgatccatctgcctcaggctcccaaagtgctggggttacaggtgtgagccaccacgcccagccttatacttatactttttaagtattacacagatgtcttaaaagtatttgtatgttctgataagtgttttttagcttttgaaaagtaaaatttatgaaaaagccttgttgtttacaaatatgtttacctttctgttaattttaaatgtggactttgataaggaagttatatttcgatgatatccagtgtaactaattttttccctcttattcaagaaagataattttacacttattctttgacagagaaatttcatagaattttcttcttctaatttaattccagaatacattctctcaaccctatgccctcatactagtaaccttgagggttctttgaaagaaaaattgctttaaatcaagcaattctcttttgtcattaaaataagctattttctatttttatttttaaaaactatttaaaacaatataattatgcaagtgtgtatatatgtatttgatttttttgttttcttttgtttttatttatttttttgacacagtctcctctgttgcccaggctggagtgcagtgatgtgatctcagctcactgtaacctacacctcccatgttccccccctgagaaggatcctcccacctcagcctctggctaattttttttttgtatttttagtagagacggggtttcaccatgttgcccaggctggtcttgagctcctgggctaaagtgatctgcccagctcagcctcccaaagtgcatgagccaccgtgcccagcttgatattttaatttttacttgaatgaaatcatttactgaaagcaatacatgttgatgcacacacaaaattactgaagttcatcaaattgtcaagcattcagtaatatatacagcattattatttttaatcattttcaaactgaaaactccttttctttttcagggatatcatgataacacattttgaaccttccatctcctttgagggcctttgcaatgaggttcgagacatgtgttcttttgacaacgaacagctcttcaccatgaaatggatagatgaggaaggtgagtggtaaagacagggctgcctgtgtaagcattttaagatcttattctatcatttgttgtaaaaatataatgagtcctaaaaagtttaagaggaaagactattagaaatttgatgccattcttgttttttctttaagtatttaaaagaatactgaagagcacaatcttttttttgccccttttacgccaaaatgatgtgaaattaacttgactttttttttttttttttgagacggagtctcgctctatcgcccaggctagagtgcagtggcctaatcttggctcaccaaaacctccacctcccgggttcaagcgattctcctgcctcagcctcccaagtagctgggactacaagtgtgcaccaccatgcccggctaatttttgtatttttagtagagacgggggtttcgctatgttggccaagctggtctcaaactcctgaccttatgatctgcccacctcggcctcccaaagtgctggcattgcaggcgtgagccactgtgcccagcctaacttgacttttttaagcataaggtaagcatctcatcaaatagtgtgatgttttactttaattttgttttttctttgaattaaattttttttttttattttttaaagacagggtcttgctaagttgtccaggctggtctccaactcctggcctcaagtgatcttcccatcatgacctcccaaagtactgggattgcaagcaggagccactgcattcagcttcactttattttttaatttaaattttttttttttgagacagagtctggctctgtcgcccaggctggagtgtagtggcatgatatcagctcactgtaacctccgcctccaaggttcaagcaattcttgtgcctcagcctcccaagtagctgggatacaggggtgcaccaccacacccagataatttttgtatttgtagtagagacggggttttgccgtgttgcccaggctggtcttgaactcctggcctcaagtgatctgcccacctaggcctcccaaagtgctgggattacaggtatgggccaccacacctggcccccagcttcactttaattttgaatatgtgttgtcttatattttaatttaagagattacctatttttaagctgaatattaccttaaagaaaatattgtggaatgaaagtgattttgacaatcattatttcaaagtagtggcagaaacctgatacctcagtgacttgtactcagaaaacatttatcatatatgtaggcttacgcctgtaatcccagcactttagagtctgaggtgggaggattgcttgaggccaggagtttgagaacagcctgggcaacattgtgagaccctgtctctacaaaaagtttttaaaacttatctggtggtagcgtgcacctgtggtcccagctacttgggaggctgaggtgggaagattgctcgagcctggaaggtcaaggctgaagatgggccctgattgtgccactgcactccagcaacaaagcaagcaaagcaagaccctgtctcaaaaaaaaaaaaaaaagaaagaaaaagggaaaaagaagcaaatatctgtgtgctgaggacagacatttcctatcctcaaacccatagtctgatagggagatggacacatgtgtaacaaatgtgataaattctggaacataaacgcataggggccttgaggaatacaaaggaagacacatctataatacatctgcaatgtttgacataaacctgtaacagagtagaagtttttgaggtagaggaggtgaggagaaaaccatataggctgaagaagaatatgtagaaaggcacagaaatgtgaagaacatgatgagtgaaaagcagtaattcactgtatctgaagtatgaagtggtgaagtatgaattggcctacagtttaacaggctccacgggtgagttgtatgaatacagaaatttgtttgagaagcatgagactagatccccaagagctttgcagatcacattaaattttattttacatgactattatggaagtctagttaaaaggtaccctaaagaaagggtgggttgggggtgagggataaaggcctacatattgggtacagtgtacactgctcaggtgataggtgcagcaaaatctcagaagtcaccactaaaagaacttactcatgtaaccaaacaccacctgctccttgaaaacctgtggaaataaaaaaagagagaagataccctaaatatactactttttttacaatagttttctgttaattgttatacaaatagaatttcattttaaggaatgtcataatatttagctcaatatttgggatcatttctatcttccctgatataaagaactctggaaagtcattattgaagctccaagctataggtaaacataaacacattctcattttttaaaacagtgttcctgaagtaattcatgttcactgttcaggaaaaaaagtagtgcaaaaatttatgaaatgtaaaaagaagcctcctgtttttccttttttctctctcctccctcaccaattccaattgtaagagaatagcttagtatgtatccttctatatattttctatgcatttgcaaacgtgtatgtatgtttctataaattctttattaacagttttattaacatgacaaatgacatacagctgatattttgcagacctggtgggcatggggagcttggagcccagtgccacccaccctggccctccatggccttaaaaaaaaattatatggggccgggcatggtttctcatgcctataatcccagcattttgggaggccgaggcgggtggatggcctgaggtcaggagttcgagaccagcctgaccagcatagtgaaaccccatctctactgaaaatagaaaaattacctgagcgtggtggcgggtgcctgtaatcccagctactagagagggtgaggcaggagaatcacttgaacctgggagacggaggttacagtgagctgagattgtgtcgttgtactcctgcctgggcaacagagcgagactccatttcaaaaaaaaaaaaattatatacaaatcgttatgcagtgttttcctttatagtatgcgctggacattttttcatttcagtgtacttcaatttgcatcattactctttttttttttttagtactgcatagtattacatattatagatgtttcatgattaatcccttatcgatggacatttggactatttctagtttttcactaccataaacaatatataatgaacatttcttttctttttttttttttttttgagacagtctcactctgttgcccaggctggagtgcagtgtctcgatctccgcccactgcaacctcctcctccttggttcaagcaattcttgtgccccagcctcctgagtagctgggattacaagcgtgcaacaccatgcctgcctaatttttgtatttttagtagagacggggtttcaccatgttggccaggctggtcttgaactctggcctcaagtgatccacccgccttggcctcccaaagtgctgggattacaggcatgagccaccactcccagccttatttatttatttctcttttaatacagaggctgggttctcactatgttgcccaggctagtcttgaactctggccttaagtgatcctcctgacctagcctcccaaagtgctgggattacaggtgtgagccactatgtcaaaacatatgtatatcaaaacatcatgttatataccataaatataatttttgtccattaaaaaattaaactagtttttcacacaactacatgaaatgagaggattttttcattcttgcccttaccaaccttagatatgaatcataaacatttttaaagatcagtaagtgaaatgctaacctggtatttcaaattttgcattaagaggaaagttgagtatctttatctttttgacctaccctatcacaaagatagtttaaatatggttacttataaatgtcatgactatctcacaatatgtcttcagccagaaaatgagactatatataatttagcacagtgtgcaacttatgcttagcattcaataaaatgcttcttatcataaatgaatattcttattttaatcctgatcatttcataccatttatttgctgattagagttgtttttcagtcaatgattttcaaattgcagcacacataggcatcactggataatgctttttattagacgtacttagtttagcgatagtccattaaacgtttttataatacctttgtattatccttgcctggagagttctgttcccagattgtcacctggctgtctctcatcattcaggttttaactcaaatgtcatgtcctccaagaagccttcctatctccattcattttgtatcttcttgccctgttttttctcttgtatggtagagtgtttttttttttttgtatggtagagtgtaagctccatgagagcagaggtcttgtctgttttgttcatgttggagctgcagtgcctagagcaatactaaataatactatgctcaaaaaatatttgtggctgagtgcggtggctcatgcttgtaatcccagcattttgggaggccaaggcagaaggatcccttgagcccagaagtttgagaccagtctgggcaacatagtgagatagtgagaccctgtccctacaaaaaaaattttttttttagttagctgggcatggtggtacacacctatagtctcagctactcaaaaagctaaggtggaaggattgcttgagcatgggagatggaggctgcagtgagccatgattgtgccactgcactccaacctaggcaacaaagcaataccctgtttccaaaaaaaagatatatgtgtatatatatatttgtgagttgtacaagaggctagcaacaagcctttccctggtttaattttgcttcagttattggagacttaagcattgacagttactgtttattctgttttttttttcttaaagtagcatattttaattaacagatgcacatagtaaattaactttctgatgcaacagtcttattataatgcatttcatacttctttctccctaagtagctattaagtttccaagttttctggggaaagctatgaagctctaggctttgtcttgttcaagtaaaaggttaaatttttcattaaggtctgttgattcccatgcgatccttctcaccttgcttaattctgataccaatcttttcttaattttaggcatacagagccaacagtaattatttttaagttactttcaattagttttcagttgtaattttgtcacctttgtttttaatcatgtaggcattggggcatgtcggtctgatctggagaaaaaaaattctctaggatcaaagacaggacagtcacttgatttctctggcatatgagaagtgctgttcctcaagccaaacatttaattgttggaattttatgttggagcaagtaaagatcttaagcttacttcatctgtttaaagagatttaagacaactgccctttttccttgtactcaaaaccagtcttagtgatttgttttactgtggaaaaactggtttgcttaatctaactaaacattttagaatgagtagtaattttgtaaccatcatgccacactcctctttctcataaattcttgtgtaacaaaagtgtgggacagggaatgacaaatgtgactttatttttttaacaaatgtaagttttcagttcttttttttaaatttttaattaacagataataattgtatatgttcgtgggatacagtgtgatgtttcaatacatgtatatgttgtggaatgaaaaaatcagggtaattaacacatctattacctcaaatacttatttctttgtggtgaggacatttaaaatccactctttttgttattttgaaatacacaatacattattatgaattgtagtcaccatgctatgcaatagatcaccagaacttactactcctgtctaaccacaaccttgtaccctttaactggcacctcctttctctatctaacccactccctccagcctctggtactctctacgtgtatgagttcaacttttttagattccatatatcatgtggtgtttgcctttgtatgcctggcttatgcttatttcacttagcataatgtcctctaggttcatccatgttgttgaatatgacataattttctgcttgaggctgagtagtattccattgtgtgtatatgccatatttatttcatctgtttatccattgatgggcatttcaattgtttccatatcttagctattgtgaatgatgcagatgctacagcgtagttcacctttgttttgagagagggagagagagagacagagacagagagagagagagaaaaggcctcactctgttactcaggctggagtgtactgatgcaattatagctcactgcagcctcaaacctatgggcttttgagatcctcccatcgcagcctcttagctacaggtgtgtaccaccatgcctagctactttaaaaaaaattcttttggctgggtgcagtggctcacacctgtaatctcagcacttggggaggctgaggcaggaggatcacctgaggtcgggccaacatggagaaaccctgtctctactaaaagtacaaaattagctgggcgtggtagtgcatgcctgtaatcccagctacttgggaggctaaggtaggagaattgcttgaacccgagagatggaggttgcggtgagccgagatcgtgccattgcactctagcctgggcaacaatagcaaaactccgtctcaaaaaaattttttttgtagagacagggtcttgttacattgttgcccaggctggtcttgaactcctggccttagccaggagttgaattcaaccaactctttggctgaatgtgtagccaatgctacttcacctatttagatagctgtattatggctccaaagctgaaaactgaaaaattaatattaacagccaggcatagggctcatgcctgtaattccagcactttgggaggctgaggcaagaggattgcttagcccaggaggttgaggctgcagtgagccaagattgcaccactgcactctagcctggaccacagagtgagaccccatctcaaaagaaaaaagaaaaagaaaagacaagaaaagaaaaaattaacagcacttagaaaaggaaagctaagtacctccaagcatatctagttttgtaacttatatagttttcctttataatgttaaaacattataatgttataatgtaaagaacttatacattatgaattattatacattattacattatttataatgtaatgtaaagaacttcctttaacatttcttttgtttttgttttgttttgttttgagatggatccttgctctgtcgcccaggctggggtgcagtggtgtgatctcggctcactgcaacctcgacctcctgggttcaagcgattgtcctgcctcaacctcccgagtagctgggattacagacacctgccaccatgcccggctaatttttgtatttttagtagagatggggttttgcagtgttggccaggctggtctcgaactccagacgtcaggtgatccgcctgcctcagcctcccaaagtgctgggattacaggagtgagccactgcgcccggcctcttgaacatttcttatagagaagttctgctggtgagaaattattcatgtttttaatttcacttaaaaatagatttattgaggtataattgacatatatatgtatacataatatatataataagttatacatattaaaactttacagttggatgagttttgatacctaggaacccatcagcacaagcaaggtagagaacgtatctgttatccccaaatgtttccttgtgctaagcagtgcctcactcctgctcttttgtcctcaggctactactaatctgctttctgttactacagattagtttgcattttttagaattttatatggatagaatcatcatatagcatgtactttttggtgggatgtgtgtatcagtagttcattccttcttattgctgagtagtattctatcctgtggatgtactacaattcattaatctgttgaagatcattgggattgtttttggttttggctgttttaaataaaggtgctatgaacagtcatgtacaagtccttccttgtatggaaatatatttccatttttcttgagtcaaacctagaaatagaatagctggatcatgtggtaggtatatatgctgcttttataaaatggaaaaagaagattttgaaaaggagatgagatggggcacttcatcccaggcacatccttgggcagatggtttttagtaaggaattcacaaggaagttgaggatcaggaaattgattccttttaaaaactgtctatgcctgttagtccctgaaaagttttcctgcactccaggggtactgtattccaattagaagatagctgacttagagatgtccccagctacttctcttagttctggcctctgccccagctctgttcttcagacggaccttatgcccaggaaattctggctgccatcttttacacaccaggctgtctggaggcctgggagaaaaaggaattagactggggttcacctgggagaaacccttggcagtggtggagtggggatggattcagaagtgaggtatgatactataatataatgaaaaaatgtatctgctattcatcgctggttcctgacagtgcctaaaacccttgttcaagtaaaaggttaaatttttcattaaggtctgttgattcccatgagatcctgagtaatagaagtgagaagagcatcttttgttatttatgataagcccctgccaaccaaacctgattttatgctaatgaggtggctcttggaggatggcttctggttgccagaggaatcaaccatgtggttatctctaaggtgggacttttcagcctacctcccccttatttctgaggagggcagaggggcctggagatggagttaatcaccagcagccagtggtttaatcagtcttgcttaggtaatgggacccccttaagaactcaaaatgtaggggttcagagagcttcctgctcggtgaacaaatcaaggtcctgggagggtggtacatctggacccggcttggaagctctgtgtccccccgtaccttgtcccattacctcttcatctggctgttcatttgtatcctttataatatcctttataataaagtgtttttgtagcaaattgtttaacatgaggagggggttgtgggtgtaggggccagggaaaagcttccccattgatctccaaaggtttgctgaaaaatcaactcacaagaggcagattaattggagaaaagtcatacagattttattacatgtacacgggggaaccacagagattactcaccccccaatggggttcggaagcatgtataatatcctggcaaaacaggttatatggctggtccaggtgcagtggtgtttacagctaattgatcacagccagttacagatttctttgttccttccactcccactgcttcacttgactagcctaaaaaattaattaattaaataaaacaggttataggagaagggagaagaggaattctgttgtgaggattactaggaagaatgaatggatcagggaagggagattaacttgtacattatcttgtggaaggatctgttcaggtgtgattacattcttggtcttactgggaggggaatgcaaaacagttgttctcggtgggtctggattttaggcgataaaggaacttcagagaacgtcattctgactttgggagaagtcagttgtaggggtgggtggttgggggaagtcagagagaccctgaggtattggttactgagtcccaacatgggaatgcccagtttgtagccaagtcagactaatttgactgatttgtggctaatttgaggatccactacttgcaattagcatctgaagttgggggtagtctgtgggactgagccctaaacctacgggggtctgtgctaactccaggtggtgtcagaatttaattaaattgtaggacgctcgattggtctccacagagaatagatttgcttctggaaaactcacacatctggtgtcggaagcattgtgagtggagaaacagttttttatttatgaggcaagagaggctatgggggtcttgaggcggtattggggaccttagatgctatcatctgctccagtatctgggaaggtctgtcctcctcattggcatcccgtctccagttgccctgtcttcttcctctccctcatagaccactgttcacacgggatacacttatgatccccacactgttttctccttactctcacttctccatccctaggcaatcactgatctgctttctgtcactattccatacatataaatgacaaaatatagtgggtttttttgtttttgaaagacaggatctcactgtgttgctcaggttggcctccaactcctgggctcaagcagtcctcctagctgaaactacagatgcacaccatgactcctggctcaagcacagtgtttttgtactttttaataaatgacattatatatcccatattctgaaatgtctcttttttccctggatgttatgtctttgtttttttttttttttttttttctgacacaaatcctttctttgtcacccaggctggaatgcagtggtgtgatcatggctcactgcagcctacctctcaggctaaagcagtccccctgcctcagcctcccgagtagctggaactacaggagtgctccaccacgcccagctaattttttttcttttttttctttttgagacagagtctcgctcttgtcacccaggctgtagtgctcgctcttgccgcccaggctggagtgcagtggcatgatcttagcccactgcaacctccgcctcccgtgttcaagtgattctcttgcctcagcctcctgagtagctgggattacaggcgcctgccaccatgcccagctaatttttgtacttttagtggaaacagggttttgccatgttggccaggctggtcttgaactcctgacctcaagtgatccgcccgcctcggcctcctaaagtgctgggattagagggctgagccactgggcccagcctaaattttttattttattttttgtagagacagagtcttgctatgttgcccaggctggtctcaaaactcctaagcccaagtgatcctcccgctttgctctcccaaagtgttaggattacaggcatgagccaccatgcccagcagatgtcttgagatctgttaatgtagttagagaactagtgtaccctttaaaaatttttttattgtaattaaatataaataagaaaatttaccagttcgaccactcttaagtgtacagttcagtggtataagcacattcacagtgttgtacaactattaacagtatccttctgtttccagaacttttcaccatcccaatcagaaactgtacccattaaacaataactccctatccctccttttgcagtccctagtaacctgtattaaactttctgtctatgaatttacctatgcttggtcacctttgtttttgtgtttttgaaagatgattgtgattggtaaataactccaggttggaagtttttgtttttttttctcgttcagtaccctgtcttatagcttgcattgtttctgatgcaaaatctgctatcaacttcctttctgtatgtgaagcatctctttggctgcttttaagacttttttgttttgttttgttttggagacagagtctttgcctggagtgcagtggtacagtcatggctcactgcagccttgacctcccaggctcaagcagtcctcccacctcagcctcccaagtaggtgtgcgccaccatgcccagctacttttttagttttttttttaaatagagatgggatcttgctatgttgcccaggctggtcttgaactcttggactcaagcaatcctcccaccttggcctcccaaagtgctgggattacaggcgtgagccactgcagctagccttaaaccactgtttaatccagtgttttaaaattgttttagagggagggttatgtctattcctattacttcatctctcctgatgtgaatgttgaggctggatgcggtggctcacacctgtaatcccagcactttgggaggcagaggcgggcggatcacctgaggtcgggagttcgagaccagcctgaccaacatggagaaatgccgtctctactaaaaatacaaaattagctgggtgtggtggtgcatgcctgcaatcccaactatttgggaggctgaggcagaagaatcacttgaacctgggaggtggaggttgcagtgagccaagatcgtgccattgcactccagcctgggcaacaagagcaaaactctgtctcaaaaaaaaaaaaaaaaaaaaaaaaaaaaaagttgaggatgagcggcttcatgggatggcatgtatttctgtaaccactgacttccacctcccagaaaaaggaagcaacaagccaaaaattcactactgttgttattgggcctgatagtgaaaggatgaccacctaaaaattatggcatccttggaaaatttttgcaaatctgtattttaagcagtgtaaccctttacagtaagggagtacagtgacttttgcaagtggtttagtgttctgactgcatatccagaggcaggatggcagtacgaaggtcctagtgggaacagagagtgagagtctgtgagtctgtggctaactcagacatcagggagaagaatgtgtgatactgtctcagaggttgccaactttggtattaggctgtgttctttgaaatgtggggcactgaatttaggcatatactgaaataactaaataaaacaagagttacatatatgtttcatgttctacatcctgtcaggttatctcatataaataattggattgtgaatatttacctaactttttgaggtctaatgccctaatttgctgctttctttttgtaggtaaagaacaacagcagcaacaaaaacaaaaacagtagatatattgggggggggaaaaaacctgctggttaatatacagatttcattaccttgaagttcactgcactgaacaattctcactctggatgtattcctgctctaggatgtgaatttagacttttgtaatagagtgggctttgagaaatagcttttctgctcattttagtttcatgatgactgcatggaatgttttgcttcacgcttatgcattgagttttatcaagcattaagcagttggccgaaacaggtaatacttgaacattcagtccaagaaaaacaaaatggatttgaacatacgtagaatcagtaactcttattttcatacttccttatggttattcagaagtgttggtctctaggtacattttgaaagcaagtacttgatctggcttaggttttaactaacagcaagcagatactggcctgataaaaagatgatgtacagcaaaagtgagatggtcagaattggcttttttctttttcttttcttttttttttttgagagggagtcttgctttgtcacccaggctgtagtgcagtggcatgatctcagttcactgcaagctccacctcccaggttcatgccattctcctgcctcagcctcctttgtagctgggactacaggtgcccgccgccacgcttggctaatttttttgtattttcagtagagacggggtttcaccatgttatccaggatggtctcgatctcctgacctcgtgatctgcccacctcggtctcccaaagcgctgggattacaggcatgagctaccgcgcccggccagaattggcttttttcattatagactactacagtaaaatcatcctaactgcagaagtcacttgaaatgtggaaatcacagtttgctatgtatttgatttggttcaatctttttttttgctttctgggacatcaaaatcagccagcgagtctagggaaatttggacttaaggttttaatgtttagattttgaaaagccaggatgcttataaaacactcattggtatcatttacgacagagagagagagagaaaggagagagagagagagtgcgtgtgtgcgtttatgtgtgtatgtatatcttgtttaaaaaacagtctggactcagttttctcacctggaacattagaaatgaagtgttagctgggcgtggtggctcacgcctgtaatcccagcacttttggagaccaaggtgagacgattgcttgagcctaggagtttaagaccagcctggtcaacatagggagacgctgtttctacaaaaaaagaaaggaaaaaaagccaggcatggtggcatgagcctgtgggattcagctcccaccttggaaggctgaagtaggaggatggcttgagcctgggaggtcaaggctgcagtgaaccaagatcatgccactgcattccagcttagacaacagagtgagactctgtctcagaaaaaaaaaaaaaaatgataccaactttcatatttgtggcaaaatgagataaatttacgtaactgaaaaagggagtctttttttaatgaattactttatttctttgaggaaaaataaaacagatttgtaaactttgctcctggactagaatgctactttgcaggcaaacttacttttgtaaaaatgctagactctggccagacatggtggctcacacccataatcccagcactttgggaggcctaggccggtggatcacctgaggtcagcagtttgagaccagcctggcctctgtcgctattaaaaaaatacaaaaacaaaaaaattagctggacgtggtggcacacacctgtaatcccagctactagggaggttgaggcaggagaatcacttgaacctgggagctggaggttgcagtgagccgaggtgtcaccaccacactccagcctgggtgacagagtgagacttggtctgaaaaaaaaaaaaagctagactccacattctttaaaaaaaaaaaacaactttgctaagatataattcaccaatgtaaagtgtacaattcattggtttttagtataatcacagagttgtgcagctgttatcaccatcaattatagaacattttcattaccaaccccccccccccaaaaaaaaatctcgtgtctattagcagttgctacttgtttcccccctacccctttctctgcaggccccagacctagacaaccactaatccacgatatgtttctacagatagactgattctagacatttcctatacagtgtcattactaattccttttatgggtggataatattccattgtatggatatacatattttatttatccatttatcaattgatggacaattggctattgtgagtaatgttgctacgaacatttggttacaactttttgtgtgaatatgttttcatttcatatggtaactgtttaaccttgtgaggaactgccagttttccagagtggctacaccatttaccttcctaccagcagtgtatgagaattccaatttctctatatacacttagacttgttatttatcagtgtactgagttttgatcaaaaatagtgtacctgtgtagtgtggttaaatcatgttgacctcactctctttcatctagcctcttaaaatatcaatactaagacttataaaatgagcatatgaaaaccagtaactttccttcctacagattgaaaatactcaatcagaaagtatattcaaagaaaatatttaatccacagtagcgacataaaaataggttttaaaaaaaatctagtaataaaccttagagaaatttgaagaaactatataaagaaacaagaaactcaattgagtgtcataaaacgaaacttgaatgaatggtttgggaaaaagcaacattatacaaagtgaattccctgcatatcaatctgtgaagaaaacatttctcccaaatttccaacaggattttaaatctgacaaaaatttcatcaggaaaaataaatgctcaacaataaacaggaaaattttgaaaaagaaagtttggaaagagaagacttttcctaatgttgtatacaggaatagtaacaactgagagaaaatatttgcaacatttacaacaaaggattactatctctattgtacaataaatgccaagaagaaatagatgaaaaatctacataatgaggtataaatagtcaattcataaataacaggctcaaaaatcactaataattaaagaagttttgaaatattaaagtgagacattacttttcacctattggactggaaaatacagaatttagtaattatctctaagaaattagggccaggtgtggtggctcacacctgtaatcccagcactttgggagaccaaaacaggtggatcacttgaggtcaggagttcaagaccagccaggccaacatggtgaaaccctgtctctactaaaaatacaaaaactagctgggcatggtggtgggcgcctgtagtcctagctactcaggaggctgaggcagaagaattgcttgaacccaggaagtggaggttgcagtgagccgagatcacgccactgcactccagcctgggcaacaacaagactgtctcaaaaaaaaaaaagaaattaggaaagattggccgggtgcggtggctcacgcctgtaatcccagcactttgggaggccgaggtgggtggatcctgaggtcaggagatcgataccatcctggctaacacagagaaaccctgtctctactaaaaatacaaaaattagccaggcgtggcggcgtgtgcctgtagtcccagctgctggggaggctgaggcaggaaaatggcatgaacttgggaggcggagcttgcagtgagccgagattgcgccactgccctccagcctgggtgacagagcgagactccgtctcaaaaaaaaaaaaaagaaattaggaaagataccctgttggttgaatgaatgtatgtgtcataactcttttggaggacagttggaaatacttggccaaattttaaatgggcagacttttttttgttaattttttactttaattttaatggatacatagtaggtgtatgtgtttatggggtacatgagctattttgatgcaggcatacagtgcataatcatgttgcgtaaatgggatattcatcacctcaagcatttatcatttatttgtgttacaaatattccaattatactcttttagttatttttaaatatacaataaattttgttgactgtaattaccctgttgtgctatcaagtactagatcttttttttcttttttactttttctaacctttttttttttctgagacagtgtctcactcttgctcaggctggagtatagtagcatgatcacagctcactgcagccttgacctcccatgctcaagcagtcctcctgcctcagcctactgagactacaggcttgagccaccattcctggctgttttttaaaattttttgtagagatggaggtctcactgtgttgcccggggtggtcttgaaccaaatactagatcttactcattctgtgtgagtatagttttgtacccactctccaccactatcgttcccagcttctggtagctatcattctactctctatctccatgagttcaactgttttaatttttagcttccacaaatgagtgagaacataaggtttgtctttctgtatctggcttatttcacttgacacaatgtcttccagtttcatccatgttgttgcaagtgacaggatctcattcttttttgtggctgaatagtactcccattgtattgctagacacttaagttgcttccaaatcatggctattgtgaatagtgctgcaataaatatgggagtgtacatatctcttcaatatactgatttcctttcttttgggtgtatatctagtggtgggatttctggatcatatggtaggtgtgtgtttagttttctgagaaatctctatactgttctccatagtgactgtactaaagtacattcccaccaacagcatgtgagggttcccttttctgcatatcctttccagcatttgttattgcctctcttttggataaaaaccattttaactggaatgagatgatatcttgatgtagttttgatttgcagttccctgatgatcaatgatgttgaacaccctttcatatacctgtttgccgtttgtatgtctccttttaaaaatgtctgttcaggagccgggcacagtggctcacgcctgtaatcccagcactttgggaggttgaggtgggcagatcttgaggtcaggaaatcgagaccatcctggctaacatggtgaaaccccgtctctactaaaaatccaaaaaattagccgggcgtggtggcaggtgcctatagtcccagctactcaggaggctgaggcaagagaatggcatgaacctgggaggcagagcttgcagtgagccgagatcgtgccactgcactccagcctgggcgacagagcaagactccatctaaaataaaaaaaaatgtctattcagggctagggatggtgtctcacgcttgtaatcccaccactttgggaggccgaggcgggcggatcacttgaggtcaggagttccagaccagccaggccaacatggtgaaaccctgtctctactaaaactacaaaaattagctgggcatggtggcacgtgcctgcaatcccagctacttgggaggccgaggcagtagaactacttgaacccaggaggcagaggttgcagtgagccaagattacgccactgcactccagcctgggtgacagagcaagatccgtttccaaaaaaaaaaaaggaaaaatgtctattcatatcttttgcccattatttaatcagattattaggttttttttttcctattgagttgtttgaactccttgtctattctggttattaatcctttgtcagatgcatagtgtgcaaatattttctcccattctgtgggttgtctcttcatttttttgattgctttgttttgcagaaacctaagttgatgtgatcccacttacctatttttgctttgattacctgtgattgcggggtgctactcaagaattacttgcctggaccagtgtcatggagagtttccacagttttttcttttagtagttgcatagtttgaggttttggatttaagtctttaattcattttgatttgatttttgtatatggcgagaaataggggtctagtttcattcattcttctgcatgtggatatcttgttttcccagcactatttattgacagtcttatttattgaaggctgtcttttccccagtgttatgttcttggcacctttgtaaaaaatgagttcactctagatgtatggatttatttctgggttctctcttctgttccatcggtttatgtgtctgtttttatgccagcaccatcctgctttggttactacagtttgtagtataatttaaaggcatagaatgtgatccctccagttttgttctttttgttcaggctagctttggccattctgggtcttttgtggttccatataaatttacaatgatttttttctatttctgtgaagaatgttattggtattttgatagggattacactgaatctgtagattgctttcagtagtatggacattttaacagtattgattcttccaatccatgaacatggaatatctttccttttttttttttaatgtgtatgtcttcttcagtttcttgtatcagtattttatgattttcattgtaaagaaagagatctttcacttttttttttttttttttttttgagacagagtttcacttttgttgcccaggctggagtgcaatggcacgatctcagctcactgcaacctccacctcccgggttcaagtggttctcctgcctcagtctcccgagtagctgggattacagggatgcaccaccatgcctggctaattttgtatttttagtggagacgaggtttctccatgttagtcaggctggtctcgaactcctgacctcaggtgatcctcccacctcggcctcccaaagtgcagggattacaggtgtgagccaccgcgcctggctgagatctttcacttcttttgtgatacttattcataggtatttttttatttgcagttactgtaaatggaattacttttttgattactttttcagattatttgctgtggcatatagaaatgctactgatttttgtgtggtgatttcatatccttcgactttactgaattagtttatctgttctaatagtttttttgtggagtctttaggtttttccaaatatataagatgatatcatctgcaaacaaggataatttgacttcttcttttctaatttggatgccctttatttctttctcttgtctcattgctctagcttggacttccattactatgttgaataatagtggtgaaagtgggcatccttgtcttgttccaaatcttagagaaagactttcaattttctcccattcagtatgatactaggtgtgggtctgtcttatatggcttttatcgtgttgaggtatgttccttctatccccagttttttttggatttttgtcatgaagggatgttgaattttaccaaatgctttttttagcatcaattgaaatgatagtatgatttttgtcctttattctgttgtatcatgttttattctgttctatcatgtgatatatcacgttgattgatttgcatgtgttgaaccatccttgcatccctggaacaaattccagttggtcatgatgaatgatctttttaatgtgttgttgaattcagtttgctagtgttttgttgaggatttttgcatcaatgttcatcagagatattgacctgtagttttctctctttttgacatatttgtctggttttagtaatactgatgagtattactgggtcttagaatgagtttgaaactattccctcctcctccatattttggaatattttgagtaggattggtattagtttttctttaaatggcactgaagccattggatcctgggcttttctttgctgagagactttttattatggcttcgatctcattacttgttagtactctagtcaggctttggatttcttcatggttcaatcttggtaggttgtatgtgtctaggaatttatccatttcttctaggctttctgatttgttggcatatagttgctcatcgtagcctctaatgatcctttgagtttctgcagtattagttgtattgtctcctttttcatctgtgatttgatttctttgggtcttgtatcttttatttttagtccggttaaaggtttgttgatactatttgtcttttcaaaaaaatcaagtttacattttgttgatcttttgtgtgttttgtttcaatttcattcatttctgccccgatctttattacttcttttcttctactaattttgtgtttggtttgctctcgcttttcttgttctttaagatgcatcattagtttgttcatttagcgcctttctcctttttttgatgtgggcacttattgcttgctataaactcacctcttagtactgctttcactgtatcccattggttttggtagtagttgtgtttctattttcatttttttcaagaaatttttcaatttttttcttaattttgtattgaccccctgcttaataaggggcatattgttaactttcatgtgtttttgtagttcccaaagtccatcttgttactgatttctagttttgttccattgtggtcagagaagatacttgttagtttttgtaggttagtaacaatatttggattatactaaggagtttttatctagagttatagagattttcttagaatgctgccatggtagagaataagtgggtgggtatataggggaaaacaacattttgaaatatgtttcaaattttccagattaaacagttaaaaagaacaggtggtgaacctagagaatagtgttttagaaaccgagacacaggatttcttaatagtgggcaactttgtcagggactgcaagagagatcacctagaataaggactgaaaagatgtcataggtttcagcagctggtttcatgacctttgcaaccgcagttttggtggagtgtttgggctaaaacctggcagcagcattttgagaaatgtgtggaaggtaagaacatggagaaaggatatgatcactatgtgaaaaaaagttgtttcattataaaagattacaaacttatgatttttaaaatattaaagagaagtatgaagtgaaaaaaaaccctgccccttttcctttctcatcttctcacctgtttcctccagttttagtctctagttttactcttgagatttgtggctactgaatgaatggagtgtcaatctgaatgggaaagagaatttttttttttttttttttgagacaaagtctcgctcttgttgcccaggctggagtgcaatggtgtgatctcggttcgctgcaacctccgcctcccaggttcaagcgattcgcctgccttagcctcctgagtagctgggacaacaggcacgtgccaccacgcccagctaatttttgtgttttcgtagagacggggtttcaccatgttggccaggctggtctcaaactcctgacctcaggcgatccacccaccttggcctcccaaagtgccgggattccaggtgtgagccactgcacctggcctgaaagaggtttttgagagggagactcagaaacgcctttgcctgagaagagctaggaaatagaaggaaagaaaaaaatggaacagaggagctcagagaagataaaaggaagtagggatgcagtggtcaagtgggagaaaaaaaaggagaggcactcttttctttgagtagccaggaaaaaatgactttgtttttctttctcaattagcagaccaagctgtatgctggtgattgaggtttggatagggttggtggcatctagtgtgtagtaactatgggaattagcaaatcaatggcagagtgaaggactcactttcactcgctcaggtccaaactaggctttaaatgacttcttttttttttgagacagtcttgctttgttgcccagggtggagttcagtagcacaatcttgactcactacaccctctgcttcctaggttcaagcgattcttctgccttagcctcccgagtagctgggactgcaggcacacaccactgtgcctggctaatttttgtatttttagtggagatgggctttcatcatgttggccaggctggtctcgaactcctgacctcaacccgcctgcctcggcctcgcaaactgttgggattacaggccaccacacctggcctgaatgactttttcactgaggaatgccatagtccaggcagatgtgccacctcattgatcgccagggatgactcagttgtctggctagttgggtaagggaggtgttttttccatcacttctgtgtgtctgttactaaaactgttcatttatatttcacagcagctcaagtgcaactgttcttcagtacttttgtagcttttcatttctgtgactcctttgaggaggctctgtcatgtgaaaggaaaaatttgataaaatgattacatggagacttctaactaatcgtattgtggcaatggaactactttcacttcctcttttaaagaaacaggtaacagaaagcctcctctttagactttcccattagacacatagcagtgacaatttaaactgtggtcagtagccaggcatggtggtgcacttctgtagtcccagctatttggaaggctgaggcaggagaatcgcttgaacccaggaggcggaggttgcagtgggccaagataacaccattgcactccagcctgggcaacaagagccaaactccatctcaaaaaaaaagaaaaaaaatgtggtcaggaatagattctgtttgctgtatttgggatatatacaatgttaagaacaaaatggccaggtgtggtggctcatgcccataattccagcactttgggaggcccaggcgggaggattgcttgagcccaggaggtcgaggctgtagtgagccgtgatcatgtcactgcattcagccttgagtgacagagtgagaccctgtctcaccaaaaaagaaaaccaaagaacaaaattttatatctatatacattggtgtctgtgaacctcatgtggtatttttatgcaaatagaaatggaagttatatgttacctacttcagaaaattgaattgtctaaataaatatctaaatatttgtccttaggccaggcacggtgcttcacgcctataatcccagcactttgggaggccgaggcaggcggatcacctgaggtcaggagttcaagaccagcctggacaacatggtgaaaccctgtctctactaatacaaaaattagctgggtgtggtggcacacacctgtaatcccagctactcgggaagctgaggcaggagaatcgcttgaacctgggaggcagaggttgcagtgagccaggatcatgccactgcactccagcctgggtggcaagagcaaaactctgtctccaaataataataataataagtaaataaatatttgtccttgtcatatatttgtttataaatatgagattattttttctaaaaatttacattatgaaatttgtttagtaatcatcacatttaggggttttaaagtgacctttactttacttttgtgttttttaggagacccgtgtacagtatcatctcagttggagttagaagaagcctttagactttatgagctaaacaaggattctgaactcttgattcatggtaagagagtagtcatttcatactcgtccagactgataatttctttgaaatcactctttattcttcaccattttgaaacataatcttaatgtcattttctcaatctctgtgactcatgcctaagtaattgtcgttatttagtagtttctcacgtgctacagaaggtaaaattaatctgctgcttatagtctggggaattttgtggtctctgtatgtcttgttggatattaaaatgtgatatctcagtgtatcacagcaaatttatgatagaacttaaaaattgagagcctggggaatctaagtcatctacttgaaattttgttatgtatacaaataatgacctccaaaggtaaggtatcttaaatatcctttcttttgcttaaaggttaatagtgaaactatttacatgattcctttatttttgagacagtctcactctgtcacccaggttggagtacagtggtatgatctcggcccactgcaacctctgcctcctgggttcaagcatctcagcctcccaagtagctgggattacaggtgtgcaccaccatggctggctaatttttatatttgtagtagagacagggtttcaccatgttggccaggctggtctcgaactcctggcctcaagagatccgcctgccttggtctcccaaagcactgagattacaggcatgagccactgcaccaggcccatttacatgatgctttagagacattaatatgtttatacctcagcaaccttgagatgtaggaagtggcatagaagaagtaacctaaactcagttatcattgtaactggcacgttgtagacctggattgtgaatctaggaattctgattccaaatttgtgtttcattcaactatgctaaccatcaaaagtcatgtaaaactttttttttgtttgtttttttgaggcagtttctctcgctctgttgcccaggctggagtgcattggtgcagtcatagctcactgcagccttgacttcccaggttcaagcgatcctcccacctcagcctcctgagtaactgagaccacaggcactgccgcaccactatgactggctaattttttttttttttttttgtatagatcggatatcactatgatgcccaggctggtctcaaactcctgtgctcaaagagtcctaccacctgggcctcccaaagtgctgggattagaggtgtgaaccaccatgcccagccaagaacctcttaatatactgcatttaattgcaatatattgacagtatttcgttgaacatttttgagagctatgagaccagacttaggaatcttctaaaaaagtgaaacgaatgtaaatctttccttaagtataatgaatcatttcagtgccttattattatttctttgtattttcctttacagtgttttttttttaaaaaaaaaaaaaaaacagtggtttgattttatattttatttgagacacagtttcactctgttgcccaggctagagggcagtggcacagtctcaactcactgcaaccttggcctcctgtgttcaagtgattctcatgcctcagcctccaaagtacttgggattacaggcgcctaccaccatgcccagctaatttttgtatttttagtagagatggggtttcaccatgttggccaggctggtctcgaactcctgacctcaggtgatctgcctgccttggcctcccaaagttctgggattacaggcgtcagccactacgcctgacctgatttttttctacctccagaatttgacatagtgactcacaagggatccataatgtactttgttgagattctaaaagagctttaagagtctattttttttgtcatctctttccagaataaaattacaatgaatgcataaagaagtgattgatgaatggtattaaacagtcagttttaagtcttattgccttttaatactacatcacagatgttttcagaagctagcttacgtttcagcttttaaaaatatgcattaggaactgtgcttcctatagtctgtgctctttattaaactgtgtcctttagtacatcacagactaagaatagctgactagatattcataaatacattgttgctttatattctaccttgttataaaaatggttttaattagtatatacatttaaagtttctaatgtaaatttacatttttgattttggtactgtttctggtgttaatttattcctaagtttagtatacatcttttaaaaaccaatattttatgttccatatttgtatacatttttgtaatttaattttcatccttcattgtgacaaacttgtcctactataccaaggatttaaggcgatattagttaatgatttctttaaggataagaaaataattcatgatgtaacagggactggaattagtcatttgagcttctgatgcattggtttttttgttttgttttgtttttgtttttgtttctgagatggtgtctcattctgtcacctgggctggagtgcagtggcatgatctcagcttactgcaaccttcgcctcccaggttcaagtgattcccgggcctcagcctcctagggagctgggattacaggcacatcaccatgccaggctaattttttttgtattttttggtagagacagagttttaccatgttggccaggctggcatcccctgacctcaagtcatccacccaccttggcctcccagagtgctgagattagaggcgtaagccaacgtgcccagcctaatgcattgtttatagacatgtttgttttcataagaacttttttctttctttcttttttttttttttttttaacatcaacaaagcaaggcaaataaaaccttcttttgtggccgggcgcggtgactcacgcctgtaatcccagcactttgggaggccgagacaggcggatcatgaggtcaggagatcgagaccatcctggctaacacggtgaaaccccgtctctactaaaaatacaaaaattagccgggcatggtggcgcgtgcctgtagtcccagctacacgggaggctgaggcaggagaatggcgtgaacccgggaggcggagcttgcagtgagtcgagatcgcgccactgcactccagcctgggcgacagagcgaaactctgtctcaaaaaaaaaaaaaaaccttcttttatatggccttggtaaaatgaatccctttggcaaataatattgatcacatgctaagtatcttgtctcaagtgaagagagggtcaggttgaaatctgggtcagtttcttttacatttgaattttaaattctgtgtaatttgtatgttttaaatatgctgttaactcatgttcgtttattttctttcagtgttcccttgtgtaccagaacgtcctgggatgccttgtccaggagaagatagtgagtgtttatatacttcataccttttacaagagttactatgctatggtacaagtgaaaaagaaatcagagatagaatttttagctaggtgcagtggacagtggctaatgcctgtaatcccagcactgtgggaagctgaggtgggaggatcgcttaagcccaggagttcaagaccagcctgggcaacaaagtgagaccttgtctttccaaaaacacacaaaaaaattagcatggtgtgtgcctataatctcagctacttgggaggttgaggtgggaggatcccttgagcccaggagtttgaggctacagtgagccaaggtcgcactacttgcactctagtgtgggtgacagagacaggccttgtctcaaggggaaaaaaaaaaaggaaatagaagttctaattcatttgatttcttttccatttttcagtcaatttagaatatattagtgactgcccaaatgctactttgccagatcaaattcagatagttcttagttacaacttacatgattgcctgttgcacatatgaaaggaatattaagttaaatttaagttttaaaattcaattttggaaatgttcaaacctatacagaagttgaaacaacatggaaaacaaggatacctatatatcctttgcccagatttaccaatttttaacgttttccctgtttgctttatctctgtatctgtctatatctcatatatgcatgcacagttatacataacaaacacatttttttttttttggttataccacttgagactgacatgacactcagcacatgtaattaggaattggctttttttttttctgcagtgttttttacttaaacaggtattaagtcacttttgttgttgttgtttttgagacagaatctcgctttctcacccaggctggagtgcagtgacgcaatcttggctcattgcaaccttcacctctggggttcaagcaattctcctgcctcagcctcctgagtacctgggattacaggcgccaacaccatgctcagcttatttttgtacttttagtagagttgaggtttcaccatgttggccaggccggtgtcgaactactgacctcaggtgatccacctgcctcagcctcccagagtgctgtgattacaggtgtgagccactgcacctggccccaagtcacttattaaatgtctttaaatattgcagacttcctacagttgacccagagaaatgtgtatatttattagatctccaattcctagtaacttcaggtaaccaaccagagtccacagtggaacggtgattcttacccttggacacattaaaattgtgggatggagggaatgatcaatgccaaatttccatccccaagcttaatgaattagtgtggaggtgaaatctggatatctttgtattttaaaatggactctcaaaatgtagccattgggtcccacagcatcagcttcacctgagaactgaatagaaactgcactccaggctgggtgcagtggctcatgcctgtaaccctagcactttgggaggctgaggcaggcagatcacctgaggtcaggagttcaagaccagcctggccaacatggtgaaagcccatctctactaaaaatactaaaaaagttagctgggtgtggtggtgcatacctgtaatcctagctacctgggaggctgaggcaggagaattgcttgaacctgggaagcggaggttgcagtgagctgaggtcgcgccagtacattccaatctggacaacagagcgagactctgtctcaaaaaaaaaaaaaagaaaaaaactgcactccaatctacgtgattcataaactcttggactggggctgagctaccagatttaacaagctcttcaggtgattctgatgcacactaaagtttgagaaccaccatttaaaagcttccccaggtcaggaattgttaacggaatttctttggaatatctaagccaatggttactattaatgagatgaactaagagtgtccaactactctttgttctaatgtaatttaatatgcaaacttatgtttgattgtaagttattgcttttggtattttggcataatttactaattgtggatattaggcaactcattttcatttgtggtttctgcacatgcccatcactttagaaggaatagtggtaaatgctttgctttgaattaatcgaaatagctctaaactttctttttcttttttttttttttgagatggtcttgctctgtcgcccaggctggagtgcagtggcgagaactcggctgactgcaagctctgcctcctgggttcatgccattcagcctcctgagtagctgggattttaggtgcccactaccacgcccgtctaatttttttttttgtatttttagtagagatggggttttgtatttttagtagagtgctagccaggatggtctcaatctcctgatcttgtgatctgcccacctcggcctcccaaagtgctgggattacgggcgtgagccaccgcgcccggcctaaactttcaattctgtattaagctatcctgagatttctaattgagagcattgcaactggtctttagtatcttaattttaaatagtaaacccattgctatatttgctttaaaatatgactttgggaacctgttgtaatctttctatggtattaactattactgttattaccattactgtgggatgttattattaatgactaatagacaatatataaaataatgatggacttaaaaatatgaaggtggactagatttgatcgtttggaacctctttctctaactatatttgagaaacatattaatataaagaccactggatgaaaagttgttggggaaaaagatatgcttctggtacaaaatatcactttacagattagttacaaagactgaaatgtacctttacaatgaagagatctagcagtcactacctttaatggttattgaacatcagtagtgggagttgataatccgacatttgtgtacctcatgaaaagtaatgagataagaaatacacaacactacctatgtgttatttttgccaaaggtatttaatactgcctctaatcgtaagtaaacagacaaatccagaatgtgggatataatatgaaacaactaaccagactctttaaaaaaaaaaaaaagtcaacataatgaaaaggaagtaacaacaaataaggcagagtgaatgttttaaaatgttaaggagaccaaaaaaagcatgatcaaatgcagtccctgaatcttgattgcatcctggatagaaaaagtgagctttgaaagtcactttggggcctggcatggtggcccatgcctgtaatcccagcgctttgggaggctgaggcagacagatcacctgaggtcagtagtttgagaccagcctggccaacgtggcaaaaccccatctttactaaaaatacaaaaattagccgggtgtggtggtgtgtacctgcaatcccagctactcgggtggccgaggcaggagaattgcttaaacccaggaggcggaggttgcagtgggctgagattgcaccactggactccagcctgggtgatggagtgagactgtgtctcaaaaaagaaagtcactttgagaccagttagggaagtttgtatatgaattgtatactggttgatattgaattaatgttgattttctaagacatggtaaatggtattgtggttaggtagaattgggtggcgggggggtgcggaatatccttaatctcagacaatggatacttgggtattaaagggtatttaagtgccatgatgtctgcattttacttccaagtaattcagaaaaaaaaaagtattttttttgtagtgatgaaagtaaatatgacaaaacatgaataattggtaaatctcggtgaaagatgcaggtgtctattcttttaccttttctgtgggattaaaagatgttcaaaataaaaagttggaggaaaatttttaaaaagaaaagcagtagtaggccgggcgcgttggctcacgcctgtaatcccagcactatgggaggccgaggcgggcggatcatctgaggtcgggagttcaaggccagcctgaccaacatggagaaaccctgtctctactaagaatacaaaattagctgagcatggtggtgcatctctgtaatctcagctacttgggaggctgaggcaggagaatcacttgaacccgggaggtggaggttgcagtgagctgagactgtgccaccgcactccagcctgggtgacagagcaagactccatctcaccaaaaaaaaaaaaaaaaaaaaggacaagcagtaggcagtagtagtcaaatatttatactctgtggtctttatttttctttggtcccttgatgaatctattttattttttgacgttcaggtttttatcagtatttttttttcttgcagtgagtatcatgaaaaaattacagacttaattataaaatgatttttactcaaacttgctcttttttctttttttaactattactctgtcttcagaatccatctaccgtagaggtgcacgccgctggagaaagctttattgtgccaatggccacactttccaagccaagcgtttcaacagggtaaacatagtttgttgaatgtcgataatgtgaaacagctattttttccctttctactatgaaagaaaggtagtttgttattaagtcttgttatacacttttaaatacataagtagcatgaccttacatttccagtttgcctgaggcagtatgcctataatttttaatagcatctctttcactcttaaaaatgctccaggccaggtgtggtggctcaggcctataatcccagcacattgggaggccaaggctgccggatcagttgaggccaggagttcataccagcctggccaacatggcaaaaccttatctctattaaaaatacaaaaattagccaggtgcagtcacatgcacctgtagtcccagctactcgggaggctgaggcaggagaatcacttgagtctgggaggcagaggttgcagtgagccgagattgtgccactgcactccagcctgggcaatggagcaagactcagtttcaaaaaaaaaaaaaaaaagctccagattggatgattaattattccacataatataccctagctgtaagaaaattgaattttaaaatataatttaaggcaaccagaaaacaagcaaggtttatttatttaatattaatctttatttttccagttagtgttgtaatttgattttcactgtttagaaaataataatagcaaacacttatctgggttgtactacgtaccaggcacttttccaaatgccttatatacattgattcatttcatccttacaacaaccctgtaagataggtactatatgtttccactttatagatggcaaaactcaagtgcagggcagtaacttgcccaagataatacagctagtaagtgatagaaccaaagtttgaaagcagcagtctgtcttcagaagtcagttattcatttattatttatttattttttttttattttaaagacagagtcccgctctatcgcccaggctggagtgcaatggcacagtctcagctcactgcaacctgcatctcttgggttcaagcgattcttgtgcctcagcctcctgagtacctgggaccacaggcatcagccaacaggcctggctattttttgtatttttagtagagatggagttataccttgttggccaagctggtctcaaactcctgacctcgcgtgatccgtccgcctcggcctcccaaagtgctgggattacaggcttgagccaccatgcctggccagaaacgaattttttaaatactcttgataaccgcaaatttttggatgccatttccattctaaaactaatgccatgtaattaattaatgtaaatagaaaccaccacccgaaatccctctccaaactctcttacttccagtagcactgacatttaagaaggctttgaggctgggtgcaatggcacatgcctgtaatcccagcagtttgggaggctgcgaagggggaacactgaagcccaggagtttgagaccagccagggtaacgtagtgtgagatcccatctctacaaaaaatacaatcattagcagggcatggtggcacacacctgtagtcctagctactcaggaagcttgagcccaggacgttgaggctgcagtgaatcaaagtgactccactggactccagcctggctgacagagcaagaccctgtctcttaaaaataaataaataaataaaaagagagaccaagtgcggtggctcacacgtgtaatcccagcactttgggaggctgaggtgggtggatcacctgaggtccaggagtttgagaccagcctgaccaacatggtgaaaccccatctctactaaaaatacaaaacttagccaggtatggtggcgcatacctgtaatcccagctactctggaggctgaggcaggagaatcacttgaacccgggaggcggaggttgcggtaagctgagattgtgccattgcattccagcctgggcaacaagagtgaaactctgtctcaaaaaaaaaaaagaaagaaaagaagaagaaggcggctttgaaatgagaagtcactttaggttattgctctttaagaaaacagagctttgttttgacctctgaacagcctgcaaggtttatgtttgcttaggagtccttcaatggctttttctgccatatatatttctagtttaattctgttttcattattttgaacttgattatgtaaagactgaaaattcttagacttagaaagaaatgtggttgcagatttcactgtctctttaaaataagctctgtttttcgctgaccttcatagcttttaaaaaattatgtatgaggaagctttgttttgcttttgtttttgtttttgttgtgggctgacagttgacaccgtgacaaagggaattgagtcagcaaactatttgggaaatggttatgaccttcttggttaataaaatattgttgaattactcttttcagcgtgctcactgtgccatctgcacagaccgaatatggggacttggacgccaaggatataagtgcatcaactgcaaactcttggttcataagaagtgccataaactcgtcacaattgaatgtgggcggcattctttgccacaggtaagatgtctgtccttttttttttttttttttttaagagcgtgcttgataacactgctataacagagtgctaaaatagggaggtgttcaggaattacagcacaacagagtagctacagagtatggggaggaataccttacgttactgttaacacaccgtgaactttggaacttcgaaatatctgtggtaatacttgtctgtgggacacagttaacttctttacctgctgtaaaatcctctggtctaaattaggaagctatagagagaaccatttaagagttttttccccctctcctttaatctgaacgtattagtttatagctcacattattctagcttctatcctaagcagatatcaggtaagaagagtcaaaggtatcatgtttgttatttaaactgtgagattactggcgaggaaagcatttaaaatttttatttattaatttctattttaaatatataaaacatgtttgttatcgaaaaaaatacagaatacagatgaataaagaaaactaagtaaaagtccacatatattctaccatgtaaaggtaattgtcatttggtggatatccttccagaacttttcctgtgcaaatttatatgcataaacatttttaattttccatatggaaaaaatgtaaacatgtataagagtaggtggaacactataatgaactcccatttactagacatccagctccaacagttatcaactcatgtctaatcttggtttcatctgtacccccattcacttaacttccccttgccctgtattattttcaaacaaatctcagacatatttcagtatgtacctctaaaagagaaggacttttttaaaaacctaactaaaaaacaaattctttatgtcaaatatccagtaagtgttctcataaatattataattttgtttttatagttttcattatgaatcaggatccaaatgaaatgcacttgtacaattgattgatctcttagatattctttaatttactggttctttcttcatttctctctcttctttttttccttacaatttaattgtaaaagaaacagttatttgtcatttacactgttgtaaaattttgctcattacttctccatggttatgttcagtatgttattgtcttctttattcttttatcttgtacagtagttggatgtcgaggtttgattagattctggggttggtttgtttgttttggtggattgtttttgagtcgactttacagagggttgtttatccaccagaaggcacatgtgcttgcctgtgtcttttttgttattgttttgagacagagcctcgctctgtcttccaggctggaatgtagtggcacaatcttggctcactgcaacctccacctcccaggttcaagtgattctcctgcctcagcctcccaagtagctgggattacaggtgtgtgccaccatgcccagctaatttttgtattttcagtagagatggggtttttgccacgttggccaggctggtcttgaattcctgacctcaggtgatccacctgcctcggtctcccaaagtgctggaattacaggcgtgagccactgcacttggccaatcttagtgaactttctggcaaatcttacttccttaaggatccagaattagaattactgggttaaaagatacgcatttaaaaaaatacctggatgcagctatctaagcacactgcctatcgattagccctgctccacaaggaacagtcaaaaaaagaaagaaaaatacctggatgcatctttctaaattgtcctttagaattgttattccatgtttattcatgggacttgctttggacattgtgaaagcaggttattaccggtagctctttggtattagaatctttaattagttcatataagcttaggaatgggtttgtagtaaaggggaaaatccaatcttaaggaaaaacagaaggctgactatttccaacatatttatgtaggttactattaatatttttgagtattctttggtgacatatggaaggaaagggggcagggttagtgattatattgaagttttaaaaatccttaagcttacttatgagcctttctttaacgcagccttgaaatgctaactgtatcattaatgttctttctcaagtttactttttcctgctggtattcattaaatgtgagtctaagaataaatcagtaataacttgggtttgaatttacctttttcctgagattattcgccattatttgggtaagttggattctagaaagtatttcttttctcttttttggggccactgacacccttgagaatcttcaggaaaatgggaaacccacaaaattttacatgtaattttaagaggttatagacatcctgaagtctaccccggaccccagctaaagaatgcatattccagaaacttatttttgccaaagatctgaagtggagcttgaaggaagaataggtagtgttgaagagaagcaaagcagaatatatggcagtttaatatgatttctaattggtggtctgaaattagttttgtattttcttttctgtaaaatgtgactaacattacctcattcacagcagtattgtatagtttcataaaacaaaattaaaagtaaattctcacttaagttatattctttcaaaattaaattttaatatgctgtgtgttgttgaaatagtgttatttctggtgtaatagaggtactccactgagttactgtgtctttggaaatgtttgtaggaaccagtgatgcccatggatcagtcatccatgcattctgaccatgcacagacaggtaagagtggtgctggcacaacccattgttcattcacagagtagcatgtaaagacttacttaggtgactctcttacccaagtttaaaaacatttacttcttcccaattaaaagtaaatacatatattttgtagtggtgaaatcagtcacactatttaacatacacatttggcatttttaaaagacaactgtgggctgggtgcggtggttcacacctgtaatcccagcactttgggaggctgaggcaggtggatcacctgaggtcaggagttcgagaccagcctggccaacgtggtaaaaccccgtctctactaaaaatacaaaaattagcagggtgtggtggcacactcctgtagtcccagcttctcaggaggctgaggcgggaaaatcgcttgaacccagaagttggaggttgcagtgagccaagatcatgccactgcactctagcctgggtgacagaacaagactccatctcaaaaaagagagagagaaaaaaaaaagacaactgtgggctgggtgtggtggctcacggctgtaatctcatcactttgggaggtcgaggcagaaggatcccttgagctcaggagttcaagaccagcctggccaacacagggagactctgtctctatttaaaaaaaaaaaaagtatgtaaactacaacaaatgactattttttctagttcacataaatttcttttgagacgcctttaaattcagcaaactcagtttttttccataatgaaaaacatgaggctgattttgtggcccatgttgactgtgttcaggtgactcgcttttttctttttctttcgagacagagtcttgctctgttgcccaagctggaatgcagtggcgtgatctcggctcactgcatcctccacctcccaggttcaagtgattctcctgcctcagcctcctgagcatctgggattacaggttcatgccaccatgcccagctaatttttttgtatttttagtagagatggggtttcaccatgttggccaagctggtctcgaattcctgacctcaagtaatccacccgccttggcctcccaaagtgctgggattacaggcatgagccatggcacccagctgaagtgacttgtttttattaaaagctttattatcagaagtagaaattatgtgaaacatagagagatgcaatataggaaattccaggaagatggtgtaactgaaaacgttagatagatacaaaaccttaaacacgtatctgggaaatttggagagcagtgcaaggaggtagaacagcatgatcttctctggactaaatcaagaaagggaaaacaagggagtttttctggaaagacaaaatgcaatctcgtagtcatagaatgatcaactctatgaaatgcaggctcttttttttttgccccaagtagctttaagaagtagaagttccatccttgtctgttctttacttgaccattgtggtagttaggaaaattctgagtacaatggagtgagaagtgaaaaccagaggtcctgtatctctatgtcttagtcatactaaaaaatttaaacatatcttatagagtcatttgtttagaaggaagtgtttgattaatttgtaaagaagagaaatgttttaaaaataacgaaagtacttgttaaaagcagtacttggctaccaggttgtgatgcttgctctctttaccctcactaaagattaggatttaactattgtatttacatacaatttgttattagtaggacagatagtcagttttaaataatgaaaatttattcagaagtaaaaactaaaataaaaatcaggagacaatttttatttcaaactcattaatggttgctgtttttttctcctgcaccttttttttttttttttttaatgtttggtattgggtttttagtaattccatataatccttcaagtcatgagagtttggatcaagttggtgaagaaaaagaggtaagataatttgtcttattgtacattatatcattagctttttaataaggctcaggagtttaaaagtatgacatattgacctgcttagactttagatcataatggtgaaatgcaaaaatgatttgtaatgattccagagttttattctgatttaatttagtaattaaattactaatttaaactaggaaataatttagtgggataacttattttcattttaaaatagcttaatctgaaaattacaatgtatttaaggatactgtttaaaatacttggtagtattgtttaaaatatatagtagacccttccgttttgtgcctgaattgcttatttagacaataaatgattaaacatattaactgtcattgtttttttgactattaagtattttatcagtttttaaaacaaaacaaataattaaaatgatttgattaaaataataatcagttttttgaaaaaagcttatagtgaaaaagataatcatgtctcccaccttccactcccagtttggcttcttggcaaccttttaaaccatttctagttatgtccataatatttatatttctgtttttcaattttttatttttgtgtatttctggacatgaaagatttagttcacactgcctcctctctttcccgtatcattctttttttttttttttttgagttggggtcttgctgtgttgcccaggctggagtgcagtggtgtgattatggctcactgcaaccttaaactcctgggctcaagttatcttcccaccttagcctcccgagtagctaggactatagccctgtgccaccacacccagctaattttttcattttctattttgtagagacagagtctcactatgttgcccaagctagtcccgaactcctggcctcaagcagttctcccaaatcagcctctctaagtgttaggattacaggcatgagccaccatgcccagccaaaactttgaaacataaataaaagtaaacaataatataacaaagcccttgtatctattgttagttaaaacagctatcaattcatgtctagccttattttgtctactcacttccctcactcctgtattattttgaagaaacctgttagtcacctatttgatgttatgttttagtttcttgttctgtttgtctgaaaaagtctttttttctttttaacttttttttttctttttattttttttgtgagacaggattattgcacaggcacccgtgcagtggtgcaatgatggctcactacagcctcaacttcttgagttcaagccacctcagcctctcaggtagctgggactacaggcatgtgtcaccactggaccctcatcacaatatacaaaaatttactcaaggtggaataaagatttaaatgtaatacctcaaactataaaaatcctagaagaaaacctaggaaatatcctctcgacattggccccggcaaagaatttttggctaagtctccgaaaacaattgcaacaaagccaaaaattgacaagtgggacctaattaaactacagagcttccacgcagcaaaagaatccaccaataaacagacaacctaaagaatgggagaaaatagtcacaaactatacatccaacaaagatctcatatccagaatttataaggaacttaacagcaaaaaacaaccccattaaaaaatgagcaaagggctgggcatggtggcttacaccagtaatcccagcactttgggaggcagagtcaggcagatcacttgaggccaggagtttgagatcagcctggctgacatagtgaaaccccatgtctactaaaaatacaaaaaaaaaaaaaaaattagggcgtggtggcacacacctataatactagctacttaagaggttgaggcacgaaaatcattggaactggggaggcggagattacaatgagccaagatcatgccactgcactccagcctgggcgacagagcaagacactgtttaaaaaaagaaaaaaaaaagggcaaaggacatgaacagacatatctcaaaataagacctataagcagccaacacacatgaaaaaccactcatcgtcactaattatcagagaaatagaaatcaaaaccacagtgagataccatctcacaccagtcagaatagctgttactaaaaaatcaacttgggcgtgatggctcacacatgtaatcccagcactttgagaggctaaggcggaaggattgagcctgagagttcaagagcagcctaggcaacatagtctctactaaaaatacaaaaaattagccaggctcggtggcaggcgcctgtagtcccagctgctcgggaggctgaggcaggagaatggtgtgaacccaggaggcggagcttgcagtgagcagagactgtaccagtgcactccagcctgggcgaaagagcgagactccgtctcaaaaaaaaaaaaaaaagaaaattacaaataacacttttactgtttctctagaagatgcagtgaccttggcacaccttaaattcattccttttccattcctgcctttgggtgttattattatcagagtttaaaattctgtgtgtgtgtatatttgtttttttaaacagttactccttatgtagatttacccacattttaccctttttgtttttctttccttcctacgtctgttcctccatctgagatcatgcattttctccttcaagaactcaatttagtttttcctttagtgagcacctagtagtgatggatccactcagtttttctttgtctgaaaatgtttttctttcactttcactttgtgagctacttttgcaggatagagaattctaggtcagctgttttcttcttttttaggccctttgaagatgacatttcactgttaagtggcgtctatcatttcattcagccttattattgtgtcggtgaagttaactctatcttttttgctccacttgattctctcttatagtttccagttagccatatttcaagtctatgtgttgacttactttcttacacttctcttctttcttaaccttctcaaacctggtttcttttcactctgctgtatttacccttgtgtgttagtctgttttgtgttgttacaaaggaatacctgaaggttgggtgtggcagctcacacctataatcctaggactttagaccgggaggatcatttgaggccagtagttcaggaccagccttggcaacatagcaagaccctccatgtctacaaaaaataaataaaaattagccgggtttggaggcacatgcctgtagccccagctacttgggagactgaggcaggaggatcacttgagcccaggagttcatggctgcagtgagctatgttcgtgccactgcactgcagcctgggtgacagaacaagaccttttcttaaataaataaataaatgaaggaaggaataaaggaatacctaaggctgggtaatttatacaagatttatttggtgcacggttctgcaggctgatcagtaagtattgcactagcatctgcttctcaggaagctttcagtcttggcagaaggcaaaggggaagcaggtgtgccacatggcaagagagggagcaagggagtcaggggaggtgccacactctgaactcactcattacacaggaacacaccaagccattcatgaggaatctgtccctgtgacccaaacacctcccactagggatcacatttcagcatgagatttgagatttggaggggtcagatatacaaactatcaccttgttaccaaatcaaattattattattattactattattgacagggtctcactttgtgatgcaggctggagcgcactggcacaatcacagctcactgcaaccttgacctgcctggctcaggtgatcctcccacctcagcctcccaggtagctgggactacagtgcacaccaccaacatccggctaatttttgtatattttggtagagatgaggtttcttggcacattgcccaggctggtcttgaactcctgggctcaatcagtccacctgcttcagcctccctaagtgctgaaaatacaggcatgagccactgtgcgcagcctaaattattatttctaagtttttaagttgtcattctcactcagtttttctaatacccttctttcagttttgtgcttgcgggtttctttatctttctcaaaatttactatttgcttttcttggtattcttcacttcagagatttcatactttattctcatgggtccattgtgtgctgatgattttgcaggcatctaataaaagactgtcttcaggcttctctgtaaattgctagaagcttacatttgtagttgtgaatgaattttaaggcttactttgtcgtcccaaaggggtcttggtattctgtggaaaagaatgtcttccattcgctgaactacttcatgcttgttttctgtctatagcatccaaaaacgcctctgaatgtgtgctctcactagcttacattctatgtatcaagcttccagcagactctttcatcttgatgtctcattataacttctgaatttatcatgaaaaacccaatcgttctctccagtaactttgtcaatcttatcctagccacacacttgacgttccctgtcagtggtacccccaatctcttggtcaccaaggttaatgtgtttttttaattcctgcatctctattgcctctgtacccaaaagttatcgtatcctttttaagacatccttcgatgtttttgtgatttcaactccctccccattcttattaccatccctcttatctcaaaattcatccatataatctggatagttagattatttggtttggaatgacatttgaaaaatattaagaacttaaaatatttttatgttaggaaaatatctttaaatcgttataggtacaactaggtgttagaaatataatgtactacgcaaagcatttcccattataactctgatacaaatgttctcaacaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggtaagcactgcatattttattgcttctaaactgcttgagaatactattcttttttttttttgaaacggagtttcgctcttgtcacccagcctggagtgctagtggtgcaatcttggctcactgcaacctctgcctcccaggttcaagtgattctcctgcctcagcctcccaagtagctgggattacaggcatgcaccactatgcccagctaatttttgtatttttagtagagatggggtttcaccatgttggccaggctgctcttgaactcctgacctcaagtgatccacccgcctcagcctcccaaagttgctaggaatataggcgtgagccaccgcacccagccaagagtactattttaaagaaaacctctatgtttgtgctttattatctcattctgcttttctaaatatgtgctaagtaaatgaaatatattatttcggtttacttttcttatagatggtataagatatttaaagtaatttgattattagatttttttaaaaaaacaaaaatcaaaccacattattatcaggagaaatacttgagctttgtaaaagttttctagacagttttataatactgaaagattgactagtgttatttttctctttgtatgtaaattttcgtttcatgattatcaatggttttgatatttagcctagttaaccattgcatttgtgaccattgaattgctcagagcaaatttatcattaattgtgatatcagtttgacatagatttcttacatgtttcaaaataggatattgattgggtacagacagagaagcatgtgtttgagcaggcatccaatcatcctttccttgttgggctgcattcttgctttcagacagaaagcaggtaagattgaaagatagtagaatgattactgggcttcatatttttggtcatattacacagttagaacctttctgccctaattcatgaagttgatatcatggaggatgcaacagtgttaggcttataacttcctgctaataatactgccatcagtgatatcagtttgatattagatcagcattaggaaatgacctactttaggcagaacaggaaatagccatgtcgtaattatggcagtagaaatccaaccttttaaatatccccagtattctagttttatgacttaaaattttctagcatttaacaaggaggaaaaataccttgacagtcgaaaatgacttatttagcaaatgctaaaattaggatggtaatgagtggctctggattgcaagtggtactactttagaacagaagtagtaggttacaaaattattatcatgctggtttactttctcgtatgttccgtaccctagataccctttgtttccaccaaaattttggcatctttttaaaggctaaatagtagagaatgctctctgttgtgatggtttctgaaaatgcaaagttacactaccttattttggatcttgatttcatgggttctctcctgtgttttagattgttctttgttatagagtatgtaaatggaggagacctaatgtttcatatgcagcgacaaagaaaacttcctgaagaacatgccaggtgagtttttgtttactgtttgtgttgttttctttttggggccatgtggctttttatgtgcagtggttggaaacagtagataaataatttattttgatactagttaattatttgtaagtcatgcagaggctgagctaaaagttaatttacattatatatatgtaaaacaattatatattcttttacatttatacacatacatgtacatacacatgcacacagtgcttcctaagcaattgaaaagtgtgaacagtattaaaaggcaaacctttagtctgctaaaaccaatccttttcaaatattatgtctatgtagcatcagccatttaaataattgagactaataaacacttattagtcttttcaggtttgtagtggtctctcagagagttcttcacgataagagtgctattcatacatacttgagagtaattaaacgatccctctggctgggcacagtggctcacacctctaatcccagcactttgggaggctgaggcgggcggatcacctgaggtcaggagtttgagaccagcctggccaacatggtgaaaccctgtctctactaaaaatacaaaaatttgctggtcgtggtggcgggtgcctgtaatcccagctactcaggaggctgaggcaggagaattgtctgaacccggaaggcggaggttgcagtgagcccagatcgcaccactgcactccagcctggccaacagagcaagactctgtctcaaaaaaaaaaaaaaaagatccctcttaaactagtatatacttctgactgttcttcctgtgatttattgttctttggcttttttttcctctaatcccataattattgatgaataaaataatatcgaataggccaggcgcagtggctcatgcctgtaatcccagcactttgggaggccgaggcgggtggatcatgaggtcaagaaatcgagaccatcctggccaacatggtgaaaccccatctctactaaaaatataaaaattagccgggcgtggtggcgggcacctgtggtcccaactacttgggaggctgaattaggagaatcgcttgagcccgggaggcggaggttgcagtgagctgagattgcgccactgcactccagcctgggtgaaagagcgagactccgtctcaaaaaaaaaaaaaaaagtattgaatattaattttgtgcccttaatttgatattaatatacaagactgtaaattgtttatgtgttggatggaggagataggtgggaagggatcatggccttgagtaaaaagtttaatccatcagtaccatgttttgtttcttatccgtaatcagcagtaattctcaccctttcctacttcacaagagtaatgccaaaatgaagcatgtgagtttgtatatgtatgttattatcatgcagggaataaatattagaaatttcatttaaattaaaaacttgtagaaaatttgctacttcattattgcttgtcaaaaatttcataagaagatataaattgtacttgtctaatcttgaggccaacctgggttttttgtttatttgggtttttttgttgttgttttggtgttcatttatgttcattgtgtatttatgccttatcaaatggtcacccttcatagagccacagatgatattttgaattgtgaacatagccaatatttgttccttgtttgttcagttgaatgtgggaaagctagtctggtttttactatattaatgtgccagttttggttttataccatctttgcttttgtaagaactaaagcccaggacaagggcttaagttcccaaatcacggaattaagtagctaggaggtgtatgttacgtacctccacacatgatcatgataatgtgccaccaaagcagccatacatcagctcaggcattccattttcattattcaggccaaaagttctgggttgtcaccagtgagttggtagcagtttttttaagttcttcatttaatattaaattttacagttgtttatagttgtagaatattttcatttaattccttttctaaaaccttcatgaggattttatagtattgagtagtcagcttgtagtattctttctattctcgaccccattagtggttcttagccttctcggaggatcacgggtcccttagagaagtgatgaaagctttgaggactctgtagatactgtgcatgtacatacgggcatacacctttgcccccagttgtagaagtatggactgcctgaagttcacccaaggacccagattgagaacccctgtttgagactatcaaattaatagctttatgaaaaatgtgagtttaagttagacaggaacttttacaattgtgtcttgggctcagatgttttaaagtggtacttcagttcatttttcaaatttgttcctaaaatcactgggagaaaaaaatatgttttaatatgaatttttgtgtttccagttgtaaatgtagaacttaaatatggttgaatcaaatgacttattttttatttaattttagattttactctgcagaaatcagtctagcattaaattatcttcatgagcgagggataatttatagagatttgaaactggacaatgtattactggactctgaaggccacattaaactcactgactacggcatgtgtaaggtgaggaaaattttctagttattttaaaaggtcttcagcagctagtagtctttgtaaaataacttcatgtttaaagatgaggaaatgattactaattttgctaatttacttaagctttgtggaattctagcacaaagacaaatgtactttttttctaaccatttgcaaaatttgtatcttctgtgttatgtgtactacaataagagctaatttctttttattatacataactttttatcttgaaagttgaaatacaattgaagacaatttggaaataaaaattgtctgcaattccactacttaacacaaccatttgcatatgaccttccaatttttgccatttagtagtgaatcttatataatgcattcaggattttcctcagaagtcaaacattttttatatttaaattttaaacatctgacataaagcataataggataaaacaagaatttcagttactcccggaatatgtcttcatttctttttttttttttttttttgagacagggtcttgctctgtcccccaggctggagtgcagtggcgcaatctcggctcagtgccagctccgcctcccgggttgacgccattctcctgcctcagcctcccgagtagctgggactacaggcgcctgccaccacgcccagctaagtttttgtatttttagaagagacggggtttcaccatgttagccaggatgatctcaatctcctgatctcatgatccgcctgcctcagcctcccaaagtgctgggattacaggcgtgagccatcgcgcctggcctatttcttgatgttttattcttttataacagtgttccattttaaatgtctgatattttcccactaaatgtgtaaggaactattccttgttaaggtaactggtacaaaattatcctcacatagcaatacaacaaccagtatgtaaatgtgtgaattgcattccctgttcacctgtgggaagtgcctccagagcctggagattatctaaatgctaacaacatggcatatgacaacctagttgtatcgaagatttaactttattatctgttcagcatgcattaaagaataaaatcttcacttaaactatgtttgcttttatgtacagaattcaaccgtacttttcacatgatacttattaattaattattgttgttttttttttttggagacagagtctcgctctgtcgtccaggctggagtgcaatggcacaatcttggctcactgcaacctccgcctcctggattcaagccgttctccagcctcagccttccaagtagctgagattaaggtgcgccccaccatccctggctaattttaattttttttttttttttttaatttttgagacagagttttgctcttattgcccaggctggagtacaatggcacaatctcggctcactgcaacctccacctcccaggttcaagcaattctcctgcctcagcctcctgagtagctgggattacaggcacctgccaccatgcccggctaatttttttgtatttttagtagagacggggtttcaccatgttggccaggctggtcgcgaactcctgacctcaggtgatccacccgcctcagcctcccaaagtgctgggattacagatgtgagccaccatgcccggcccttacgtatttatattatacaagttttcaatcataaacaattagaaagcttagcgagtggaacccctatgtacctatcacttatatttgtggtacctttttgatctctgtgtcattttttttcctaagggatttttttctcatttcagaaaaaagtgacagtgatagaggagtcttatccccaagaataaatgaaactgaacaaaaaacatggagagtattacccttcatacgaagtgcacaaattaaaacaatgaggcttttttttttttttttttttttgcctgtgagatacgggttttaaagttagaatagcctgtatgtacaagagtttaaagaaatgggcatatgtcactggtgtgtatataaattgttacaaaccttttgagaagcagtttgatgggggaattatcaggaatcctaaagatggccatgttctttgatccggtaattctgcccttggatattctgagtaaatattttggtttatgaggagagatttctgaccaaaacttttattgtagtttatgatcaatattataaagtcatttaagaagatctttatttttattttatttttactttcttttttttttttttaaatagagacgaggtctcgctgtgttgcccaggctcgtctcaaacccaagagttcataatgttagcatttagataatctccaggctctggaggcactttcctcaggtgaatggggaatgcagttcatacatttacatatttgtcatgttactatgtgaggataattttgttccagttaacaaggaaagcaagccaccacgcccgactgaagatatttgtaaaaaatacataacacatgatggctcagacctgtaatcccagcaatttgggaggccgaggcaggcagattgctggagctcagaagttcgacaccagcctgggcaacatggcaaaactccatctctacaaaaaataggaaaattacactgggttggttgtgcttgtagtcccagctacttgggaggctgagatggggggatcacttgagcctggggctgtagtgagctgtaatcgcgccactgcactccagtctgggtgacagagtgagatcctatctaaaatatatatatatatagagagagagagagtaataaatatatatatgtatatacataatgcttataacagatgaagtcttaacatatagaattgtctgattcttttatgtatcattctgttatgtagcatcacacgttgattctgtttacttttcagcatttttcaagttgttattttaaaatgttatgttaaatgtggttaccaattgcattacagtacactaatgcattttaataacattttaaaatgttatttttaaataacacctttaatggaatcactgcattgtttaaacaatcaaaatgggcagggtgtgatggctcacacctgtaatctcagcactttgggaggcccggcaggcagatcacttgaggtcaggagtttgagaccagcctggccaacatggtaaaatcttgtctctactaaaaacaccaaaagattagctgggcatggtggcacacctgtggtcccagctactcaggagactaaggcaggagaattgcttgaacctggaggcagaggttgcagtgagtggagattgtgccactgcactccagtctgggtgacaaagtgagactctgtctcaaaaaaaaaaaaaaaaaaaaaagaaaatcacaaaaatgaattaagacttttctcttggccgggtgcggtggcttgcacctgtaatcccagcattttgggaggccgaggcaggcggatcacaggtcaggagattgagaccatcctggctaacatggtgaaaccccgtctctactaaaaatacaaaaaaattagccaggcgtggtggcggacgcctgtagtcccagctactcgggaggctgaggcaggagaatggcgagaacccgggaggcggagcttgcagtgacccgagatcgcgccactgcattccagcctgggcaacagagtgagactacgtctcaaaaaaaaaaaaaggacttttctctttttgtctttcttagtcttttgttactcttactggaaaataatattggcttcttatacattttcatttcttacagggatcctcaatcaagttagtcaaggtgtttcataaatctgagatctttatcgagtaggtctttaaatcaaatgtcctcctacctccctttctgcctttcctccttctccaagagctgcctagggcgggtgcagtggctcacgcctataattccagcactttgggaggccaaggcaggcggattacttgaggtcaggagtttgagaccagcctggccaacatggtgaaaacccatctctgctaaaaccacaaaaactagccaggtgtggtggcgagtgcctgtaatcccagctacttgggaggctgaggcagaagaatctcttgaacctggggtggggtggagattgcagtgagctaagatcacaccactgcactgcactccagactgggcaacagagtgagactccgcctcaaaatatatacatataaaataaaataaaaaataaagcttatgagaaattaaccctccaaaagtttgaatgctcttttatgacttagtgtcaatatttaacttacctgaagcttgacttcatgcaagtgttggatgaatttctttataaagattgcagaggatagtgatgaaaacttgaattagtatctttagagttatgtttgaaatattttatgaacgttgattttattaagtggcagcctttcgtggttttatgaactgatgtgcctttaagtgtttttttcatcaacagaggaattctaataatatctgttatgctgcagaaaacttagcaaatggacctacattctgacattcagtcaacaagtgaatgattaagcatagctgttacaagttaacagactacatctcttacctctgactattgtactgaaagtacatgtcatttttcatgagaatgtattgccgttgccaataatagaaaacaataaaaaccatattcatatttctaaaaatagcatataatatcccttttagaaatcattttaaaattcttggagtcacaacatattactaaatatttcttctagatgtttatagcagtgttatatataacagggtgaaatttgaagaaaaatatgttcaccatgcccagaatgtctctggagggccacataatagtggttgcctctagggagctggaactgggtgagtcagggacaagaatggaaggaagggccgggcacagtgctcacgcctgtaatcgcagcactttgggaggctaaggtgagtgaatcacctgaggtcaggagtttgagaccaacctggccaacatggcaaaaccccatctctactaaaaatacaaaaagccagaggctcggcacagtggctcactcctgtaatcccagcactttgggaggccgaggcgggtggatcacttgaggtcaggagttcgagaccaacctgaccaacatggtgaaaccccgtcactactaaaaataaaaaattaggtgggcgtggtggtgcatatctgtaatcccagctacttgggaggctgaggcaggagaatcgcttgaacctgggaggcagaggttgcagtgagccgagatcgcaccattgcactccagcctgggtaacgagcgaaactccatcttaaaagaagaaaaaaaagccaggcgtggttgcatgcacctgtaatcccagctacttgggaggctgaggcgtgagaatcacttgaacctgggagacagaggttgcaatgagccaagatcacgccactgaactccagcctggatgacagagcgaaactcggtctcaaaaaaaaaaaaaaggaaggcttgagttttgtgctgcccctcttttttggtttagaattttgtaccgtataatctataggaaagtggttaagttctaggtacatatgttctgttgaatttcatatagttgttaatattagaaagtcttcggttgtgtaggaaatgcttacaaagttttaaaacatgcttaattatgtatgattcagttgtctttagacttttttattgttgattttttttttatttgccttttggccagagaatggtttgaatattagttcattggaatacattgagatttcctttatgacctaatatatggccagtagcccatgtgtacttaaaaggatatataatctttacatgcagggagtctctctctctaatgtctctcttccttctccctcactccacacacacatatagacgtacatatattctacatgtatatgtattttgtatatatatatatatattttaactctagcttttttccaaatctttctctgcctactgatttttagtatgtgtgatctatcattttctaatatagattattctcatattaacttctcctattatgattggagattgtgaaattctcctaataattttgtccttttttactctttgtattttgaggccatgttgttgagtgtatgcaagtgtatatttgttacaatttcttggtgattgtcccattaattattgggtagttcctttactctgcctgttagtgtgttttgccttattttttttccatcctacagctattaaaatacaggcccggcatggtggcttatgcctgtaatcccagcactttgggaggccgaggtgggcagatcatctggtcaggagtttgagaccagcctgagcaacatggagaaaccccattttctactaaaaatacaaaattagttgggtgtggtggcacacgcctataatctcagctactctggaggctgaggcaggagaattgcttgaatccgggaggcggaggttgcagtgagctgacattgtgccattgcactccagcctgggcaacaaagtgaaactctgtctccaaaaaaaaaaaagtgttcttaggaaaaataaacagaaggaaaatattgtagtcttatcaatggttgtattaggaggtgagatttaaagtgcttcttttcttcatgaaatatgccttattctactaatattaaaattttgttattaaattttaacttgtatgtaaattattttaaattcaagtcgtaccttaattgaatcaactctagcaacatctaatgaggacaggttttcttcaagctatttagtggtgatctgtgattttaataataaaggcagttgccaggcatgatggctcatgcctgtaatcccagcactttgggaggccgaggcaggtggatcacttgaggccaggagatcgagaccagcctggccaacatggtgaaaccctgtctctactaaaaatacaaaaattagctgggtgtgttggtgcatgcctgtaattccagctactcaggaggctgagacacaagaattgcttgaacccaggaggtggaggttgtagtgagctgagatcgtgccactgcatgccagcctgggcgacagagcaagaccctgtcaaaaataataataataataaaggcaattgttctagtgatgttaagtgagcttaatgtatcactgcagatgctgaacttatatgataggtgaaatagaaagggtgaatttaaaacagaactttttatctcattctttctttctgttctttttaataaaaggaaggattacggccaggagatacaaccagcactttctgtggtactcctaattacattgctcctgaaattttaagaggagaagattatggtaataaataaattggtggtattattttagctattgctagatgggtggtaaaatgtggtaccaattgcattacagtacactaatgcattttgacgtgatcttattaatataaggattcttgatcctgttaaaaactacatggagagtcccagactttgaaatcgagacagtgggaccttggcagtatttgggggtaccaagctgaataatattttattagtggcaaacactaaacagtagcaggcactattctaagcagtttacatatattaactaagttaatcctcttaacaaccctgtgaggtaagtactattaattctccttttacagttgaagaaactgacatacggaaagtttaaataactcgcctaaggtcaaggattcagaacagcacccatgtgactccagagtcatgaacccctggaaaatttttcagatttcctgggatatttgccccaggaatctgaaagatggtggaaagattaactgtatctcaggcacccgaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtttaagaccaaggaggcaggagaatggcgtgaacccgggaggcggagcttgcagtgaaccgagattgtgccactgcactccagcctgggcgacagagtgaaactctgtctcaaaaaaaaaaaaaaagcccctgtccacacctccagcagttgccaacatatagccgggcgcggtggctcacacctgtaatcccagcactttgggaggccgaggcaggcggatcacgaggtcaggaaatcgagaccattctggctaacatggtgaaaccctgtctctactgaaaacacaaaaaattagccgggcgtgttcacaggtgcctgtagtctcagctactcgggaggccgaggcaggagaatggcgtgaacccgggaggtggagcttgcagtgagccgagattgcaccactgcactccagcctgggcgacagagtgagaccccatctcaaaaaaaaaaaaaaaaagaccaaggagattactctgaaatacaatttaattatatcctcaacacacaatattagatattgggcatgagtctgaaagtagaaatacatggagaaagaaagtttttttttctcataattttatttttaaaattatcttttaggtacctacccttgttgataaatgaagcatttctataatcttcagtgcctaccatgatagttggaatgcatttagagtttactttttcattgtttctttttcctttatgtgataaaatttccagttactaactttcaagaatgcaaagtgtataatttattgctttaaaatttctttctgaaggtttcagtgttgactggtgggctcttggagtgctcatgtttgagatgatggcaggaaggtctccatttgatattgttgggagctccgataaccctgaccagaacacagaggattatctcttccaaggtaatttggagtattttacagagattctctgagaaaaacctattctagagtacaaatgagagtgattcaggttactactttgagtaagaaaaatgagcataatctggaaaatataatcctgactggtggtattaggttttgttgttgtttttgtttgtttttgagacaaggtctcactcttttgcccaggctggagtgcaggggcgcaatctcggctccatgcaacctccacctccctggttcaagcaattcttctgcctcagcctcccgagtaactgggattacaggcacactcccgagtaactgggattacaggcacacaccactatgcccggctaaattttgtatttttagtagagacagggtctcaccatgttggccaggctggtcttgaactcctgacttcaagtgatctgcccacctcagcctccccagcatgctgagattacaggcatgagccactgcacctggcctctgtgtattaggttttgatgttttttaatacattctttcttttctatagtcttcactcctgttcacagttaccttctcatactcaaaatcataacaggggttatttagaattatccatcacaaacagattggagaaaggaatcctgtggctagagagataatctttacacagggaccctgaggctgagtgcataagttcaagaacagtatgaggggaaaatagagcaccaagatgatgagtgatcaaaagatggggaaaaaaggccccacatcagggaatatacagaattgacagaaacaagcagacaagtgcagggacctctagcacagaatccaaagaagtatgaaaactactataaaattctacatttaataattaaagccatcacaggatataaataggcatttcatgcccaaatggccatggaatatgtgaaaagacattcagtctcactagcaattaagggaatgcacattaaatgttaatgagttaccatttcatatcggtacatttgatcaaaatattaaagttgggtaataccagtgctggtgaggatgtggagcaactggaactcttctagactgctggtaggaatgaaaactgacacaacagctttaaagaataatttggcagtgtccaaaaaaattgcatattatatatgctaagcattttacaaatgttaactcatttaaacctcataacaatcctatgaagtatttttttattcctattttacagatgaggaaactgaggcataattaggtagtcaaagaataagacattcatgtaaatgataaatagtattcagattagaggctttctctgagaagatgggaaaagaaggggtttaggaaagtacaggaggcacttcagttatatatgtaatatcttattttttttcctggaatgccttaaatatcttataataaaaatttaaagattgcacccaggcatagtggctcacatctgtaatcccagcactttgggaggccgagatgggcggatcacttgaggttaggagtttgagaccagcctggccaacatggcaaaaccccgtctctactaaaaataaaaaaaaattagctgggcgtcgtggcgggcacctgtaatcctaactactcaggaggctcaggcaggagaatcacttcagcctggaggcggaggttgcagtgagctgagatcgtgccactgcactccagtctgggcaagacagtgacactctgtctcaaaaaaaaaagaaaaaagaaatttaaagattgccaggtgcagtggttcacacctgtaatcccagcactttgggagtccaaggcaggaggattgcttgaacccaggagttcaagaccagcttgagcaatatggtgagacccttatctctacaaaaaaatttaaaattagccagccattgctgggcgcagtggctcacacctgtaatcccagcactttgggaggctgaggtgggcggatcacttaccttcatgaggtcaggagtttgagaccagcccggccagcatggtgaaaccccatctctaccaaaaacacaaaactcactgggcatagtggcacacgcctgtaatcccagctactcaggaggctgaagtggtagaagcacttgaacccgggaggcagaggttgcagtgagctgagatcgtgccactgtgctccagcctggatgacaaaacaagactccatctcaaaaaaaaaaaaaaaaaaaatttagccgagcgtgatggtggcgcctgtggtcccagctacttgggaggttgaggtggaaggattgcttaagcccgggaggtcaaagctgcagtgagctgtgattgcatcactgcactccaacctgggcaacagaacaagcccctttcaaaaaagaagaaaaaagattaaagccatgtaaaagttaaatataatactataatttttatctttctagttattttggaaaaacaaattcgcataccacgttctctgtctgtaaaagctgcaagtgttctgaagagttttcttaataaggtataaattgtgtataagaatattttgtgatttgtctctttctatatatatcaaactggtcagtagcggtttgggaaatgtaaaattccaaaacagtagagaatgtaactttttcagtttgacccagaatttgtctcttacccaaagagtaattgacagcattagatcctgagataagttagttgtcctttccattttggcaataaaatttactccccagctatatattacataatttttgtgtatgtgtaaataatatataccatattctcacataggggaagagttaatctttgggtttagccataattgtactttgaactctgtttccattttctctgtatcattatccatagaatctatttattaccatgtactttttgagcacgtgggccgcagtgctccctacaaattctcatgtcaaaaatgctataattaggtaagattcggaagaaatgaaatgctatctttggctcttaaaaatgtgaacatcattcaattgtttgttgctgttggtaggctagaggagttttaggatctaggagtgtggtcttggcaattataaattctactttaaataaatggtatgatagaaaagttgatgtacatttaccttctaaggtaaatagataagataatgagttttaataaaataagaaattgaagccttttaaaaaatgaacaatttatgtgaggaaagatttaaacttgaaacctaatttttcacatagtgaaaaatgaaggcaagaggtgttgatatgcaaaataaaataccttttatcagaaagaaaaatgggaacatattctcattcatagtgatgaataagccaagactttttataagttgcaggctcctcagtccagtgattcagataatggttgtatcattgtcttacacaggtggtggtttgttgctataattgggcatggggattttaaattaagctaaaaacaaacttctcatgaagtttggaggtttgcatgttttgactctcacactaggtcatgcaaagaaatggctgggtgctgtcaaatgattctgctgttctctttttcctcctgtttttctttagcaaggaattggtgatgattctctgttttaattacatgatgggtggagaaagtgccttgaggaatcacaagtttcaaataactcaatttgttctggagttgtactttctagaaataaaaggtagaccattccaacttcagaaataagagtatcatgtgagggcacacaacacagatcacaaagatgatttattttaaagcatgacattcacccaattcttgaaacatttctttcaccataggaccctaaggaacgattgggttgtcatcctcaaacaggatttgctgatattcagggacacccgttcttccgaaatgttgattgggatatggtatgtaaattttgattactcaactattaggtttcattattatcttgggccaattttttgttgttgttctgtttgtttttagacagagtcttgctctgtcaccgaggctggagtacaatggcacgatctcagctcactgcaacctccgcctcgcgagttcaagcagttctgtctctgcctccctagtagctggaattacagtcactcaccaccatgcccagctaatttttgtatttttagtagagatggggggggtttcacaatgtcggccaggctggtctcgaactcctgacctcaggtgatacacccacctcggcctcccaaagtgctgggattacagatgtgagccaccacacccggcctatctcgggccaaattttattgtcttagctaacatatcacagctttaaaaacttaaaaccactttctaaactgctttttagaaaacttttaaaacaaaaaaaaaattcaatttttttttaatttattattttttttctgagacggagtctcattctgtcacccaggctggagtgcagtagtgtgatctctgctcactgcaacctccacctcctgggttcaagcaattctgcctcagcttcctgagtagctgggattacaggcacacgccaccacgcccagctaatttttgtatttttagtagagacggggtttcatcatgttggccaggctggtcttgaactcttgacctcaagtgatccacccgcctcagcctcccaaagtgctgggattccaggggtgagccaccatgcccagccaaaaaattgaatattaatgtaataaagcaggttgtaatgttattaaggcccatatcaatgtttatacttgtttttatttttttaggagaaacagtctcagtccgttgcccaggctgtagtgtagctcacgacagccttgattgaactcctgagcttaagagatcctcctgtgtaacctcccaagtagctgggactacaggcataagccatggtacccagctaattttcaattttttttttttttttttttgagatggtgtcttgctctgtctcccaggctggagtgtagtggcacaatctcagctcactgcaaccttcgccacctgggttcaagcgatttctcctgtctcagcctccagagtagctgggattacaggtgtgtgccaccacacctggctaatttcggtatttttagtagagacggggtttagctatgttggccaggctggtcttgaatccctgacctcaggtgatctgcgcaccttggcctcccaaagtgatgggattacaggcgtgagccactgcacccagccaatttttaatttttttatagagatgggatcttgctatgttgtctgggctggtcttgaactcctggcctcaagtgatcctcccatctcaacctaccaagcggttgggattacaggcgtgagccgccatgcccagctcatatttgtaaattatgttcatcattgctaatatcattgaaccatgcttcaggactcactttaataaggtaaacaatgagtgcagaggagaactgtagaggtggagtttttctaagaatacagacttgagctgtcatccagtatgtcttttcagatggagcaaaaacaggtggtacctccctttaaaccaaatatttctggggaatttggtttggacaactttgattctcagtttactaatgaacctgtccagctcactccagatgacgagtaagtaattctgtacactgaaatttttttttaagttctttggaaatcccatttttagtgactatgcaatgtttcattatcagattatactataatttttttattttctattttatttcattttattttattttgagatggagtctcgctctgttgcccaggctggagtgcagtggtgcaatctcggctcactgcaacctctgcctcccaggttcaaatgattctcctgcctcagataccctgagtagctggtactacaggcgcgtgccgccacgcccagctaatttttgtatttttagtaaggacagagtttgccatgttggccaggctgatcttgaactccagacctcaggtgatccacccaccttggcctcttaaagtgctgggattacaggcgtgagccactgtgcccggcctatactataatttatacaaccattcagttactggtatttgtatctactgtaccattataagttttaatagtaactgtcattttctcctttgctttatagtgcattatcttattttcacaacaactttgtaatctagttactgtcatcttcgttttacagatgaggaaaccaaggctcagagaggttaagcaaagttacacagctatcaggtggcagagtcaggattcaaacccaaatctgactgactaaggcctgtgctctttctaccacgctgcactgtttcccatttgacaaggactgtctttgagttcctgagtattgccttaagatagattcctagaaagagaattaggtcagagggtattaacattttaaagctcttgtattgccaaattgctttttttaagaaattacattgagttattaaatccagccatcagtgatctggtatattttttgtgcttatacttcatcttttaaacatgtagtttggaataattgggagatattttgattatttacctgttgttacagattcattctctctaatctcagggaggcccttattgtttggcagtcatttcacttctatctcatttcttaccacatttctcccagcacctgctccaaacagtctcttcatttcagaagccttcagttctactcctttttccatcactgttaatggattaaccttgtcttaatttgatgcaaggactgataacctctctgacgtgaccttgcctcctttgcagctgtccccagaccaccttgcatctcagaattgctttctaactcttttcatcattttcttattccctactcttggaagactctcctttacaaggggtgtccctgctattttcctagacctgtttccttagttttctccaagatttcattttgtcagttatctttttattagaccttctttatttttttctagcttgtttccctctgtgtaagcatgctcagatactctgatttttccccctaactcatggcccctctttgaacaaccacgtttttcctcattttcatttcatcttaaagcctcaaaaaaaaaaaagttaatagatgttcatggtcaaagaaaaataaatacacagcacctctaatcaaacttcttcagactagtcaacattgattgtcttgaattttttttttttttttttttactgtcaacacttcaaccccttacaatcgaacctgtcctccagcttttgaaggttgaatcaatttcttaatttctaaattgtaaagcattttggggtcagtcctcctctcccttgattaatgtaaagcatttggtactcatggctttgccttgggtagcactgcctattctggttctgtttcatctctgtgactactttcctctcatgtgttttccctgtccccttgagaccaggatgctccatggttctgttcatgacagccttctttttgctatatgcagtttgtaccttggagatttcagccagccctgtagcatagataccagctaattaaatggctctcagttaaatggcaaatggttattgagcaaaaggtgttatggtaaatactagacattcaaagacaatcaagacagtctgatctccccaaaagcgtgctgtctactagaggagaaagatgtgtaccaagtcattatttctgacagcattgtgtattagaaggaacactggatttaatcaaaagataggagtttgaatcccgatgccacctcttaccaactgggtaaccttggataggaattgcataacttctctgagcctgttctcaaattgcctacctcataaggttgctgtgaagaataaatgcatgatggtttctgaagcacttatcccctgccgttagatctcctgagctgcatttctgtttaacacggcccccagtttgtcagccaagcagctcaaatatatgaagtctaaaatgaaagtaatgaccctttatgatctctttctattgttctcaatcagttcctttttttttagttacctaattctgctcacggtgtgtccctgttgttcagattccagatgtcagtgattgtggactcctcctttttcttaacagattacataatacctgcagctgccaagtctttgtctgtgttttcattatttcatcatttacatcagatctttcttttctcttcccgttgacacaccctagttcaggcctcattcaagtcatacccagagtattgtatcagcctcctaattgatctttactccttcactttgcaacctattctgtatgccttgtgaagtaccactccaattcttgaacccctttaattagaaaccttcagtaactccttcattgcctatcaggtaacatctatcctcttggctagcatttaaggcctccccacatctgctccagcctgactttctagcgatacctctcaccataatacaaacagtgttctgatcagtcttagctactcaccattccctagtagtattattgtctctgcttctgcctgttcattcctgtgtatcccgccttcatttttacctattgaaattttcccatctttcagagccacctcagatgcaaccagatctttgatggatcaaggtgaaactccttagtgtaaacatcactggcctctttgatttagccattatttttcttcagcatcatctaacacacttctattcctgtgctccaccctaattacttgcatttcccaagacctaccacagtctttcatcattccattcattaagtgtttgcagaatgaatactgccttccttgatttctccaactagaagtcacacctttctttagaaccatggttagaacaggacttagcttattgtgtataaaatttaacaagtactgctttctcttccagtaggaattacctcccttccttgaaggaagggactgtatcctctgtaactttgtgcttcttagtatggcataatacatttatgtattaaatatttgatagcactactcactgtatattaaagtagaagcccagtgtaacaaaatgccaacctctcccctctctgtgacccatgatctccctgcggtgttctctcctcattccaggtctctcagtgtacttgttcctattgccttttccttttggctaacttcttctgggctacactatctaacatctggctgttgaggtgactactaaattgaatgctaattcaaacctggatgttcacctgtaactaggaatgttgttctggtcaaaagttaagattaactggaatggtgacaactggtgtcttttttattcgcagtcctcagttttgaactcctttttggctctaaacttgcttgtgggattatcggggttttttaaattttcagtactccattcttgattcgtctagaaaatctgggggattaatctaaaaatttatagatttcctttcagtacaattagcctaattacttgatttttaatcttattttaccatttaaaggttgaagaaatcttgattatgatgaaaataaatttatttttctttcaacagtgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttatcttttttgtttaaaaaaaaaaaaaacactgcattaaaaaagtatctgttgcattaaggcacatagtgggattacatcataaacctcccataatttttgtcattctgtgttaaatcatttcagggtttaattttgaaataaaagattaatataaaatgcaacaactttttatattacctattagttttggagttctttatgtttaaaaattcaggtgtaaattttattgccttggataaataaattattgatcttttttaaggcagcagttattaaattggtaatagaagatgctgcttgcttagaattgggaaattcggctgggtgcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccattgag

SEQ ID NO: 95 - DNA, 581663 bp, Homo sapiens
agattctgcatcttttaatgaaagataaaacaacaatataaacatacacaaatttacagagaagggatcaactttaatacatttggagtaaaaggtgtttcttctttaaatatggtataaaaataaatgcgagaaacattaacggagaatgtacagacaacagacgaagacatgagtttgtttctgactgtgacacattggtgaaatgaaactttctgtgcggaatttattgtttaataaatgtgaagccacatgtatacttattgatatatacttttttcttttacagttcttccagtttttgactgactgaattttcagtgaactgtgtgtctaactgaagctttgagagagagagagagagaaagaaggaaaaaaagaaaaggttttacttcacttgaacttgttaaaaaggaagagacacagatccagcatagtagaaggagaaagaaagcagacaacagtttggaatggaggcattgagacggaagagtccattggagatggaatgtacacacaaaaataacaatttaggtcctttgctcatgcaacatcttgttctaatgtcctctgctccaggtcacaacattgagctacaaagtgtgtgcagtgactccagtctgcattcatgctacaagatgatccgtttagtaagactgagcaaggcttgttaacctcttggacgtgagagatttcccctgagaaaatatataaaacaagagaaaagaaagaaaatcaagtacgatcactgaaaacctgcttagtagtagcaactatttactgtagctgatttttgtgcaaggtcaacactgaaccctttaagtccatcttagttcaaacctcatgaccaacctgccttcccccctccctccctccactgacacgtcaaacaaaactatcctccctccctccaccctcctacccctcccaaatccttcctccccactgcaaacagactgatggtttcacagcacagattagcaaatcataaaacatatccataaatgctccatcaaggcttagcaatgaagcaacacctaggttcccaactgattataaacatgttacaacaaatcttagtaagctgctctgaaagataatgtgagtgcattcttgttcaatggctgaaattaatgtcacatttataaatatctagaaatgtagaggatacgatttaattaaataaaatgcagtttttgagggtgtgattcatgaaactcaagattgagtctgttccctatcttacataataatggataaaaaggtgccaattatatatctgaagataaaagtctacttgttccctgtttctagctgttgatgtcttcctgttctttcctacctgacttcttccaaccctaatacaagaaaaaatctgttctattctgattccacaaatcatatgattacataaagcacatacttatgttttagaaatcttgtaagtcaacagtgttgctgttaatcacaagtactctagagagataagaaatttgagaccgggcgcagtggctcacgcctgtaatcccagcattttgggaggctgaggtgggcagatcacctgaggtcaggagttcgagaccagcctggccaacatggtgaaactccgtctctactaaaagtacaaaaataagccaggcgtggtggcgggcacctgtaatcccagctactcaggagaatcacttgaacccaggacgcggaggttgcagtgggctgagatcgcgccactacactccagcctgggtgacaagagcgagactctgtctcaaaaaaaaaaatagaaatttgaaacgtttgatcggaatgcaaaactgctggttttcatttcatgtcttattttatatgttctattataaaattatgtgggccagttatttaatgaatttttgtacatctcagaagataagtaaaaattaaaaaattggaaacatatattttagtaataaatcacagtcatagcaatactcttgatttgctacctaatgtggctcagttttagaaaggggtcagcggtgatgggagatacatcatcactcatggccattgccttagtctgtttgggctgctataacagaaaacgatagactaagtggcttataaacaacagaaatttatttcttataggactgggaagtccaagatctagacacttatagattctttgtctagtgagggccttctccttggttcatcaatggtgcattctcgttgtgtcctcagataatggaagaaggaaataagctccctgggacctatctgataaaggctcctgttcataagggcttcaccttcatgatctaatgaccttccaaaggccctaactcctaataccatcaccttcatgatctaatgaccttccaaaggccctgactcctaataccatcaccttcatgatctaatgaccttccaaaggccctgactcctaataccatcaccttcatgatctaatgaccttccaaaggccctgactcctaataccatcaccttcatgatctaatgaccttccaaaggccctggctcctaataccatcaccttcatgatctaatgaccttccaaaggccctgactcctaataccatcaccttcatgatctaatgaccttccaaaggccctggctcctaataccatcaccttcatgatctaatgaccttccaaaggccctggctcctaataccatcaccttcatgatctaatgaccttccaaaggccctggctcctgataccatcacccttgagattaggatttaacatgtgaacttgagcgggaagggatcacaaatattcagttcatagcagccacatttttggaaaaagacaatatgtttaagaaaagattaataattccataatcaacctgtctttacacaccatataattactgataagggcccttttgctgatatgaacagcagcaatgaaaatcatgcaccattttctcttaattttttcttaattgggaaaaagggtccacaacttagctttcagcatctgagagtagaagatattaaagtggtttttgttttgttttgtttttttgagacggagtctcactccgtcgtcaggctgaagtgcagtggcgaaatctcggctcactgcaacctgcacctcccggattcaagcaatcctcctgcctcagcctccagagtagctgtaactacaggcacctgccaccacgcctggctaatttttgttatttttagtagagatggggtttcaccatgttggccaggatggtctcgatctcttgaccttgtgatccacccgccttggcctcccaaagtgctgggattacaggcacaagccactgcgcccggctgatatcaaagtttaatgctggcatttcccactaggcttatgtttattcactttatgggagaaacaacaataaaagagaaaacagtttattaacaacagaccctgctttataaataaaatatgcactcctgcctgctctggtctgtctgtccccctcaaagctcacatgttgaaagcttactccccagtgtgatgctattaggaggtgggggctttgcgaagtgaccatgtatgagggtgaagctctcattaatgggattagtgttctttgtgtgtgtgtgtgtgtgtgtgtgtgtgtgtgtgtgtgacagtctcactctgttgcccagactggagtgcaatggcgcaatctcgggtcactgcaacctccgcctccaaaggcccctacctttggagggcctcaaattgcttgagttgctgggttcaagcgattctcctacctcagcctcctgagtagctgggattacaggcatgcaccaccacgcccggctaattttgtacttttagtagggccagcttttgccattttggccagcctggtcccaaactcctgacctcaggtgatccacctgccttggcctcccaaagtgctgggataagaggcatgaaccactgcgtcaggcctagtgctcttataaaagaggccgaaggaagcttgtttgcccctcccaccaggtgaggacacagtaggaagatggctgtctatgaaccaggaagggggccctcatcggacactgaatctgccagcatcttgatcttggacttctcagcttctagaactgtgagagataaatttattttgcttataagctacccacccagtttgtggcattttgttatagctgactataacggactgaaatgctgcctccacttctatgcctatttcctcatctgtaaaatgaggataataatagtacttattttcaaattttgttgtgaagaatgatacaagtaaattgcttaaaattatttatggatcattttgtgcactcagtttacgttggctattacctcattatactatcattataattattaacactatcattatatgctctcttcattaagatacccaaacccagagtcactattctgactctaaaaggacagaaagttataaattaaaagctaaaatcatactgcttttccaccccaatcctgggcaataagctaatcaaatgatgttgaaataaaaaagattcagttcttaaatacaatgccatttcctgtgtttactactgtagtctctgtgctatgaatagaattgtatacacatgtgcatatatacctattctgagactgaacaatttatatttaaaaagtgcttacttggctgggcatggtggctcatgcttgtaatcccagctctttgggaggccgaggcgggtggatcacttgaggccaggagttcaagaccagcctggccaacatggtgaaaccccatctcttctaaaaatacaaaaatcagctgggtgtggcggggcacacctgtagtcccagctactcgggaggtgggagaatcatttgaatctgggaggcggaggttgcagtgagccaagataggccactgtactccagcctgggctacagagtgagactctgtctcaaaaaaaaaaaaaaaaaaaaaaaaaagtgcttcctctttgtgggatgaaggaaggtacacatcagtacacgttgttgaggcacaggaatgaattcttatatagtagaagactggggaaagatgctgatataaaactgtttcttttaaaactacagattaatgtgatttggttcaaaattctgggaagaagaatgggccgggcgcggtggctgacgcctgtaatctcagcactttgggagagcaaggcaggtggatcatgaggtcaagagatcgagactatcctggccaacatgttgaaaccccatctctactaaaaatacaaaaattagctgggcgtggtggtgcgtgcctgtagtcccagctactaaggaggccgaggcaggagaatcgcttgaatccgggaggtggaggttgcagtgagtcgagatcgcaccactgcactccaacctgggtgacagagcgagactctgtctcaaaaaaaaaaaaaaaaaaagagtgaaatagttacattgaaattggaagccatttgaaactcagatacagtcatttttttatttgaacaatgacatctactgttgtctttatcaatttataaaaaaaaaaaaacatggttctctttctatggttttgtttttattttttcaaatatcctcaaatcctcaaagctactagtacttggcctgatatggacttcattaaaaattggatgatacaagttaagcccgacaaactcttgtcccaggaaataattaaaaaatactttttcatagcagcccagagagaaatacaggcccacagtaaacctggggctttgtgatattagcataacaatgggcaaaaatgagaaaacatacaggtgtattttaacaacaaaactctgtgtggaccaggcgaggtggctcaggcctgtaacccccgcactttgggaggccaaggctggcggatcacctgaggtcaggagttcgagaccagtctggccaacatggtgaaaccccatctctactaaagatacaaaaattagccaggtgtggtggcaggtgcctgcaatctcaactactcaggaggctgaggcagggagaatcgcttgaacccaggaggcggaggttgcagtgaggtgagattgcgccactgcactcatcctgggtgacagagcgagactctgtctcaacaaacaaacaaacaaaacctctgtgtgtggtatagatttatcaaatgtgcaataaggatatttgttttgtatattgagacaactaaaaggcaaacttgggtacaactaacagttaacagatcttgggctgggtgtggtggcccacgcctgtaatcccagcactttgggaggccgaggcaggtggatcacttgaggtcagaagttcaagaccagcctggttaacatagtgaaaccctgtctctactaaatatacaaaaattagctgggcatggtggcggtcacctgtaatcccagctactcgggaggctgaggcaggagaatcacctgaacctgggaggaggaggttgcagtgagctgagatcgcgccattgtactccagcctgggcaatagagtgagactccgtctcaaaaaaaaaaaaagagatcttaagtgcagcactgaggtcaaagcagacagcatggatgcccaataggccatctggattggaagatttacacttggatctatttgtaaaccatgtgcaaatcctgccttattcacatagtggaaaggaaaatgcataagccctactctagtgcacaaagaaatgattgtgtgtatacttttggttgctcactcctccactgcaatgtattaagttaaaaagaacacgatcacttccagggaagtacacgtggtacggtatttgcatgtcagccattttggaacaatcattttcagtgcagttccttggatgctgtatggaaccagctcctgccaatgatcttttcccaatttttccaaattgaagaatctgagaaatggtttttaaaaactattttttaaatttttcgagacagggtcttgctctatcacccaggtcagagtgcagtggtgtgaccatgacacactgcagcttcgacctcccaggctcaagcgatcctcctgcctcagcctcccgagtaggtgagaccacaggtgtgcaccaccacacctcgctgattttttatttttagtagagatgaggtctcattatgtcatccagtctgatctcaaactcctgggctcaagcgatcctcccagctcagtctcccaaagtgctaggattacaggtatgagacactgtgcccgaccaaatatgagacatttttatagctaagttttaaagtcttaattccagaaatgaaaagggctaacaaaccctatcaatggcacttttaaaaaacgaaattgcttacaataattctatgcgaataatacttatttttaacccaatgattacatatgtgttatgtgatttaaactcttcctgtcagattctaaaggaaacagattatagtggaaacaaatctatagagaaagacaaatatactcagaacataacaaaaactcaagatcctgtgagattttgtaatatctggttaatggaaatatgctagaaaaagcagcatataatcagtttcaggacaaaataaacctgagacttcagctggcacgtaagtgaacagagagcatcatcctagtctataatacaataattacataaacaaagagagttctctagtgtgtcacaataaaacttcccctcaaccaaaccaattcctttctgtcctaaatggtttgcagagattttgttataattagggacaacactctcaaaacaaaaataacaacctatgtatttgtccttaacttttccaagtgagctatcaaaggtataaattttaactgactttaaaaacatcattcttggcctgggcacagtggctcatgcttgtaaacatagtaccttgggagactgaggtggatggatcacttgcagtcatgagtttgagaccagcacggccaacatggcaaaaccccatctctactttaaaaaaaaaaaaaaagcagggcatggtggtgcgtgcctgtaatcccagctacccaggaggctgagacaggagaattgtttgaacccaggagacagaggttgcagtgagccgagattgcgccactgcactccagtctgggtgacggagcgagactctgtctcaaaaaaaataaaaaataaaaaataaaaaaaaatcgttcttggtcttaaagtaataacagaaagttgatggtaaggagccctgagtcagtaggaattgatgaaggccaggctcttagctatagcctgagagcctggggcattagggagatggaagcaacttcctacattcttctcctgcaatcccttcttcacaaaggaaatagagagaagctatgtttgctttagttactaagcccacttattttattgctgtcataaaaacacacagaatggccaggtgcggtgattcatgcctgtaatctcagcactttgggaggccgaggtgggcggatcacctgaggtcaggagtttaagaccagcctggccaacatggtgaaaccctgtctctactaaaaaaaaaaaaaaaaaaaaaaaaatagccgagtatcgtggcaggtgcctgtaatcccagctactcgggaggctgaggcaagataatcacttgaacccgggaggtggaggttgcagtgagccaagattgtgccattgcactgcagcctgggctacaaaagcgaaactctgtctcgaaaaaaaaacaaaaaaacaaaacaaaacaaaaaaacacagtagtcttttctagtatacaggacactgaagagattgagcagaaataaaggggcagatttttaaagggtggctatgaaacagattacagagaagagtagaaagttatcaacatcttttagattttttttgaggccgggtacgatgtctcacgcctgtaatcccagcactctgggaggtagaggcgggcagatcacgaggtcaggagattgagaccatcctggctaacacagtgaaacctcgtctctacaaaaaaaaaatacaaaaagaattagccgggcgtggtggcgggcgcctgtagtcccagctactcaggaggctgaggcaggagaatggcgtgaacccgggaggcggagcttgcagtgaaccaagattgctccactgcgctccagcctgggcaacagaataagactccgcctcaaaaaaaaaaagatttttttttttttgaaaaaaaatttaacctccattttcgctatccttttgcaattcctgcttgtttgtctccagccactgcctccgagtctctcccatatgttgctgtagactgggatggatattcttgagtgccttgtaggctgcagagactatggagaggcactggggataagaaaggtaaaatcttatcgttgcccttccactggtttatgtgatccaactgtctcaccagatgctcaaccccacagctatgttaataaaaagaactgaccatatggtggtaaaatgagatgctattggaccagagatagggaatgtttttaggagagtctgagctaaaggatgttatctgtttattattttactctcatgttgaaaaatgccttttccacttattgaaccagggataggcagtgctcttagcagagtctaaactaagggatgctagatgtttgttattttactctcatgttgaaaattcccgtttcacttataaatataaacatctttgcctggatttccaaatccttcactacctgggttccgtggcctttcagactctttactgttacccacgaagtggttctttggctggcccttgtgcctgctgctctctccgctggtcacctgtttgtgcatgtacctgttcagaccctatccactcttcaaagatgaacttcctatctatgtccttgctaaagctttctaactatccctaaactcctccggttccctctttgaattcttcttgctggtagaacctgcattagcacttttatatgccttcttacgtgattttgtaagtcatctggcctgatgaagtgataacggacagctgttaaacattaatattatagcagtctccaaataagtagttgattatttgcaagagctgagctccttggctgcaaatctcattaagggaataaacttctagaaatcagggtaatgagattccaaggtcttgggaaaattaacttttaatttgggggaggagagacatggtggagagagggatgggggtcactggtcacaccctaaatgttaacagattgactaatagaatcagaatattttcaagtaggcaggtgctaagaaggaattcaagctaggctaggtgttagggaagctcttgcacaatttaaatgaaatcagttcttccaggtaaacttacaagtgagtttgctgaaacatagtgaataatttttataaaactgtggaggtgggtgagttcctagaatgttaaagataagctcgaattcttgagaattaagatggcaaggacaagaggaagaggattctgtagttagttttgaaactgtcatatttaatgttgaatgctgaaaaatattctagtactacgtactaaaaagagatagcttatgaacacatatacatttaagtactggtcactagcttcctaagagaattgagaaagaataagtatagccaaatactttcattttcttaaaatatttttccataataaaaccagtatgtgttcactaaagaaaatgaagaaaacatagaaaaaagagaagaaataaatattacttgaaatatgatcatttacattctattatgtccttctacctttttatacacagatacatgtttaaaattttttttacaaaactgaaattatactgtgcatggtactatgtcatattctgaataacgtgtgtattaaagagattacattttgttcaattacccatgttatggatgtttcttcaaaaataatgttgttttaccaactaaatgcattagttggtaaggaaatcaatttagagagatgcaaccaacatttagaaaaaaattaagtacagaatacattttaaaaatcagattgcattgcacataagggaatgtattgttatttcagttctatgtacatataaacacacacaaatacagtttatacagtaaccatatatatgtacacacacacatatacaaatacgcacaaacacatgtatgtgtcgatcaaatgtggctactctgggcacactgcctatggattagccctgctctgcaaggaacaatagaaaaattaatattttttaaaaaatgtgtcaaatatgggtatcattaaaagaaacaaaagccaatgctttaaaatataatttttaacattcgtataacattccaacagtagatatgtcttgatacagttaagaaattcacaattgttgtactttcagattgtgttctatatttgacaattatataatgcaacaaatattttttatatgtgggaacacctgggttttttttaggattaaactactagaacttgaattactgattcaaagtgagagatttttgaccttctggcacattctgtcaaattctattcgacaaaagtgatagcaattcagacttttatgagcactgtatgagatcacctattttcttaacccctttctgatactagatgttatcatattaacaaaacacatctatttggaggaaaaagtgattgtgctgctttctgaattttacttgggtattaataacaataggttttcttttttgttttctcacatatcaatgtactgtttgtatttcttttgttaaaattgcctaagtccctccctcattcttctaatggtgtgttgctcttacgacattatatgtttgcaaggagctccctgtagaccctgtattacattttggtctgtcatagagatgctcctttattcattttaaaaaggagtttaccagatttgagcacaggaacttgctttaaacaaaagaccttcggctacgtaaggcacgcagcaggatttgcagtatctctgtgattgaaaaagagaaagatgtgcttcataactaaacaaacaatgaccttcaaagtgtgctattagggcagtggaattctgtcttcctccctgttccttatggtattttaatcagtaatttgaaagattaaactgatgaaattctgataaaatgtatgtatgatctacatatgataaccttggtttaaagactgagtaacaaagaaatacttcaaaaaattatgtaaagctttaaaaatgagctataactcacaagataaatttagtggaaagaagggtaaagagccaacatacactaaagtgaataagtaaacaatgaacgaagaaacctagcagcaaaacacaaaattagggacatgtaatctcagcacatgagaaaaaaaatccaatttttaaagtattttattttaagccccaaatgacattacatgttgctctggttgggggaagttgatgcaattttcaggttagattttaaaagttataatatatgctggctgggccatatctcaaatattgtgtttggttacgattacgaggcctattgatgaactggaacacatgtacaaagtgagcaaacagcaggatgaaagaacaggaaattattaaatgggacaacattagaagctcactttcccattttaagtgtcactcagatttaatttgctagcaacatttaagacatctttatcaagtgtttttgtgttcagcttaattttcacagaagtatctttttctttttatactcaaatttcgacaggtttattttaataaagtacttaaatgcagtatgccatatatttaattataaacagctatgggaacaaatggaacaaaacaaacaaaaatggactcttatactatacagttcaatgggtggttgcagaaatgtgaggacctaattggacagcagcatctcagctgtgacatttgtggctcttgacattcactgtggagaaagtgaagagcattggtacatctagggcagtggttttcaaagtgtggtcttaaaatcagcagcatcagcatcactgagaattggttaaacatgaaaacacttgaattggatccatcagaaaatgacttacgtagactttctgaaagatggagtccagcaatctgtgttatcatgagcactccaggtgattctgatgcgtctcaagtgagaactgcggatgtttagtaaggagagatcagctgggaatacttctatttgtgtgatgatttttaaactgtatggttttgggatgcttgtaaccaatgcggagcagagacaaagacagaataattctaatgtaatcagagatgaggttacaaatctgcatttgccaagcccctggtgatttttgaggtatggatagttggactacacttagaaaaataatgaagtaggcagggtgtggtggttcacgcctgtaatcccagcactttgggaggccaaggtgggtggatcacttgaggtcaggcatttgagaccagccttgccaacatggtgaaacctcctctctactaaaaatacaaaaattagccaagtgtggtggcgcattgttgtgggaaatcagggaccctgaatggagggaccggctgaagccatggcagaagaacataaattgtgaagatttcatggacatttattagttccccaaattaatacttttataatttcttatgcctgtctttactgcaatctctgaacataaattgtgaagatttcatggacacttaccacttccccaatcaatacccttgtgatttcctatgcctgtctttactttaatctcttaatcccgtcatcttcataagctgaggaggatgtatgtcgcctcaggaccatgtgatgattgcgttaactgtacaaattgttgtagagcatgtgtgtttgaacaatatgaaatctgggcaccttgagaaaagaacaggataacagcaatgttcagggaacaagagagatcaccttaaactctgactgctggtgagccaggcagaacagagccatatttctcttctttcaaaagcaaatgggagaaatatcgctgaattctttttctcagcaaggaacatccctgagaaacagaatgtgtccctgaggggaggcctctgaaatggccgctttggggatggctatcttttacggtcgtagctgtgggatgaaataagccctggtctcctgtagcgctcccaggcttattaggatgaggaaattactgcctaataaattttggtcagaccagttgtctgctctcaaaccctgtttcctgataagatgttatcagtgacaatgcctgcccaaaacttcattagcaattttaatttcaccccggtcctgtggtcctgtgatctcgccctgcctccatttaccttgtgatatcttattaccttgtgaagcatgtgatctctgtgacccacaccctattcatacactccctccccttttgaaaatcactaataaaaacttgctggttttgcggcttgtggggcatcacggaacctgccgacatgtgatatctcccccagtcacccagctttaaaatttctctcttttgtactctgtccctttatttctcagaccagctgacacttagggaaaatagaaaagaacctatgtgaaatatcgggggtgaatttcgcccaatagcgcatgcctgtaatccaagctatttgggaggctgaagcaggagaatcacttcagctggggaggtggaagttgcagggagccgaaatcacgccactgcactccatcctgggtaacagactgagactctgtctcaaaaaacaaaaacaaaacaaaacaaaacaaaaacaaaaaggaaagaaataaaaaaataaaatgaagtagagttttctttttttaatttataaatttgttttttatagagaccagatctattttgttgcccaggctgatcttgaactcctggccttaagtgatccccacaaccccttgcctcagcctcccaaagtgctgggattacaggcacaagccactgtgcccagccaatgtagagattttaactaagggaaagaaaaagaaaacttgagggaggtgatgtaaatcacaccttcaagcaattcactagttgtcatctagaggaagtgcttgtattactctgcagtggcttcaggaaatagaactaggattaatagctggaagttacagaaaagtggattagggaagggatttctaagagatggaatggtctgctgtctacgggtaccacatctcagatactcaggagctgccaaatgctgaatacccatttgtcactgagcctacagaaaagattcttgcaatgggctggggattggacccagggaaatagggacctctaagttcctttcaattctgaaactgcaaaaattttatcattccccagatctcctgaaagtaccttgaagatttacattttataatcagaaaagagaaagctctcccaataatcttttctatctcatgttaggaatatattcttgttagatattaatatgcctatttcaggtgaacagtgttgataatagggacttgtttttctcctttgtagtaactgagcccatgtctattgggtaatttggctgatgaaatagatgaaaaacttctttaataccaaaataaaatctgcatgactcaaagaggcaaaaaactgatgatgaactttttttcccccaggaataatagagcattctagagaatgtgctttaaatttccaacaactgccacagcctattttagtaatggcttctgctggttgaaattacaggaataagtggtgtatttaggattgtccaatgtgtgttcctattattattaggtactggccattgacaaaaacaatgacaacagccatcaaaatatggtgcacaatgaagagggcaggagattttgcccaatctgggcttgtgtacagtatcagccaaaaacatacgaaaaatttaccaaggtgtctgtagatatacacataatatatccatgcttatagatggatgcaatttagataaagatgtctaatgtattgctattttaaattgtctattttagtgtcattgctttctgggtactagcaaaaattatggaaaagaaaaaattacaaccacagcttgtcatcagtataaaaatggctttcttttctgaaagaggtttcataaaagaatgctaatgagtatatatgaagctacatgtgtctttagactaagcaagagaaaaggattttgaaagagatgacttgttgatgacccagggctgtctagtaagtggcctcacaactagaaataattaacatatgactccacttttggtggaaattaaatttggacaccataataaacccaaactttacatcaacaacttccattcatctttttcctagatacttaaaacaaatttataaaaataatgtgcaaatattaccctttagaccgttgatggaattctgcttaactctttttcattctatttgatgctgtttaattcaatgacataaattgagattgagagttgaccatctgcaaggtactgtgccaaatgttgaaatgctaagattacattacatagaagatataagtcctatatctccttgctttactgagctacaattttgtaccataatatgagattcagatcattttgaataataattcaagttcaaatatcaccaaataaaataaaagtgataatgcaacataatgagctaatggtcatatataacatgattttaaagtgagacagtgtgacatttatttttctgctgtcaagtcttccagtaaacttggttcaaaaatgttctaaaaagtttattggtgctacaagtcttcttcttccttcatttcttctattttgccacccaagtttttgttatcatctaatgtgcagatgactacagtagctgctgatgctgcaaacacatcctcctatctctagattctcctagcttgccctcatctgctgtgtagatgatgatggcccacgtgtagatccagagcacaggatatgttcttgattaccttcttctgtactctgcttctctcactggaaacctccacagtagtccctgcccgaatttgccttcttcagaccctctttcttgtgccacctttgctctgtctctctctctcctgcagggccccactgtttagcaggcaggtctcttgctaggccttaactcttcctctccctgcctactctgcactgttttaagagaagctatcatgatttatattaaggaagttcgtggaaagccaaatctgttcactgaacagttaacttgcatgagcagaatgaaccaactcaggtgcaactgttagtagtatctccaaagtagtaatttgtgttcatatctgtccttttgcaaagtataagcttcctatgagcagaggctttgtcttatctatccattctcagaacaaattgcctggcccacagtaggttcccaataactgttttgttgttgttgttggatataagaatctagtagtgcttgaatacatgggtgctcttggtttgtaaacttatcatacagagcccccaggatggtctctggctgaagcctcatagctactggcataaacccaagacttcatattcattggaacacaatactttgggaaatgctgtagaaacttctgcccctggcatatgtagcagcaggggtgacatttcccactgtggggagtgtctactcagcagccccacagcattccttaggaacccccagggctgtatcggacactctgacaaaaacccatgatacaattcagagctcacagaacttgagcagcaacttaagaactaacgatgctgccaggggaaaatgaagatatattgtctgaactcaattaggctacaaggtctgatacattgcacaccaatcgatttacatcatgctgcagggaaactaaaattgttttctcaggcaagttatcatcaccgccagtttcaataaaataagatggatagccatatctgccaactacaaaatgacaaatgagatggtttcaggtccacagcagaagaaagacgagaaaatagttcatctttgagcagacacatttcatatgcttgctggtaatatctatggtggggaaactcaatggtcagtttataaattattttcactgaaggtgtagtaggaatatatatatatatatatatatatattttttttttttttttgagacagagtcttgcactgtcgcccaggctggagggcagtggcatgatcttggctcactgcaagctccaccttcccggttcacgccattctcctgcctcagcctcccgagtagctgggactacaggtgtccgccaccatggccagttaatttttttttgtattgttagtagagacggggtttcaccgtgttagccaggatggtctcgatctcctgaccttgtgatcagtccgcctcagcctcccaaagtgctgggattacaggcgtgagccaccgtgcccagccatagtaggaatttttaagcgtagtttacctatattagtgtatctataatcccaagcaacagaatccatagcactcaaccctaaaataatatgcacaaaggctttctttaaggtaaattcacagggcagagatgtaaaatcaaaaccttccttctcgtaggttccaagtctgcttgtgtcctatgatgagtgttttgtgaagcagataatctgcctcattatgatgggtgtttgtgtcagttgaggatctgactcactctgtggagctcttaccatgcctacaacttcattaatatatatataatctagaaaaagaactttctgaatactctaaggcttgtctctactttattgtggtagagattgatatcaagggaagtgaaagtaaggacagccaagctgtcttttttaaccacaaagagtatcacataacctgacacttagtcaaaacttactacctgttgatgaatgaatgatttagaaactagaataatggtatataaaaacaatgatatcaatgtagcagatgcgtggatcccaggccaccaggtcaattttctctgttgggattatttatggggaacaaatccaatggcaagtttatatgttttctttttatttgtcctaggaccctttccaaaatagcctatttacactaatgtgcatgtaggtccaatcagtaaagtccagagtgttcagccaggagggacatgactcaatcccgaacagaaccaaggtccatcccaaacgtgccaggaatgggcagctgagggactgcccaagtagatttgacactgtactgcactgctcctaccctggctccatagctgggctggggctgtgattcccagacgtggcacctgtattattcacaggtttacactgtatgcagaggggagttcccagattatagttttatacgttttataggttattagaatatggagggaaatctcacactagattttacatttaataaaatccaggtaaggctgggcgtggtggctcatgcttgtaatcccagcactttgggaggccgaggcaggcggatcacctgaggtcgggagttcgagaccagcctgaccaccatggagaaaccccgtctctactaaaaatacaaaaaaattagctgggcctggtggcacatgcctgtaatcccagttatttggaggctgaggcaggagaatcgcttgaacctgggaggcggaggttgcagtgagccgagatcacaccattgccctccagcctggacaacaagagcaaaactctgtctcaaacaaacaaataaacaaaaaaacccaccaccaccaacaaaaatcaaaccaagttaaaaatcatttgaccagggactaaaaagtatccttcaagttttcaacagtgtcttaaaaaaaacaatatgtttcccggaaagtagctacagttcttcactgactgaagactaattggtggtggaggtctgtcattaatgtgtaacacactggttttggaaatcaggaatacaacatctgattcccaccttccagaataagttatttttccctctagtgtatgctcttgcatgaaggaaaaaataaagatacaaaagagataaaaagagataaatggatacctcttcccttgtaaatttacattccatttaaccaagcagttcaattttttatgaaaagaaaatcaatatataactttgattttattgtactttgacctataaaagcaatgaataataaataagcaacaacccaaacgtccattaatagatgatcagaaaaattacagggcatatccattcaaaagaattttgcatggttaataaatagaatcatgtagaaaaatagtcaattatttggaagacatttacaatgcattttaagtgaataaagaatgtttcaaaagaatatttaaatataattcaaattcttaagtatttatatttatttgtgcaaaatgctaattggagctgtgtctgggtagagagggtcatctagaggtgaagaaactgaggttcagcagtttaaatgattttttcttttattgttattataattattattatttttgcagagacggggtcttgccatgttgcccaggtggttcttgaactcttggcctagagccacgttcccgcctcagccccacaaagtgctgagattacaggcatgagccactgcacccggccttaaatgattttttaaaattcacatggctagaatatataggactaggtttcaaacctaaatagaaacacatcaaattccttggcccaggctctttttaccatgttaccacttatatataatctgcataaggctgtattaaccagtaattccacagtgggcttagataaatcatttaattttatttaatcaaaataacattctaaaggaactaagtgttgtatcttctttgttttctatttcaaataagaggatttacatttacatttgctcctatcaacatttaaacaattgagttacagagttaaaaacagatttcggctgggcacagtggctcacacctgtaatcccagtagtttgggaagctgaggtgggcagatcacttgaggtcaggagtccaagaccagcctgcccaacatggtgaaaccccatctctactaaaatacaaaaaattagccgggagtgttggcgggtgcctgtagtcccagctacttaggaggttgaggcaggagaattgtttgaaccatggaggtagaggttgcagtgagccgagatcgtgccactgcactgcagcttgggtgacagagtgaaattgtgtctcaacaacaacaacaataacaacaaacagatttgatcctaaagatcaactgatttcagggccaacccactcctgttaaatttctctcacggagtctccacaacttctggtcattccttgcagtccccagagcacagttaggagctcaatccaccagcacaaatacaccaggacagagagaacgggatagccaaggaggcatcatcttttttctattgattcttttaaagtctctacagataattgtcttcattaagatagagtgaaaatattttcaaaaagagataagattaggtgactccctgggtgttcaacatcaatactttctaatattcatttttacttttctacttttgtagcccagagccaggctgatttaatttccacttcacacaaagacaaaaccagtgtgttacacattaatgacagacctccacaaccaattagtcttcagtcagtgaagaactgtagctactttccgggaaactgatattgttcacacaaagacaagacagaaggtgagtcacacagctggcacttgattatgaatcttgattgaaggtgtggctgatcagtcatcctaccctgtttttcctttgttttctatctgtccctccttaatgtttgcatagcagacagatgctatggtttttcttatcttatcatgttatcttttcttattttttcagacagagtttctcttttgtcacccaggttggagtgcaatggcatgatctctgctcactgcaacatctgcctcctgagttcaagcaattttcctgcctcagtatcccaagtagctgggattacaggtgtgcaccaccacgcccggctaatttttgtatttttagtagagacaggctttcaccatgttggccaggctggtcttgaactcctgacctcaggtgatccacccgcctcggcctctcaaagtgctgggattacaggcatgagccaccatgcccagcagatgctatgatattttaatggctgaaaaagtggtgtcagatttgatgatggtgatgaagaaaataattttcataattcttaaagcatatgaacctttttgaaagagaataaagtcaacttaataacatttaaaggtatgagaggacatagtaacccttggaagaccaaccttaagagacttctctgatagcaagaaaaataaagaaataaaagagtaaacaagacatgaaaaggagctttcttgagacaacaaaccccaatgcgggcattacacaaatgtgagttatttttctcctacccattttgggattaatgaaaagaataagaataatctatgaagagtaatgaatttaaagtaaaagaaaaagcttgcttcgagttccagctctaatgctcaacagctggaagatattggtgaaggtgccctcacctcactatttccccatttttttgtctgtgaaaaaaggtgatacctgcctgactacctcccaggattgttgtgcatgcaaacaatgaccaaaacaacaacaaaacacacaaaaaggagtctatattttttggaaaattgaaagtgcaatgcaatcctcagctgtttattataatttttctctaaagtgctagtaagtatttatgaatctgggtaactaacaaaaactcccctgcaaaagctggctagcaaaatatttttgtctctggggtgaaacaaaaacaacaatgccatttttctaaccttggttataaaaaccctaggctggaacatgtaaatcaacttacaaaaataggcacgcattggaaatggactcagactggggaggtgggtatcatcaggtggcaaggtttatttattttttgtcagttgggagaatgtcaaagagcagggtggatccgtggaaatagcactggggaacaaaatacatttggagtcagtcccagctccttccctaactatgtgactctgggcaaattatgcacctcctttgaccctttaaatttcttacctacaaaatgggtaaaataatggctataataatatctaccttacagggccagcatatggattaaattagataatattataaagcgcccagtgcagagcctggtacatggcagatattcaatgaatgtgagtttttccccattattttcctagactacatatttgtttactattttcccctattccatttctttcttggatactgttgaccttgtagcctccctgtatgtaccagagcaacctgtgtagaggattcctttaaaatatttacataaattccatctttactccagtaagtctatctgattataataaaatcactcattctttatcttccattaaattattttattgatcctataaaggtgtctcataaaatttagtatgtaaagatctaagatgcttgatacagctgccgaccatgaagttataaaatacggaacactaaaccaaggggaaattcagagaaccttttaatttccttactccatttcttcagaataacacccaaataaaggtattaaataaaaaagattgcattttattttcctggatggaaaaggattaacactaagcaacagtgtctgaaagttattattatggtttgtgtgtgtgtgtgtgtgtgtgtgtgtctatgtttgtgtgtgtgtgtgtgtgtgtgtgtggatggtattcaacttcttttccttcagtaattccagttgttttttttttttccacttctctttaagaaggtggttgctcttcttggtctagtgaaatcctgcaaattcagttaaatgtaacttctgggatttctcagattacatatgggccctccctcctcaccctaacacccagtagaaattgtttatctttcccttgtacatcctaacattttgtctataccattgggtacctttgagatcaagctctaccatggatatccaaccttttggcttccctaggccacattgcaagaagaattatcttgggccacacataaaatacactaacactaatgacgaataatcttaaaaaaaaggtctgtgcataatttttataacatctaccaccacagataagcaaaaatgtccttgcattcaaagggttggacatggctgcaagtctatactttctacatggtcccaagacatagcacatggtttagaatagaggtggcaattgtgtgaattttgattgaaggtgtggatgatcagtcctcccttccccttgtttcctgttggccctttcttaaagtttgcagtgtgtgaccatatggtactattttaagagtttgagaagtgggttagatatgatgttggaagaaggacaaccatttgacttcccctttccatcttccccaggttacatcactattttaaattatatcacagaaatttccattgtaatttcaagaacagtatattctgtcagcattacgtttgaaaaggattaacttgaaatgcttcttaaacaatacacagagtacctcacattatctgatagtcactttctccagcaaaatcttggagaattgtttgacattgtctttattgccccatggtgacttatgaggcatgcttcagaaaattctgtattaaagaacagaggttccaatagtgccagccaaaatttcataaaatttatttacaatgtgattaattcctggagtccatcattctccatccctttaattcatgcaatcacattgaatgttcacagtatatattactgttcaaattctttcaaatactctgtgtaccgttgcaatggtaattcacaagtagaaatgagtaacattccccaccacaaggatccttgaaggaaactgaaaacaaaagccattatctttgttgaatccagtttgctcacatttcaacacacataactccactgaactggccatcacagcaaaagccacaacacacacacacacagcagcatggagctaaaccacacaactcaacagacaatgcagacaaacttgagtataaaccaagatttttctacctcttttcataacaggttagtgctggccctcagtgttggtgtacagtttttatggcatgggaaaatagggatgtttctgccctataaaaataaatgtgttgaaggctttagtttgagcttacacaatgtcagaaagttccaaaggcactggcacaatacaaaaaaaagaatcttacaaacaaatatatatcatcaaaacacatggcaagatactaagaaaacactggtaggaaaactactggtttctcaggtgatttatgcaacagttttcaacaccttcctgaaaaataaggaataagaaaggcaggctagtgggtctctggtggggcatatcttgtcaccaaccaccactcatataaaatctttaattttaaactgctcagtagatcattttctctctgcagaagtaaaacgcatagaaccctcattgttcttaacattttaagcctcaggaagggctaagggaaagagcatagaaatacatgcactatctttaataaagaaaggaatacaaggaataaaaataaaatataaagaataattattattccttccttttatatgttgtaatataaacttctttccaaactttaattctgtacagataacttgttcatatataacatctttttctactttggaaagggatgggacagaaagataagcagaaaacatgaagttctgaatttgaataaaagaaacacttttgctgttatatcaagaatgcaaggtgggtaacagggctagaaatagggaaattggaaaaatttcattggacttaatgattcataattcctcaaaaaattaaacttaccacattctgtgcaaatttttcaaaagatgttctgcgatccattgagtttccagacttacgtatgtggggtaggataggatgaagggaaataagggaagattaaaaaaaagaaagaaagcaaggaaaacagagcagaaaaagacaggataatgaaatgatgcaacaccaaatccatgttctaaatcagaaggcccatagaggttggagagccgccaagggaggcttcttctcacaggacatgggctctgcttacaccaaaaactttccttgtacaaacaaaatggtgtgattcaagcaaaatcaaattcagccaaaataaagtggatatgtgaagcctttatactgacatttgcagagcctaaatatttaaaaatctagcagcatatcctcagaatttcctcaaaacttttatgagaaaaaattcctattgacaacatcattaattccatagagcattaatgtctaatagaactttccaaaaggatggaaatctcattctatgctgtccaatacagaagcccctagctgtggttactgagcacttgaaatttggctagaatgttatataattttaattaactaatatttaaacagtcccacgtggctagtgactgctgtactggatagtgttactacaaagtatccatttctagttgtaaaggcaatggacttttaaaaatcttattagcctacatgacgatcatgaactacacaaaattataatttaaactcagagtttcaagaagctatgaactattttaacattaaaaagaatgaatgacgttgatgtttatgtccagattttctcttccctgttatattgattacataaggagttatgaacagagagacattgattattaacattgttgaataatgaggtctactacaatacccccataatgtgcttggctaccatgctaggtgtataaaattcatcacagggatattaagtgattcaggataaatgccaaataaaaatattcggaagcaaacattccgacattttgtcatctattattgaaaaaggtgagtctactttcagttatgaggcctgtggttcaaaacatacattctagcttactaaacaaagaaacctctcttcaagtttttgacctaatgactttgttactttcttttctttattgtaattttgattccatgaaactaggcatacagaagactaacatgaaacatgaaaacagcttctaataaattttgcaaagcatgaacatctgcagaaacaaacaaacagaaagtaatacaataagcaataaacaaacagaaacaacttaaatggcccttataaaatgcaaaggtttgggggagggtcttggagtatgttcacttaccattagtccaataccctggattcagcagaggtaattactccaaataattataactgagaactaggccaagaaaaaacaactcacaaaaaaccagtacctttttctttgcctgtagaagctcctgataggcactggatcttataaaacgtgggtatgaatcacttttcatcagtttgtaaatgtgctcctaaaaagaaataatggttgaggtgcttctttatgatttcttgggaaaagtaaaatatcatgatgtcacacatggctaaagaacaaatctagtagcagcgaaaaatagtaataacaatgctgattagaataccttctatttacaggatatttagatcttcaaattcattatctcattcatagatcattgtttaaattggtttaggagctactgaggaggcaaatcacatccagtcattacaaaaatggaatttgattaataaaatgtcataaaattacctcaaatcaagttgttgacttatatagatcactagagaatataactaaatttgctgtctcttaaaactactccaggcctgaagtgggtaatgttgactcagactgagtaatcatcctggatacctttggcctctacatttactgggagggtgccaactacccagaagaatcaaatcatctctttggtacaaattgcatggaaaattgtcttccatacccactttgggtcagagcacaagtccaaaaataaattttgtgatatttaattgctaaatctccaaatttgtgtgctctttcttattacttacccagtgacagattaggtaaatagttgatcatttgcccctaagaagtttgcaatattctgttttgatgatgaattttgatagacaagtcaaaaaaaaaaaaggaaaaaggtactcattcaattcaatctagacccaatctagggaggttccactctggtctaccgcagctcagggagctaacatgtgccttgatcttccaactctagtgaaatatcagttaggtgtagagcttggaactattggagagcattctgaatgttccagttttcttttctttctttttttttttcttgaagaaaatagatgtttcaagaaatgactccagttctctggtcttaaacacaacagcaataatttgaagttactttaaattcatttaaagacattcaggattaaatctcaagacttagcccaatggtgatcttcaaaggatgttaagtttggaactgtatgggaatttgtttgaaaagtagagcaatggctggttttggagttaagcattttgagattcacattctaccttgctcaagaactaccacttacaaatgggataaatataggccaactttttcatctctctgatccttaattttctcatctataaaatagcattgttgtgatgattaaaggaataataaatgtgtagcaaagcatggggtgtggatagtaagtgctcaaatatacttgggtatatggcaggtactcttttaagtgctttcctgtattagttaatataagccttacaaaacccctatggggttggtaaccattatgtccattttacaggtgaagaaactgaggcgtggagaagtggtcacagagcagagctgaaatcagaacccaggcaatttaccttacgatcagattttttttaaaaaccacaaaaaaaactagaattaaatatctgagcttaactgaaaaagaaatctagggccaagtggtattgttttctatagaatttttttttctgtaagaaaagaggatcctcttaggcaagaatatttttaaatgacaccgataactaaaaaaaattctattttaaacctcaggaagggcattccaaacattttccacattgttggctctagaaagatgctcggcattttatcttggactgaaagaaagaaaaatcagcagagaagtgagcagcagggccagagtttctggcctgctctctgtcctgtgtctctctagagtgtaattatttctacattggagaccatggctgaaccacatgggataggtatccagttagctgttaaaattcatgttagtttactacacagttgctgatttctttaaatgaaagccaaggagaaatatattttctatagagagtggaaataaggaaggatattcgtgtatctcattcttcatcttctatattttattttagtaatgtgtgttttttaaaaggtactttttagaattaatattcttctccaaaagaagtttaagaagttatgaagtatgcacgttctgatttaaaaaccaacttcaacacatcattagggagtgggtgcagtggcttatgcctgtaatcccagcactctgagaggctaaggtgggaggattgcttgagcccaggagttggagaccagcctgggcaacatagggagacccaccctgtctctacaaaaaaaaataaaaaaaaattagccaggcatggtggtgcatgcctatggtcccagctacttgggaggctgaggtaggaggattgcttaagcctgggaggccaaggctatagcgagccatgatcatgccactgtaggtaacagagagagaacttgtttccaaaaataaaataaaataaaataaaataccacattattaggaaacactatcccctcattacaagtttatttttcttcttaagtttcaacattttttgagagaaggcagaaattcaagttgtttctacaaagggaattaagatccagtttgagaaaagatgactgaaaatttgccttaggaagttagaatcagttttccttattttttctttctgtaggctaaaaaattaacttgaaaatttaagaaatgtcagaatctaatgtttgattttttttttcaccagagataaaactggtttgagtttgacataactttaagctaattcagtttgaataatttataataatgaataattcaggaatgtcagagtcttagaatgtctacattgaagatgccttaaagattttaaatctttttaaaaaaatgttttaaaaaatcttttactgaggtggggtcatcattagatggtgtttgctcacttactggggggacaaacagagtagaaaatgaagtaaaagttgtaaaatatttcaaatatgccccttcatataaaaatattcaaacttagaaaatattcccaggttttaaaaaaactattcagtttaatgtgtctttgttccttcctagatcagttagagttattttacagttatctaaattgaaaatgttagaaatagctgccatttagaatgaaaataaaatgaatacatctaacgctcaacttctcggaagcacgtttgtggtgtgaggctcaccgtacacccacctgagcatcttcaaatgtgtatcgtccaggttccttcacgttctgtgtggttttgtcataactcttggaatccaagttaatagcactgggggctccgggagccagaaactcttgccatatttcctgaactcttgagggtacttctttaataggcctctttttcaggtcctccactgccagccagaatctatgcagaatgtgagatcgggtgtttactctgatggcccatcatctgaaaattcttgtgacatttacggatcatgcagttcatcatgacgactcacagccagctcactttctctgagggcttccagtatcagggtggtactgactgtgttcaaaggataatcttctttggaagattattatgaaaaataattattaataaaaatataaaaatattaataaaaatattttaaaaatataaataaaaaatattaataaaaatataaagaaacatgaaaaactctctcttctaagtgtttgttgttaaaagcagatctgtcagagccccgtataacactgattttacctaaggaaagtagcacttctgactgttgattgaaaacaaagaggagtttgaagggaattaaaggtgtgggacatggagcctccaattgggagataaagctgtgcattacactgtgttctttggatgttctgtccatttcagcaatgggggctagtatggagagccttttctgttctaggtggtaagggaattacaaagaagctttgctggagttaaaagaggcctggacataagatcagaaaatgctctggctggaaaaataaaaacaattaactaatgttaaggtaatttaattgagagagttatggaatgaccaaagcagcaagctttcacatggaattatttgaaaagttgaaatgtgtagaggcatcattgcaattcagaagccacggaataatatatactgacttacttctgaagatagacttatttataccatatgtatactgaaagaacctgggagtgtgttttggttgataatagcaagtggtaaagtctagtgagaaggggccacattgtattaatcggttgcatttcttcaatattttgctctaggctagagcttgctggttagatctctagaaataatgtttaaaagataaatgagtatatcataatttgttaatagaaacaaacactctactagaaaaaggagctgctaggactgtgttatcctccataaacactcttactgctctaatagtagacgaagtcaaagaaaggcaaagagggccacagagacagcaaacttcaggctacagagtcttaagagaggcacaggtgatcagcagtaccttcgtaactactaagctttaacttgaccattaataaataatcagaaatcagtaatgaagtgcatgagctagaattagaatatcaactactactcagtctagtgatttttgagttttcatttccagattttgtttttttatagatatatgtagcagaggataatctaagtttgacaacgcctcaaacaggaaactaccaccatgacttttagaaaggaaggctcaagacctttccctcttaaaacacagatttagacactgtgcactctaataggaatactatgcgaggctgggcatggtggctcacgtctgtaatcccagcactttgggaggctgaggcgggcagataacctgaggtcgggagtttgagatcagcctggccaacatggtgaaaccccatctctactaataatacaaaaattagctgggtgtggtggcgaatgcccataatcccagctactcgggaggctgaggcacgagaatcgcttgaacccggaaagtggaggttgcagtgagcagagatcatgccattgcactctagcctgggcaacaagagcaaaacttcatctcaaaaaaaaaaaaaaaaaaagggaatactacgcataatccgagggagcagaagtgttgaaattaacatatgctcaggcaagttcatgccagcacactctgaacacatcaatcaaaacagtctctgtcctcaaagaatgagtagagaaaaagataaaccatttaattggccgtaacaccaggaagtacatgaatggctctctaggaagagaacgaactagacggtctgggaaaggcaagcaggaaagagcccctctgctggggcaagtgctggattggaaaagggggatctagacaaagctattctaaatccagtgacatctgaaatgggcctggaaataagcataaaatataaaggggttgagaagttaataaccacacctacactgttatgtaagtgcaggcactgctctaagtgattcacctatattaactcatttaattcccacagtaattctattaggcaagttctattatttccctcattttagagaagaggaaactaagcatatgaagattaagttgcttatttaaggttgctcactattactgtcacagctgaggtttgctcccagaagatctgcagcagatgacatgctcacaaccactccctcacacggtctttctaacagcatcattgcctttcttattctcaccattactgtaattattgtaatagcttaatagcatggaggagccaggtgcaatggcttgcacctgtggtcctagctactcaggaggctgaggtgggaggatcagttgagcccaggatttcaaggctgctatgagctatgacagtgtctctgaactgcagcctgggtgtcagagaaagatcccatctctcttaaaaaaaaaaaaaaatcctatatcctttatataggtggaagctaagtaagtatttttaatgtctttgattcttgatttcctcatcagtaaaatgggatgataacgcctatttcactgggtttccactggattaattggtttccattggattagttgattaaattaattccgttaatgtatactaatgatataaattatatagaaggcactgaaaagtacttggcatatttttagtcactcaaagataaaaactcatgatattactatgttttcttagcacttgctctatgctatgtgttttgctcaaaaaaaagaatgagggaaatacatcataaaatttcaagtttctgctctctattagggagagcagagggtatatttgaagcataagtagttatcgagaaacagtgcttcttatttttttcctgtcctaatatttgaaaaaaaatgctcagacgagtgacacactcactgatagcaggagggcagctgtttaggtaagatgcacggagagttattttattttaagtgcaattcacagccctgttgaccactggaccattttgtctccttcagtgtgtgacacagatatgtcagtggaagcagagtagggctcagatttggggagcagtggacagtagcttggtactggtttgtaggaaaccaagaatgccacttacatgcaatctgacctccttagccacactttctcggcttaaccttcctcagccacgcttttctcatctataaaatgaggcaatatttacattttatgttgttttggtggttggatgtgtgatgatcagaaataatgaatgcaaaatataacagcatacttataaaagtagtagatataaaatatattctggtgtcttgtaggtattcaagaattaatctacatctttcatttatctactgatctatacttactaaggaaacatatgataggcaatatagtagatactcaagaaatatatgtatatgtgtgtatgtatataatgtgtgtgtatatatataagataatctaatatttcttagatataatcacttagcctagagtctagtacggcatagaatgattaagatatgaaatgattaaagcttgaactaagaaattggcaggaattcaattcatgcctgaaacctagtatgcacatgctatcctctttttccaaaggcatcttctctcttcctgttttgatggtttatctcctccccattgtccagctcttagcctagaagcgatttcccctagtatcccttcgctgatctctaactctgggctaggcatccctctctgcttctcccaactaaacacccatgattttgtgctgtgatttgttttcttgtctgtatctaccaatagactgtaattttaatgagagaaggcgatgtttttatttggctaggtgaggctggtaaggcttattacttatttatttactcatgatgatacaaatgatatcagcatgttttcaaaaacttagagaatgagaggaatgtccatctccctagccactaaaatgcctcaaggatcctttatctctgctttatttttaatgcattctttttttttttttttttttgagacagagtcttgctctgttgcccaggctggagtgcagtggtgcaatctcagctcactgcaacctccacctcctgggtttaagcgattctcattcctcagcctccccagtagctggcactacaggcatgtgccaccatgcccggttaattttaattttaattttttgtagagatggagtttgccatgttggccaggctgctctcaaattcctggcctcaagagagccacctgcctcggctcccaaagtgctgggattataggcgtgagccctcgcacctagccttttaatgaattcttgcactcaattattgacaatgtgacctaatatagaaaatgttattagtagtctcaatacagaactttagcaactttagcagcaagatcttgcaaaagcccaagcatgaagggttcccataaactggaaggagaataggaagctgcatgccagcaatccatgccaggcacacacagagagttacattcctccgggttctgtctgtggtcattttgcttcatccatgcgacatgtgtcagcgtcctacatctttctgaatggtttgggattcctacctgttaaatctcctgaaaagaacgtgaccatgcctggcactacttcgttccaatgaaaataaatgaatgcagagaactttcagtaaatgaattttacaggactgcataagtcatggaaaagtaaaaattgggcatcagctttcaaaagaataatgaatgaaagaactcatgaaacaacagtcttatatagtggaaagttatcactcccttcaatgatgttaaatagagctattaaaatccactctaatgtcttatatttaaaaatgcaattttcagatcctccttatgttagcaagttttaaaaatatataaagatgatgtttacaacagatgggcagaatgggtgtcactctctcacgaacagctcaatgctgtgctgctctcaattgccctgtggctattatttaaacatgcaaagagaatgagacagcccaatagtttggtttcaagttatttgatatagctgcccagtctcttcttctctaacttgcttgagaagtgatacgcaaagatagtcaacaatgacaaataggtgatattttaattgaacttcataaatgttattggccaatctccactttgccaaacattgttctctgtactgcatttctttacagagtccatttcaaagccaccaaatttgtatagttaaaacatctggagatacagagacggcgtaaaaataagttataagaaattgatacgttggacagcctttgccttgctatctcttttcccttcattaggtggcagaaattcaatgggttcatgacatcattatgatgttagtggaagaataattgatctattacctccaaaataaccagacacatcacagacagtatttctctggcttataagatccaagcaatgtgttttaccttaaattttccgagctgaattctgactctagaaatttaaggaactgttctctcccaactgggtctttcaatgcctcgtccatgccaaaaccccatcgttttaccctctgctggctcggttctttgctatagaagataaaacaaaggcaaatacattcctttcattagaattcccatttttttgttattacattccccttcaaaatcatgtgtgcctcgaagttcccatctttaccttttctttaaaaatatatatatccgattaacggctctgcatgaaatcatcgtgtacattagtattaataataaagtctaacatttattgagcattatgtgccaggcactttacataaatggtctctttttgtttttgccaaccactttatgagatagccactattaatcttattattttccagatgaggacagtgaggcacagtattatcacttgccaatgtcaggcaagtaataaggggtaaagatccagatattctgaccccagtgccacatttcttttttcttttttttttttttgagatggagttttgctcttgtcacccaggttggagtgcaatggcgtgatctcggctcactgcaacctccacctcccgggttcaagagagtctcctgcttcagcctcccgggtagctggtattacaggcacctgccactatgcccggctactttttgtatttttagtagagatggggtttcaccactttggtcaggctggtctcgaactcctgacctcaggtgatccacccaccaaagcgtcccaaagtgttgggattacaggtgtgcgccaccatgccaggcacacatttcttaaccactacgccacacagggtcatgcaggtatattgaactggggaaaatgcattggtaaccaaaagatctcaatactagctaatgattctggtgtcaattaaatctgtgacctaatcccaactgagtcacaacattttggggttccagctttctcatctataaaatctttagcttgtggaggaagagttctgggcatgtccagtgtttaagattcatggctggatgcaaaagtgagagagaccagaaatgcaatctagagaactgctagaagtgtgacagagcacccatcttttctttgtaaagtgatacgccatgatcctcttatgagtctgttaagactgatgatgtagttctttccctagatagctcatgaaagaaactatggagtcctaagtggtgctttgcttttcttaggaagtgtcttgccagtttctcttacagtgtctatggtaagctcattctgtcttaaaattgaatttataaagacatacttgtgttgggcttaagtatgtatggctttagcattcactttacttgactacatgagactttgtggctacgtgaattttccaggaagataatagcaatgagctaaatttcaagagctgaagatcctaactctgactaattgcacctctaattttgggacggtctttccagcaatgcaaatcttaatgcaaatgcaaatcttaatgcaaatgcaaatgtctaagtttcaaaagccatgatctcgaacaagaatgttagatataggccaatgtagataaagaacaaaattacattcacaattagccaacaataaaatccttcccatttcactcagaccctgaaataaagcaacatatgggcgagaaagataaaatgccacctaccttgcctcaagttcccagaaagtggtgtcatcggacagccatgggttagaagggtcaggtggcaaaagaaacgggtcgtattctaaatactgttccgtgtaacttagtagactaaggagaaaaaacatttccagtttctttagttttctgactggggttgcagccagtccaaagcagggaaaacaatataaaaatgtgggaccaaggaatccttgttcacttaaagcatgaaatccaatggcaatcttcacgcttcagtaactttcatgcaacaacttattgtgcttcttggcagacaactgtggctaaagattccatctctacccatgcctaagccatgtaaatcagtatcccttggttaacatgaagcactatggaagaggtcagtgtgtgaagggcaccgctaagagtcagttccaatctttggttaatcagtccacccacagcagaacagattttatacaactgagagaagggcttaaaagggaaattttgtcaaaagtatttacaggaattaagtaaaatgggagccactgacaagttttttaaatgtatataaaaattttaaaaagggagaagggaaagaagttggggaggtaggatttggcaatgcccaaaagtgaagaatatgaatggcattaagaacagatttaaatgaagcaaaggaaaatatctgaaatttgagtttcattcatattctgaagtcaggcaggaacagtgtcaattgtcattgttaaaataagtttatagagaggctccagtttgcccaaaggtcatcaataaatggaaagtttcatgtcttccagcaggagtgaaaaggctagactctgcagaattatcctctatatctgattcttagtggaacaaggactggatgtctagacatttaagacaattataatcattctgtcatttaaactacatcaaaagagttctttgaaagtttttctatgtgcaaaaaggaaaacaaaatcacattacttacaggattccaattatctgtcccaactcctgtccccacagttctctttcatttttaaacacatgtaattgtcatatgaaattttaaaatttatacagacactttgaaatactcacctgtcagcgacttttgacatttttaaccgatgtctatctaactgtatttgccaatattttatctgaaaagagggttagagaaggagttacataagtaatgacattttcacaattttccactctaaatcatgatcagctgggcaattctgaacaagagtatagtctacgtcagtacaatttcaaagttggttaaaaaaatagaagcagagggctcttaaagagttaacaaaatgaaatgttggaatttgaacacaattgatatcactttagaagagcaatgagtttgaccattctgcctactttaacaaaatgtgattttattttaaaattgtagagattttgctgggtgcagtggctcatgcctgtaatcctagcactttgggaggtcaaggtgggtggatcacttgagcccaggaattcgagaccagcctggccaacatagtgagaccctgtctgtaaaaaaatatatacaaaaagtagccaggtgtagtggtgcaggtactatagtcccagctactctgggggctgaggcaggaggatcacctgggactctgaagcagaggttgcagtgagctgagatcacaccactgcactccagcctgggtgacagaacaagattctgtctcaaaaaaataaaaaataaaattgtagagattttaaacgttcattcatggtgaatacctaaatccagaatcatacttccctccaaatttagaaaataaatgtatttattactataatttcaaaataaatcctatctcctaataccaagaaagtatcaatgatatgtgttttgagaataattttatcaacaattcatgacaaatgctcacatggaataatcacacacagaaaactttaattaaaaacgctctgaatgacttttccttcctgattattgtaaatatactagaaaagtatattttacactcttgataaactatattataataaaatatcagaggaaaagagtcaaaatgagaataaagccccataactgaaccaatcatgagattatttgatttcagacactggagtttgctttgaaatattacttggagtcaacaccattgatcaaatgctaaaaaaaagaggtagtgtatagcatgactccatggctgtacgccagtggtgataagaaaaaacttcaagaggtagagagaaatcagcactgcagaaagcgagagtaagcactcttgtgaagaaaatgtcctatcattggatgtgggaagtgtgacaatgttctcaacctcttgtcctcttactctttaaaagagagctttggagtacaaagtaactattgatgatggagtcacttacaaatcagcatatgtgatttttacaattggttagaggaacaaggatttgggtaaataaagagtgaggggttttgaaaaccattaccatatattgatacattttcaagtaattacaatacttaaaattacaacattttattatcttttaactgcaaatcttccacatgaaacagtcagtcatacaaataacctataaaaatacccactattaacatttaccctctggttttcatagctgttactctgtaaacctttaacaggtcatctcataggttgactcacctgttgttgtaactcatcttctgttggaggtttagtttctggtgtgggtgtgtgggtaggactgtgacttctaatatcattttgtaaaccatagacagactatattaaaataaaaaataaacattttaggacaaaataccgtttacagtcacagactttctaaaaagtaactctagcataaattcagtaaggtctctcaaagcttatttgattaagcttcttaacaaaattcaaaaggcactgctaagataaaaatcaaatgcatataaaatagaagcacagctcggaaaaaatgtgtagttagattattaactttgacagaataattggttatatgtagagagcaaggtgcatgtgataaaatttgagagcaagctgggaataccaagttggagaatgtcaacactaactaacatttcataagcattgatttaagaaaatagagaggtggatgaagaatagaataggaatgcaataactcaaaagaagatttaaaaataactcgatattttacataggaattaaatggggcactgaggagagtgacaagtcaagaattctattgctgatttgatttctgatggtgcaatagaagacaccagggtactcctactctccatatcaacagtgggttatttacttcacaacactagccttgccattgggtgccatttgcaaacatcagtgaccccagaggcgtcatgcatcttcggaattctcaatacccttgtattttttaattaacttgtcaaaaggtcagacctactacttaggaagactcttttttgagaaaggcccattgcttagtaagtataaataaagatctggtgactaaagggataaaaaactatctgtaactgactatgagacatctcacgtgtcaactcaaggaagaagccaaattatttcttcttggatatcaaagtattattcctttaaaataaagaatttaatgtgtgttattgagcactttttctttggatatgagcaagaaggatgagggcataataaaactgcatgagctccacaaaattagtaccagataaagtttacaaagacacttttgaaattagatgaggttagatccagatgcctaatgatgccaattttcaggcccgtcaccaagcttgccaatatctctaaattcaatgtgtttttattcctgaactgctttcacttggaccttaaatccacttaacactacgtcttgactctgtatctgtcttgactctgtatctgcaccttttggatgtggttttgcccttgtgtctcccgccctccgtcctttttatttttatttttttgagacagagtctcattctgtcattcaggctggagtgcagtggcgtaatcttggctcaccgcaacctccgtctcctgggttcaagtgactctcttgcctcagcctcccaagtagctgagattacaggcacgtgccaccacacccggctaatttttgtatttttagtagagatggggtttcaccatgttggccaggctggtcttgaactcctgacctcaggcgacccatccgccttggcctcccaaaatgctgggattacaggcgtgagccaccgcgcctggcctccgtcctttttttggtgctcttatcctttctttatagattttaacttggacttaatcattggaataatctattcccagactatcttgggtaggcctcttcagtgtcctttcttgccctaccaccagaaccttggaacccaattcccatcactgaggatatccatttcttttttttctttttttataatgccaaacaagaggcaggaaatggccatccatttcaacacaaggatttgctcatatgctttgaatttactctgaacaggacggagctgaatgtcttaaactagcccttttatttcatttattttttcactcattcattcattcattcaacatttattgaacacttactatatactagatatagtactaagcattagggaaatacaaataaacaaaatagatgtgcttctttctgcactgggactcacaatccagtggaagggaaagaagttacacaggtaattacacaaataaacatatgactaaaaaagggagcagtattatgaaacaaaaaagaataacaagcatagggcctggaatataaagtgatttaatttacactgaaggaatggaaatggcccaaactgatactagccatatttgaacatgattaaataaaacaaccttctgaattctgaaataacagtagaggttgatttcttaaaaattatgtgttatatacataatggaacactattcagcctttatagaacaagaaattctgtcatttgcaataacatggatgagcctagaggacattatgtttagtgaaatatgctaggcagagaggtctttaccatagaattacacttatatgtggaatataaaaaagctaaagtagagagtagagtgacagttaccagaggctgggatagggggtgaggaaaagaaagctcttggtcaacgggtacaaagttagttagttaggaggaataagctctggtgttctattggacagcaaggtgactattgttaataataatgtattccatatttcaaagtaactaaaagagaggattttaaatgttcttgccacaaaaaggataaatatttgaggtgacgaatatgttgattactctgatttgttcattccatggtatatatgtttattgaatattacccgataaatatgtgcaattattatttgtcaattaaaattaggcaacagaaagatcaccaattatataatagttctacctttcagtatctgctagtttttcaactgtatcaccttaatttttgagaagaaaaataaaaagactctgagacttgaagtttccattcttttttaacttggtttaattatttaaagtttttaaataataatctacaggtcatataaacagtgcttataaaaaatagctgatggttttaacagtaagtttttaggcgaagattaaaaaaataacataaaagactgctagaaaaacacagcaatttgtggtatcatgaaagtaaaatgatctataagttatcttttatctctacatttctataatgatttcaacatttatgcatttcctgtaaacttcatagaggtccgatacgaggccgggcgtggtggctcatgcctgtaatcccagtactttgggaggctgaggcaggcatatcatgagatcaggagatagaaaccactctggccaacatggtgaaaccccatctctactgaaaatacaaaattagccaggcatggcggcatgtgcctgtggtcccagctacttgggaggctgaggcaggagaatcacgtggacccaggaggcagaggctgcagtgagccaagatcgcaccattgcattccagtctggcaacagagtgagactccatctccacaaaaaaaacaaaacaaaaacacaaaggtcccataagagaccatgacccaaaccattgggaggtgttgcttaaaacatcttccaggagcctggctacttgctctgaagttactgcagagtttccatttcttgtcttacgtaaaagtcaacatcaggaagtctccctttcaccaatctgagtactgttcatttcctggggatagtgatagcgtttaactttgattgttggctacaatgaaaacagccgagaagaatataattttacatatggggattattttatggacaaaggaggcaaagagattaatcctattttggcagacaaattatgaaaattatttgcaatgtaaaaggctttgcatgttttagaaaaaaaatgtattcaaatcgtggtacagggtggggtggcatagaactagaaacaggtaaggttagagaggaagagaaataaaatctcttaatgtcttaatatttgcagctggggaaaatcaaattaactaattgagatccatttttagttttaatagcaagatcatttatttgcaatgctttggcttgattaacacgttcctttattcctatggtgctaagacaagcactttttcatatgcagtgccatctatttattcattaaataaaatagattcggcctcctacataaatctgttcatgtgtgatttcccttgacattttagaagagaactagaaaaattatcccgtttttttttttaggcagggggtgggggtttgctatggtctgaatgtttgtgtctctccaaaattcttatgttgaaatcctcaacccctaatgtgatggtattaaaaggtggggactttgggaggtgactaggtatgagggtgaagcccttgtgaatgggattagtgcccttataaagaggcctgagggagctcgtttgccgattccacgatgtgaggacacagcgagaaggcaccatctttgaagcacagagtgagctcgcgaaagatattaaatctgctggtgccttgatcttggacttctcagactccagaattgtgagcaatacatttctgttgtttataaattacccagtctaagatattttgtcacagcaactcaaacagaccaagaactaagtcagagacagtaaaatagaaaccacaaagtacaagaagcctttctgtgtttctatgtgaaatgtaatctctggggcttttctgactgactggtgtggtagtatttctctttctttcacggttgctcagctgagctagagaacagattgtgaccatatctgacacaatatggaggaagtcagtacacagaaagaagcagagagaaggcaaccagagagagaaatcatgagagagctgggtcgactcacacctctgggcaagcttgaccactgcctgccacaaggtttcagaccatgaatcagaaaagtcccctcttggccgggtgtggtggctcatgtctgtaatcccagcacttagggaggctgaagcaagtggatcacctgaggtcaggagttcgagaccagtctaggcaacatggtgaaaccccatctctactaaaaatacaaaatgagcagggtgtggtggcacatgcctgtagtcccagctacttgggaggctgagacaggagaatcacttgaacctgcgaggcagaggctgcagtgagccgagatcccgccactgcaccccagcctgggcaagacagagtgagactccatttcaaaaaaagaaaactcccctctttattcattttcatttgagcagtttctattgcctgcacctttactataccctttacttgacacacttttgtgttgttctaagacaagagtagtttattctgttcagtaacacattaaaatttaaatgtacacatgctgtatatggagttgaagacatgtccatattttatgcagaaacagctagaaccactggattattaatagcaggaaaaccagacagctaattatacatttgctgttgtttttctaggatgtgcacattagcttttcactgatgctgttaactgtaatatttagtgccatgatgtccaaatgaaggtgacagaggaaaaagagaacaggataggaaatagcttactgttattttgaaatatgggtgctaagttacaggagggagcccaaagtgtgggtccaatcacacatacatgcagatgctcttatcatttccctcaggttttgtgacctaggacccctctagctattgtcctacagaaggatacagcctgtggtggtgaattttgtgtcaacttggctggctcatagtactcagatatgtggacaaacattactgtggatgtttctttgatggtgtttattggatgggattaacatttaaatcaatggactttgagtaaagcagtttgcccttcacaatgcgggtgggcctcatccaatcagttgaagtccttaatagaacaaaggctgacctcccctgagcaagaagggattctgtctccagactgccttttttgttgttgtttgttgttttgaagaacaaggatatttactcttaaaaaagaagcgctgtcccacaaaaagatgtacagatttgaaaaacacttattttactgtattaaaaaacaacaacaacagaaaaacaggcaggggatgtctagatggcagaattgaagcagctctgtacgaaaatgaagatggtacgatgatgtgacttcaaagaaaatgactaaaacaaaatttcacaaacatcttcacgtttctaataataatgcacaaaatatcaaaaatacaaagtctgggtttcttccctgtaggtttatgataaactattaaacttctatttaatgcatttactttcataagccttctttgtttagaagtacaagctatacaagtacatacatgctggtattttaccatgaaaatttcacttttcatctcaaactagtgatttgtcttcttacccatacttatatacatttcacttccatcataagacatgtaatacatttctagtggtacattttaatcaatatatattttttaaatattgatttttaaaagaatctttttagtgctatgatacgatggccttaatttaacagctgaagcatgatatggtaactacactgtactgtttaattttcagctgtaggaaaacatttgagttttaaaatataaccaagatgaggctggatagtaataaacaccgaaatactagaaaacagtgaacgaataaataatacattttttttcatcaggggctattcatcattttgtttttagaaacctggaagaaattgtcttgagtttcaaatgttctggtaaatctagtcgtttcttagcctcctcaatgtcacctggaattgctgaaataagtgagtctaaagaatcaaagttcttttctggtctgaggtagccaacaatggccacattggggatttccccatagaagtcctctttgaaggtatgcaggataagcgtgtccatggacttcttcgtattcttgtggtagagggtccatcctatgctcaccaccacctaaaggccatctccacttccgacactggcccaaccataataaatgccaatggatacatcaactggaagattagctactacttgttctggaaaattagctgcggagatgcccagcggcctggagccacggccgaagccccgcaccacttgggcccggcagaggcagggcagatgcctcacgttatagtccagtccgctcaggacacgggctgcggccgggtccgcgcgttctacggagccgccatcgacgcggtgcccggaccctggatcagcaaggggtggggtggggacatggccgtgagctctgcctgccgcgggggcgcaccaggggcctggcgacaagacgacacgccgcggtgggtccctgaggcaaccaacccaacaaaagcttcccggcgactcaagagctgtgtctccccagactgcctttggatttgaactgccactcttccctaggtctccagcctggtggcctcccccatgagattttgaactcgccaagcctcagtaatcctgggagtcaatgccttaatataaatctctgtctctgtctctctcccccctcccgccccccactctgtctctggttcggtttctctggagaactctggctaatacagaatctattacagtaaaaattttagtatcggactcaagaacatcagaccgacagttccccttcaaacttacttagattaggctgatttctttctggctatgctacattatcattctttcacagatccttgagataatacatttttacctatttccttatattgtagtaaagtatattctaattaaaaagaaagacttgaaaatagactaattttagattcttaacatatctcaaatcatgcatacagcaaagccttcgcttcctatatttgataaacatgtcaaacattcaacaattagatacaacattcccaaatgaaatgtgaaatgattctgatattcttcaggcacctatgctagattgttactttagggatttactgggtcctttattcttgtcacggcacgtaattacaggaaaaattattatagctcactcccaaagaaatgaacagcagctctccttgctacgagcattatctgctttcaaagtttaagcatgttccatagcttccacttcctgagcagccacagtataaagatggaggccgaccacacagccaggaggaggcgctacagagacggctcaattatggcggaagggaagggtggcttccaggggcaactggctggcctctgccatttctgtctgtggtttgtgatctcacagcgtcacctgctccgcagatacagagctgtggacccctcagagggtggtgaaacagcttgctgattgctgtcaaggtattcactgacaaaatgcagtggcaatcacaagcacgaatcacgtacactccctttgtcatatgtcatggacggagttgtgtcccctcccctaaattcttatgttgcagccctatcccccaacatagctatatttggagatcaggcctgtgaagaggaaataaaggttaggtgggttatagggtgggaactaatacaatagaactggtgtccttttaagaagaggaagagaccccagagttggttgttttgttttgtttttctctctgtctctatgcacacacaggaaaagccactgaggacacgagaagaaggcagccatccccaagcaggaagagacactccacaggaactgaacttgccaccaccctgatctcgaacttctagtttccgtaactatgaggtaacaaattcctactgtttaaaccacctagtttgtggcattttgttaaggcggccccggcagactacatgaagcttaacaaaatcatatacttatatccatgtacagacatttatctccttgctcaacacctgcacccttatgagaccatgaattaggggagcaaggccctgactgtcccatttactgtggagtacctaaagcccaggacatgtctggcatagagtacagactccttaattttgctaattcagtggatcattacagttcctaaacaactatgagctaaagtatcagtggtgatacttctaaaaaatattagtatgtggcttggagtcggataaccttccatgtaaaataacattatcatctgcgaagattctagcaaattgaacacttctgactgtgagaagctacatttatcaaaaggtgagaaaaatccgttttctccaactgtggaaaataagggtatacctgttatttgctgtcagatttttcaggacttttgttttcttctggcaaatgttagcgctagacagctctggagtgaggccctgtcattctgttgttactgattcacaagaaattagatgttatcgagacaaagagagctagatctcaatgactctgtttctttacaatatttcaccttgcaatgcctcatgggcttttcatcattaaatgagggctgatggtatgtaaagaacgacattgtaaactaatgcttctcaagtgttcaaaaagaagggtgccatgtgaaacacgagaaagatgatctatactgaatatggtgccgaagagagagtataaatgatgactttattgtgtctaggtgctatcttgttaatccatatgcattctcttctgaatcacagcatgtctgtgttagggtctgttgggggaaacaggacacccaataaagtatttcgaagagtaatttcactattcagaaagtggagagaggtggcttaatgcactttttggagagccgatagcatttttgaatcttgttctgcaaaaatagttcttggtgccctcaggatgtgctgtgagcagaggatgaaagcaattaagttgggccagccaccagagagacagaccagacaggcttgctttggtctggcttcgcctctctcttggagagttcctacgggcagaagcatttgagcaccgcatccgaattggttttgtggtgctttgcttcagcttctttatcctaacatcaaggtaaactgccttaaaagaaagaaaaggtacttggaccatattggggcctttgaacatgatggtatgtttctagggatgggagaaaatggcaacacaaaataagactagaaaaaaatattgagtgcttactacagggacacagactctggaaaacacgatggctaacgaaatactaaggaaatggccacagaaaaaagaccttgaactttgtggaatgtattaatccagcagcaccaatctataagctgtgttctcaaagcgactgctacaggccagaaattcttgtgtacatcaagcgtgttttatagaatgaataaaaatgccttctagttgtacgtgttgctttaaaaaatatgtagaaactattgctgtgcattttcaaagggttatttaaaatgtcactggactcagaatagcttcccccacaccctgcacaccgatattctctcagataacaaacactgaaatacaaccactgtcttatggttgtatcacaaaattctagtgttaagaggggcccctgcactctttctggaattaaatatcttttagatgtccccctttcctcaggttttaaaatgcccttctctcatcagtatcaggttttctaaagatgatttccttagaaatcctgttcctctcgtctcagtcagtcatgaccaccgctctgtcttgggaccctggtgtgcttgagcattagggtggggctattcttgaggaagggagggctgtggaaggctgggaagagtgggaaagatactgcatgacatgagaagaaagtgtttttatggctgacgtcctgtaaacaatgcaatccatcaccaagatcagcacaacaaatgacagttttaccttccgtgttttgtgggggtttctcattctggatgacttcttaatgtccacttcagttgtatttacacatccaggctgggaatggaaaaacagagagacaaatgaatctttgggtgtgaaatttctgaccaggacaatcatgaatggctcgctctccagagcccgagcaaatgccccaatgacacaaatcaagggaggtgttttctagatggccacagccagtcccatcagcagtagccagtcataaaagacatgatacttcttaactcttcacacttaaaagccttcagatgctatcctcaaataactcccagagaaacaggaaaaagaaatactcggactgcacatgtgaaagtggtgtcaatacgtatagcgacaaacccgacagacagagtgagggcactcctggacaaagagataccccttgctggttttctgcagacagcctctcgcagagatctctctttataaaaagtgaggctgggccgggcgcagtgactcatgcctgtaatcccagcactttgggaagctgaggtgggtggatcacctgaggtaaggagttcgagaccagcctgaccaatatggtgaaaccctgtctctactaaaaatacaaaaaattagctgggcgtggtggcgggtgcctgtaatcccagatacttaggaggctgaggcaggagaatcacttgaacccgggaggtggaggttgcagtgagtcaagatcacaccattgcactccagcctgggcaacaagagcaaaactccattgcaaaaaaaaaaaaaaaaaaaaaaaacaggctgttattagatgggtgccttgcttttcccaggctggaagactaaaatggcatttagttgagccagctcacatcccagaatgaactgtcttacaaggattgtgaaacccagcaactaggaatccttgtttgccatagacagaatgtgcaatggagttcatggttaaaatgtgaaagatggagaaagaaactggtaaataagatgccatgcttcttctgataaattcctgaccttccttttccttaagggcaggtgaacccctttaaaacagaggggttgatgaagtataggcagcctgctgttagcttcctgacaacctcaggtgtctcatttgtcagatttattgttctgttgtacagaaacaaatagatgcaagctccttgtatatttggaggaggagaggggaggagggaggaagaagaggggaagggagagaacatgaatcacgaaacagagaagacaggagattcaaaaatacatagtagcttaaatgtagaaagggcttagacatcacacatcctttagaagtgatgagaagttaatggctacatggactgtgtttcctttacttttggtgcaggatttaacgatctctggtattagtaaaaaacatcggccaggtgcggtggctcacgcctgtaaccccagcactttgggaagccaaggtggatggatcatgaggtcaggagttcaagaccagcctggccaacatggtgaaaccccatctctactgaaaatacaaaaattagcaggacatggtggcaggcgcctgtagtcccagcttctctggaggctgaggcaggataatggcttgagcccaggaggtggaggttgcagtgagccaagattgcgccaatgcacgctagcctgggcaacaagagagaaactccatctcaaaacagacaaacaaacaaacaaaccatcaagttgcatgtctctgctcaatttctctatttcttcccacagactgcaagaaattaaagcattagatgtccttagaagtgactccagagaaactgtgaatacggaaaagtcttccgtggagttggggtggggttgggaagaaagggcaaaaaggcagagctgatgtgattggcagactcagctgttcactacagtaacgggaatcagttcattgtgtaatgaggacagaggacactttccttaaagaaccatctcctgctagtatagccattgggccaaaactccgccataatattataatagataaggaagtaaatgaggaaaacatttttttttgtagaatatgtatatactacagatacacacacacacactgtactacaaacattaaataaattatgagtttggtttgcatatctatttaggaatagaaatcactggttcagcacagtggtcagcttggcagtgtaggagggaggaagggcacccagctgggtgggactaatttcctaagtgacactgagcaattcactaaactctcccagcatctggttgctgagtatgtgatattgtggtttgatttttttttatggttggtctaagcatttgttttttaaaaagacccccggggattttaatctgcagccggagttcacaaccactgatgtaggtgtaacaaagacaaggtttttaaaacattaaaggatcgagttttcactttccattcgatttctatttctttgcagccttccatccctaagcctgagccataacggaagggaaggcagtaaaattctttaaactcctatcaacatatcaggagccaagcacagtgccaggtgcagtggcttatgcctgtaatctcagcatttggagaggctgaggtgggaggatcacttgctttgaggagtttgaggctgcagtgagctgtgactgagccaccacactccagcctgggtgatagggtgagattctgtctctctctgtctttctttttcttttttttaaagagccaagtatgataagatgtgtcatagagattttcttccatatgttaaggggtgggaaaaattaggatataatatccaggaaaaggaaagcatgtttcttcatgacctggaggcaaagaaagataaaggtaagatactgagctcagcaggtgtttcatttttctcctctgtggaagaaactcgaagaagaagaggtgatagggaggaataaaaagtcccagacaagtatgaggaagcctgtgaagtagtcagtcccattcccatagaagaagccccacatgcaatccgagccaacatgaattttatatcatatgggtgttagcaagaaagatgagcttaagaaaatgcttcccaagcctcttatgtggcagtcaagccatccggagtttcttgcatgccacagtagtaaaaggcacagaagatctaagaatagtgggtggatgggagcctgaagttgggacaaaggctgcagtgtgcagggattttatgctggaagcagatgtctgaaacacaaacttcagcagtgagttccaggtgatgagatggtacctgttgcaacatgcaaacctgtctatagcagaaatcgacaaggatctggaagatgttctgggggtgcttggccctctggccccactgcacaagactgtaaaaacaaaacctctagaccccaaactctcttccaaaccaatcctggatagcagcagagaaaggccgagaaaactgaaaatgtaatcatttatccacaaatgaccgagtcatctaaaccaactatttcaattatggtggcatgcagagcacatgcgttgaaacctacccttcaaataggtttctgagaaaactatgtcaattatagaaaataaagaaactgtattttctttatacatctgaggaagctgaactaatttgaactctaaactccttccataaagagctaggattccaaatcaattttacttcataccaggggtcataattaacaaatggccctggaaatcgtgtcaaccattgaaggcataaagtggaaagattcccctccccagaggaacatatctgactgtcagtcctgaaggaaattagaagtttcatcctcatatttaaaagatgatggccttttaaatttgattaatgaaccattagcttacatctgaaattcccacttgagccaattattaacaccactaatcagcaaattaataagaaagcattgattttaaaagtaaatgtcattagagactgaacggtaagatatgttttataacccggctcccatcccaggaaaatgaaatctgccagttcaaagtttgttactaatgactaaatggttaaaatagtaagctggatctgggatgcttgtctcggaggccctgtaatttctaatgaggcctcatgggacagctaatggttcaacagatctatgatatctaagtcaactaggaaattcttgaagattaaaaaagcttagaggcccaaagttgcctggaatacttctgaataattaaggtcatgacccagtgctgataacccctgaataactgctttcagaagtcatgcactgtggtaagtgaaatatggcaataatttttcttgaattctcttatgtattcaataaatatttctttctgcatctaattgtcggatcttgtgacaaatggtgagttacagaaatgaaggcacgagccctatcccagtaacttcctgatacaataaaaacgacagacacatgaataatcagaatatgggagcataatgactaagtggaagttggcacagagcattacatgacaacagaacattccagacatcctttttttttttttttttttcctgagacggagtttcactcttgttgcccaggctggagtgcaatggcgcaatctcggctcactgcaaccgctgcctcctgggttcaagtgattctcctgtctcagccttctgagtagctgggattacaggcgggtgccaccacacccagctaattttttgtatttttagtagagacaaggttttgccatgttggccaggctggtctcgaactcctgacctcaggtgatccacccgccttggcctcccgaagtgctggaattacaggcatgagtcactgtgcatggccaagacagacatccatttttatgcacagtctgttggttctcctcaacatggcaaacactattcctttaaaagttatttttaagcaatttttcaatctcgatgagaccatgttgtctttggttatttaaaaaaaagtcaatcatctttttgatgcatatataataggtaccactagctggcaccagaccttcgtgaaattcgtaaaattggtttctgcagagctaaacaaatctatcttcccaataagatataaataacattaccattaccaagtagacattccattaaaatcttcaaatatatactatttgctggatacagtattaagcacatagtattgttggatgtaaggaataatgaaatgctatttacatcagcctggaagagaattgtgttatttctagtgattcaaagatgaatttcttttcaaccgaactaagctgggttgcaacattattataacgttatttattataaagtaggatttaacattgtggaagccactcctgagggagtaaacggagcatatcattgagaaatactactgtcataacatttacgtgagtgtcctcatgaggtgcaaaagagaagctggagtttttggtttcattattgatattttaagtaaaagcatctaaatgccatttagttcctttcatgcgatagtacatttttgttagttatagcagaaggtacacttgtgttcaagacaactcggcaaagcctgtggtgaagagcgacagtgagagagaggaatacagaacagctgtgtttaagttccatcactgcagctgatgtgtacctgggagaacagtgtcctaaacgacaggtgagtggaggattagaaatgcaccatcaaatagagctgatagcaagacatcaagtacaccctagaaagttttaaaaaatcatgattctgggaaaattcaggtttcaaatatgcatagtccccccttatcctggggggatatgttttactactgcccacccccacaaaagagatgcctgaaaccacggatagtaccaaaccctatatatgctgtttttcttatatatacacatgcttatcataaagtttaacttataaattaggaacaataagaaattaacaacaataactaataataaaatagaaaacaacaataagtaataataaaataataaaatatgccagcctcactgcgcttgggctttggggtcattctgaagtaaagtaagggtgactcgaacacaagcactgcaataccaggacagtcgatctgataacctagaagactactaagtgcctaacaggtgggtaccacagacagcgtggatctgctggacaaaggggtgactcatgttccaggtggggcagaatgggatagacgagatttcatcatgctactcagaatggcacgaaattacaaacttatgcattgtttcttgaattttccatttaatatttttggactgcagttgactgtgggtaactgaaaccacagagtgcaaccatagataagggggagctactgtatttagatggtccctgacttactatggctcaacttaaaatttttcacccttactgtgagtttattagagtattaaatgcatttttgacttactatatttttggcttacagtggctttattgggacataaccccattgtaggtcaaggagcatctgtatatatattaattcaaatagaagtaaattaatgaaaaagagtcaccgctttgtaatacagtacaagttataaaaactgcatgcatgatccatagtaccccagtaagaatgatcccttattcttacatgaagtaattatagattttaaagtgttcacttacatgaagtaactatagattttaaagtgttcagtctcaggacttttttttttttggcccaggctggaatgcagtggtgcaatcacagctcactatagccttgacttcctgggctcaagcaatcctcttgtctcagcctcttgagtagctggtactacaggtgagtgccaccatgtctggctaatattttatttttaatttttagtagagacagggtcttgctccgttgcccaggctggtctccaactcctggcctcaagcagtcctcccatctcagcctcctaaagctctggtattacaggtgcgaagcactgtgcctagccaggattctttttttaaagatccaattcaagcttttcttcattttcttaggcagttgtcagttgattcagcctctgatcctttcagccctcctcctcccgacccatctacttactaagtcctacgcacaaactgaagaaagttgtttgaggaaattgctccaaatttcttccattcactcttctctatagtatttactcatttgattcctattaggcctcatttgctagctacagactcttgggtatgatatcttgcttcagtgtatgctgtgaatgaactccacacatccaagaggcagaaggaaacagaatcatacgaagtcagcctgaagctgtggaaagtgggcaggttgagtagaagtcacagaccatgataaggtggtaaggactttggtttaattctttatttttatttttaaggttttttttgtttgtttgttttgagatggagtctcgctccaccgcccagactggagtgcaggggcgtgacctcggctcactgcaagctccgcctcccgggttcacgccattctcctgcctcagcctcccgagtagctgggactacaggtgtccgccaccacgcccagctaatttttttgtatttttagtagagacggggtttcaccgtgttagccaggatggtctccatctcctgacctcgtgatccgcccgcctcggcctcccaaaatgctgagattacaggcttgagccaccgcgcccagcccgactttggcttaattctaaacataattggaagccactggagagttttaaacaggagagtgacttcatatgatttatttttcaaaactcattcagaccttacactccacacacacacacacacacacacacacacacacacacacaaactcaaaatgaatcataaacctaaatgtaaaatgctaaattataaaatttttagaaaataacaggagaacatctaggtgaccttgagttgggtgatgactttttagataccctatcgaaggcacaatccatgaaagaaataattggtaacttggatttcattaaaattaaaaacttctgttctgtgaaagatactgtcaagagaatgagaagacaggccacaaactggaaaaaaaataggcaaggttattatccaaaataagtaaagaactcttaaaacccaacaataagaagataccacaacccaattaacatatggacagatgatctgaacaggcacctcaccaaagaaaatatacagatggcaaatacatttatacaaagatgctccacatcgtatgtcattgggaaaacgcaaattgaaataacgagataccactacacacctattagaattgccaaaatccagaacgctgaaaacaccaattgctggcaagaatgtggagccacagagattctcattcattgccagtgggaatgcaaaatggttcagccactttgcaagacggtttggcagtttcttacaaaacactctaaccattcgatccagcaatcatcctcattggcatttacccaaattgagtcgaaaacttatgttcacaaaaaaacctgtacacggatgtttctagcagcttgttcttcataattgccgaaacttcaaagcaaccaagatgtcctttagtaggtgaatgtataaactgtggtacacccagacaatggaatattattcagcattaaaaagaaatgagccattaagccacaaaaagacaaggaggaaccttacgtgcgtattactaagtgaaagaagccaatctgaaaaagccacagattgtacgattccaatcatatgacattctggaaaaggcgaaacgatggagacaaatagttttgccttttccagatcagtggttgccaagggttgggaataaataggcccagcacggagaaattttagggtagtgaaactgtatgacactacaatagtgaatacatgtcattatacatttgtcaaaaccatagaatgtacaacatcaacagtgaactctaatgtaaactacagagtgcaggtgataatgatatatcagtgtcggttaatcgattacaacaaatgtaccgctctggtggggttgggggtggggggttgataatgggggcggctgtgggccggggagaggttgctggggaattcagtactttccacttaattttgctgtgaaccaaaactgctctaaaaaataaaattgattaaaaagcaaccaaacaaacaactcattcaagaatattgagcactttgagagtggattatcagggtgggaacagggcaaagcagaagcaaggggcccagtttgaaggttactgcaattattcaggcaagagattatggtgacgtgggtttgcctgccagcactagagatgatgtgaagtggttgcatctgggatgcattttgaagctataatcaacaaaacttgctgatgggttttgtctgtgggcatgctgaaggaaacagaatatcaaggatgactcccatgccatctgctgagatgggaaagcctgtgaaaagaagagaggaatccaaaatgatccctgggttgtatttacatacaatgtttgtatttgctgaagtctccaaagggaatgcaactctttatgcagtctctatgaagatcacgaatcagagcatttccaacacaaatgcctgtataatcatttgcccttggcctgtccttttgtgccattgcgtttttgcattatcactggtggtatgaacatatcattgaatctgcaacattaaaacatgatgatcaattcctgagaatttggtggagctgtctctcattactcagagtctctgctacactttcctaaattttctgtagtcctaccacattctattaatctgctctaattgaaatcagaccacttcagcctcacatctagcaactatctgtgcatccttcaatgacattccctttttatagactaggaattgccttgcaggtaccattctcaaagagcaaccaagaggactctaaccagtacatttgctatagcttctttgtggtcactgggattacccatgtttaatgttcagctttaaattacctaaaatgttcccagttagaactgctttgaaatttaaaaaatcactgggcagaagctaagttgtcataattatctttaaaataggggctcctgcaggaagaaacaaaaggcctgaggcaagtaagcgtggacactttcctgtgacacctggcctgctgtgcgcacatgagcgattgatgtccttccctttctatgattatttccctacaaaaagctggctgcagtgtgaggacatgcaaagagtttcaattggatgagaaaaaaagtctctcttagatttgagactgaacatgtgtgctccaacttgttctatatcctgggttggcatattgggtacttttatacccataattgaactggcattttgatttgcattatactgttcctctggtatttcactggtgggagggtgagtagcaacacagaattttaggattcctggtctgtgggcttaaatgggtcatcaaacaccttaaacatttttactttaacacttaacatgtttcttgaatgcagaaattaagacatgaaatctaggctatgtctctggtgacaacataaatttccccaatgtaaaggtaaggtgccaaaaagtaggaaaatgaactagctactgaactggagaaaacaatctttatttttttacacagtgctattgttagtactggtgacttacatggtatgctgtaaaggctaaagagaaccaaataaaatttcatatagcatcaataactcacagtaaattcaagggcttataataatttttacaacagatagcaatgggacaactaggaaataagtttgtgaaaatcatcacatattggaattaaccttgaattacaatagctgccttgaattcaatagctttgaatcacaaaggatatggggggctcctaaatcataagttcccaaatagaaaaggggtgcatctccctgtcttagtctcttcagacttctataacaaaataccataaaccaggtggcttataaacaatagacatttatttctcacggttctggaggctgggaagttcaagatcaaggcagtgaaagattttgtgttgggtgagggtcacttttcagttcatagaaggttccttcttgctgtttcctcacatggtggaaggcataatagttctctcttggcctcttctgtaagggcactaatcccattcaagaggaaagaaccttcatgacctaatcaccttccaaagatcttagctcctaataccaccaccttggaggttaggaattcaacacatgaatttggggaggacacaaatgttcagaccagagccctccctttacaggacacacatacagagaaaggccataacacatacctcggtttagcaaaatctctgtaaagaagattaatttcaaagatatactctgttgcattcaacttgatttccaaaaagagaaaaagatgtagtggtgttagaaaagagatttttacataaagttcttttctagatttcatatttattgctaagagccaaaattttattttcagtgctagggaaaaaaaatcttttaaaataattcccatgcatcctcgcattcttacttaatcatatccaaaacaacagagtctttcttgatgatttgaggtcgtgattatttgaggacaatgcttattttttattattttttttttttttgagacagagtcttgctctgtcgcccaggctggagtgcagtggcgccatctcggctcaccgcaagctccgcctcctaggttcacgccattctcctgcctcagcctcctaattagctttaggattacaggattaggattacaggctaattttttttgtatttttagtagagacggggtttcaccatgttggccaagatggtctccatctcctgacctcgtgatccgcctgccttggcctcccaaagtgctgggatgacaggcgtaagccactgtgcccggcctattttgctgtctttaagacagcaatgcctatgaggctagatgatcccaactcctaatgccttttgagcttttatgtgattttatgccatttttagttcctctgccttatcccagttagctgtcactttttgctgctctcagcatccttgactccagcgcatctcattattctctaattcgttgcttggttctgatgtggatcagaaaactatacaaatgctcctttgccacagggtctcacattttagcgaatgaaccgatcaaagcacacggttagagtgtgagagtttaaacagctacttcggttaagactttttgagtttatttcttggctgagttttggatagaattagacttgaagatatgagaggtaagaaaaagtctcaaaactgtaacaaataaaatgtggacaagttctcatgatatatttaggaaaacttatcagtacatacatatcatagaagccaattaaagggggtcagaagtagatgacatcaaacatttatctggagttctaagaaagaggatggcatactgagagctagaaatttgttctgtgctccgaggggtggggagaaaagttaactgaggtgaagggcagcattcttgggttgcatctccccagatcctgagtgaacaatgatgcactctcttgtctacacccagattcttttggaaaaagcctgccagattcattgctaattttggtttagtttcccaaaaaggataaagtgtccaagccagaactctcagtttctctcccctcctacctattcttttcttggttttctgcctttcagtgagtgcctccaaccatccatcaagagactcaagccatcaccaaggaggcatcactaagccctcttttccccttacttcccacacttgattcatcagcgcatcatgcaaactttacctccaaatacaccccgaacctactggcttccctccaccctcactgttaccaccctgctccaagctgccatgatctcccatctggactatcacaacagccttcttatttgttctaattcctctcttgctttgtcctccctttccccaagttattctccacacagtagccagagtcacctttttaaactacagcgacatcacatcggtctcctcgtcaaacctccaaagggctctcgtcatgctcaggataaaaggcaaacaccttgccatgctctacgaggtgttacacttttcttttcttttttttttttgagatggagtctcgctccattgcccagggtggagtgcaatagcatgaactcagctcactgcaacttccgcctcctgggttcaagcgattctcctgcctcagcctcccgagtagctgggactacaggcatgcgccaccatgccagctaatttttgtagttttagtagagagacagggtttcaccatgttggccaggctggtcttgaactcctgacctcatcatccacccaccttggctgcacaaagtgctgggatttcaggcgtgacccactgcgcccggcctcactggccttctttgtgtaccaggcccttttctctgtactagatgctacttctttctccaaatactatgtagtccctctcgatcacatcaccttgcttttatttttatcatatcacttacctccacctggagggtttttgcacattacacttgtttgttttctctgtctttcaccactgaggggtaaattcctcaaatacagggacttcctatgtcttgtttagtatctgtcactggagtctgaaatttcctggtacctagtaggtgctcaatgaatgtttattgaatgaatgaatgtgaaagactttttgaacatacccatctattaaaaatacaaaatgagttttattttctgtttgcttgtgtgtatgtgtgtgtgtgtgcatttgtgtgtgcttgagaatgttggtacctataacttaacctcttggccgactgatcatcacctctcattattatcatacatttatttaacaggaaacaaatactccaattcttcagttagccttaaaagaaacatttctagtgcagaaaaatttagctcaaatgttcttttcctgtgcaatgtgattagcccatcagttgataagtgtaaatagcagattgcttccagatttgatgggggttaagtagttaaaaagcaggaagacactgggaacttacaaagcctcagttttagagaagtcaagatgagaatagagcaggcctctctgtccctgcctttataactttgtttaaagcggttcccatcttgacctacaaatatccaaggacaaacaaaatctgtgcccctatgcatttctttacccgggtgtgcaatggcacagcggagttcagacaacacaactgagccatattatacaaccagcacatctccactgggctgtattatggagctgaagattaaaaccccatatgagaaaaacctggattcaagatataaactaagaaaagataaagctaataacgcctcttctattgtgcagtactttgacatttttcaactataaccatcatctaatatgagtttcataagcattctctaaactatatagattagtcactatgaacctaattttcactgaagcatatcaaagattcaaaccttggaagagaatataaatattatctggtctaacttagcatccaattcatgatttcttctggcaacttctacgacaagagtcattcaaccttagctcgaatgcttgttgcctcctttcccctaaaatacctccatctgcatcacacttgaaagaaaatttttgaataagtcatttatttaaaggaccatgccacttttaaaacatgttaataatcatacctaaaaaagacaaataacatgatgacaaactagttaagattcttggaaaagtagaaacttctttaagccttggtgtctcttctttcagagcgagtgcaataaaaattgttccaacctcctcagtgtatgaaatactgcacgtaaaaggggtcagcacagttcttgacacacagaatatgcaaagcacatattagtttcccttagtattagtattattagcagtataatttgacatcaataaaataatcccatagaagcaagggactggttcttctatgatttcagattatgtttgtcaggaatttttttttttttttttgagacagagtctcactctgtcacccaggctggagtgcagtggcaagatcttggctcactgcaacccccgcctcccggtttcaagcgattctcatgcctcagcctcccgagtagctgggattacaggcatgcatcaccatgcccagctaatttttatatttttagtagagaccaccatgttggtcaggttggtctcaaactcctgacctcaggtgatccacctgccttggcctcccaaagtgctgggattacaggtgtgagccactgcgcctggctgtttgtcagtatttgaggaagttgcttatgaaagtaaacaagttgaactatactgaatggaggaaaagcaaaaagctaataaattttagtaattttaggccaaatatcagatttaatttttaaaaaggtaagcattttggggggggaataaatatagggtaagtgtggaggcaagagtgtaaaactcagttcacttcaaagttcttctgatatatcaagccagaccaatacgttggagttgcatttcctttctttctttcttccttccttccttccttcctttttctttctttctttcttttttggagttccattttcttaatggcagttttctttttttcttttttctttttctcataaggggtaactgctaacatttgaaaatatgtggccaagcgtggtggctcatgcctgtgatctcagcactttgggaggcctaggcgggtggatcacctgaggtcaggagttctagaccagcctggccaatatggtgaaaccccatctctactaaaaaaatacaaaaattagctaggcatggtggcgggtgcctttaatcccagctacttgggaggctgaggcaggagaattgcttgaacccaggaggcagaggttgcagtgagctgagatcatgccgctgcactccagcctcgggcacaagagcgaaactctatctcaaaaaaataaaataaaaataaaaataaaaaaagaaagagaaagaaagaaaaagaaagaagaaagaaagaatgaacatatgtaaggacaaatatctttttttcttttttctttttttttgggacagggtcttgctctgttgcccaggctgcaatgcagtggtgtgatctcagctcactgtaacttcaatttcctaggctcaggtgattctcctgcctcagcctcctaagtagctgagactacaggtgtgtatcaccatggctggctgatttttgtattttttgtagggatgaggttttgctatgttgcccaggctggtcttcaactcctgacctcaagtgatcctcctgccttggcctcccaaggtgtcaggattacaggcatgagccactatgcccggcctgacacatatctttatgttgagttttctcttaatgaaatgtaatttgttttgaaaaaatccagttattgattgtgaggaggtatatgcaattattgtgagggaaatagcagagctgaggagaaatctagagttttttgtatttgagagaggatttgctatcttttaaattaatccagattgcttttaattttaatttaattgtctttctcaggaaagagaaaattcatttgaagaagatagctgatgtcctattaagggaagacagcctatcttttctttctttcttttttaaaaatacaatttgtgcatctggggaaaagcaaatgaacagggaaaaaaaacaagctcaaataatgactgctctctgtgaaatcagagtccatgctggtcccgtcagggttctggcagactgagcccatgttgttagctcagccagcccctcaaagcctgtgtgcacgtgcatgcctgagtgtgtttgtacacattttaaatcttagtttcgctttgatatgatttcaaacctacaaggattgcaagagtggtttaaagaactcccatagactctttacccaggttctcctattgttaacatttggccccattttctccccttccttgtctatatttaaactactggcaaacagaaattcagctatagtaggaatggcccaagaggctggcttctcaatagagtatcagggttagatgctccccttccctccccgacacctgcccagacacccacaactatgcaagataccatcagtacttgagatcaatactatcctctatccacttccctgagagttagctgttggctcttaagaccttcctgctatcatcaccccaacccctatccacatcctcatcatttcagaagaaacaggacagaaatctgggctcatgattttgaaaagtcgccaatccacaagggataaaagcaccaacttaataataggggaagcagtttttattctcattctacccatggctcacataaatagcatcagatattacataataataggacactgtatctacaaatctattcagggatagaaagagcagacagaagatgaaagatatagccaggaagcaaaaaagaacagtttcactcatagcggcttgtgatagccagattgtcaaaatatttttcaatccaaaggaacagatgggaataatagacagaaatgctgttccattttcagagcacaaaagaaatatttaaatttggatgaacacattttggattttctaaaacagctcaaggtatcagtaatgagatcatggactattgataggaaagacagcatcatgagtatgggctgatttgaacttaagaacaaaaagcttgcacagttcctattgatttcaacctaatttgtttctcatgaacaccacaaaactgacaatgccaaagattaaaataggtatgtaactgatatcttccaagggaaatattagggaaaatattagggttctcctacagcttaagctccagatgagcacatgaaattatgcatgtggattgcacatcagttacaaaattaaaaagcaacctccctgaaatctatagaatactatacctgctggctcaaacccagaggtagacatgaacatttctaagggatatttatacctgttgcatttacttgacacaatccatgctgtgactcctttccagcagcctagcatggctgataatatgtagccgcctctcagagatgttgggacaatggacatatactgccctttgcctcagagttcaagtagacatgcaaggtgcaatagaccatttaatacataaaaaactcaattaatcatttcactaataagaaataaaaactagttaacatgcacaaagccggtcctggtgcgatataatatcctgctgtgtcttatgaattgacaaagtttgcatcctatgcaatagagatcacatggggttttggagaaaatgctaggttttcagtcatcattagggatttgactcttaaccatatcaaaaccaacaaaacccaactcttcagagtcttgctttctcttatttgttaattaaggaaaatagttacccaccccacgaagtcattgtaaagaataagtggtatgataaatctaaaaggcttttgccaccagaaactgctacacaggcaatcaatgttattgtcatcgatagtaatccacatgcattattgttctcttacattttgtagaaagaaatccaggtggcatgcatttaacatgtgttttagagtaatgtatcctgaagagagaagtagctcgaacagtaaaagggacaatgctggaaattgacaagcttctcgataactgacaaagtcctgttgcctcatctctggccactgctgccttggttggttcaaatattggagccccgtggaaaagaaaaatctgtgtgcttttgaaactaagtcagtatgtatttaatgtcatccaaaaggatgtagataggatgagggaaatcaagaattattaatttattcatgaattcaaaatctatccattgagtgtctgctgtgttcctggtacttgactgaggcctaaatacagagtcagggacaagtgaagcctagtctctgtcttcttatggggaacagttactacctcatatttaccatgtcattcccagtataaaaatcattcataaaaagtactttcatgttcatctcaaaagtttttttccttaatattatgaaagagatgatttgctctgcttaaatattgtggaagttaacctaaaatataagtgagtggtgagagacattctttagtttaggagggagatttggcaaagaactcatgcgccacagctgtgaggagtatacaggattatccccttattcccctcttgatctagggctttgttctcttcctcctgcttacaggttactgtaaggtggttccagcagcatctgcataggtcaccctcttcactgggaagggtttcattcatgctagggcttaacctagttttattttttccaccaccctttccaaattctattttcccagattctactgtggtgagtaccctccataacagtccctattgacctccttctgctggtattctcactctgtgtggtcccctcccacactgcaccagggttggtttgtgtaaccaataaactatgacagaagagatgacataccacttatgagattaggatatacaaacatgaggttttgacatggggctatctttctattttgggatgacatggcggaaactgtcttggacatccttatggagaggtgcatgtggccaggaactgaagctgcctgcaaaccaccatgtgaatgaagtgaaccatcagccccttcagatgaccatagccttggccaacagcttgactgatgcctcatgaaagaacctgagcctgcatcaccaggaaaaccactcctggattcctgactctcagtagctgtgtaaaatagtgaatatttgttgttttattccgctaaattttgggataatttgttatacggcaatagataactaatatacttaaccttcaaacttcaactccaactcttctgatccccaaaagtatttttcctgattataccagttcatagctatctgctaacctttttacccacctcctcatctccttttaaaagcatgattgctaaaataacttcagctaccaattactgaacaagggttgtgtgccaggtactgtcctaagcaatgtacaaatattatttccatgtgttctcaagggtcgtgtagggtaagtatttatttttcccatttcaaatgagaagtttgagacttggaggcatttagtaaaatctcactcaagaaggaagttggtgtttgagccaaatctttttagctgcagttgcatcccttgaacactacatcacataaaactgtcatagctgtgtgagttatcttgaagtctttgtatctgaggcagggaaaatataaatggagagagcctaagcacagtggcaggagtgggaagagaagtgagaatttttatgtaatccatcattcgggcatttagctcttgacacaatgttgccctccccaacttctgtctcactggatatctttagattaaagaaataacataaattttgcatgagacttttcgaaatcatggaagagtatgccaaaaatccataacattaccattctttatagtcaggtttttattatagaaatcaataagaagcctagtacacgccaatttcacctttgaatatgcatgtcaaaattctaaatcaacatacaaacaaaatccaatatcacattaagaaaataacacgacatgaccaagtagggtttatttattctgggatttcaaggatcactcaacattagaacatctattcatagaattcacatattactaacagatataaggacaaaaatgtataaaaagctttagaaaatagttttatcaatcatttctacttgtaaaaacaaatacactaaaataggggttcttattcaggggttctgcaagatcaaaattatttccataaagatcggaagccatcactgccttgttctcagaaatatacagtagattttcccagatattgtgatgacatgtatatagcaaaggaattgaatggagaaagagataggtgaatggagctgccttctagtaagcttatgattaaagtgatttgcaaaagtataaaacagttccactcttcctgctaattttcctttggaaaatgtgccaatttttcattaaaattacactgattattttattaagtgattggtgtcctattgttatcttacatgaaaaaataaatatttaaacagtccttggttttactgttgagtctgataaatgctaatagataaaacttgtataagcaaagacacttcaggacacacaataatttttaggagtgaaaaggaataataagaccaaaaaataataagaccattttcaaattttcagaatttgaaaatgatagctgtgtaagatacaaatgtaaggtccagtttcttaattctatacatagttcctttataaaagatacagcagaaaaggaaatctcatttataacgagaggtttttttttttaagaaagaaacctaacaagaaatgcatgagacatgcacaagaaaaatctaagatgctcctgaataacacagaagttggtaagaacaaatgcttaggatgactcagcttcagaaaaaaactcaattctcccaagttttctataaatgtataacatttgaatgccaaaaagggttcttttctggtgctagacaattgattccaaagatcacatagcaaaataactaggaaaaacctaaaatgaagagcaacaagtaaaaggtgtattgggattgagagggtctagacttatgagacataaaacactaaaatccaaacagtgatgggcagaatgtgatatctccaacccagatgatgccttttaaccattttgttgcctgtgtaaggaactcatcatccatttcctagtacaggcctcgctagcatatttcaatgataattccctaagtcttccctcctttctttcatcctaattttttccagaataattctatcatgtggtgtgagatttccagagaggtgtatctcttaaacagatctattctactttgcctttaattacatgtttcattcaacaagttacccccttcgtttttcttggtttattgtaagttctaccttactcatcctaatggctttcctctgtgatctgttatgttaacctcagggcctggctttgagcagcatcctgagttagtggaaggaatcctgagctgcaattcagaacacctggattcattcctggctcctctcaaagaaaaagaagtcctgggggaaataaaacaaaactcagtctctctacacttcagtttccttatttatgaaatgaggacaaaattaatgccaactgatatggtttagatatttgtctcctccaaatctcatgttgaaagggaatccccagtgttggaggtggggtctggtgggaggtgtttggatcatgggggtggatccctcatgaatggcttagcaccctccccttggtgatgagtaagttcccgagagatctggttgtttaaaagtgtgtggtgcctcccctcctctctcttgctcctgctctcactgtgtgatgtgcctgctcaccccttcgccttccactctgattgtaagctacctgaggcctcaccagacgcagatactggagccatgctgccacagcctgtagaacgatgagccaattaaacctcttttctttataaagtatccagtttcatgtattcctttatagcaatgcaagaatggtcgaacacaccaacctaacagagtaatgtgaaattaagaagaaagtttatatatgatcacattccgcacccgtactggatttaccaagaggcaggaaggtgttgtgataaagagtatgggtcctgggaccagaacacctgccttcagtaacagcttcctcatttagtacttgtggaactttgcacaacttaaatgtcccatgtctgagattccttatctgtaaagagaaaagataacagtaaaggcatatctcattttattgtgctctgatttattgttcttcacaaatattgtgggtttttgtttttgttttgttctttttgcagattgaaggtttgtgacaaccctgtgtccagcaagtttactggtgccatttttccaatagcatgtgcttgcttgctttgtatccttgagtcagattttggcaattctagtaatatttcagaccttttcattattatcgtatctgccatggtgacctgtgatcagtgatgcttgatgttattgtcgtgatcgttttgggatgccacaggccatttcccatttaagatggcaaacctaattgataaatattgtgtgtgatctgactgctgcatcttccactcttcaggcttccctattttctgagctacaacaatatcaacatcaggccaataataaccctacaatgacttctaagtgttcaagtgaaaggaagagtcccaagtctctcaatttaagcaaaaaactagaaaatattaagcttagtgagggaaagcatgttggaagctgagataggatgagagctaagacttttgagccaaacagccaagttgtgaatgcaaagaaaaagttcttcaaaagcacttgaaaagtgctactctagtgaacacacaaatgataagaaagcaaaacagccttactgttgataggaagaggtttgagtggtctacatagaagaccaaagcagccaaaacattcccttaaaccaaaccctaatctacagcaaggccctaagtcatcaattctatgaagactgaaagaaataaggaagctgaagaaaaaaagttggaaactagcagaggttggttcatgaagtttaagaaaaggagccatctccataacataaaagtgcaagatggaagcagcaagtgttgatggagaagctgcagcaagttatccagatctagctaagatagttgattttcgatgtagacaaaagagctttctacaggaagaagatgccatctaagactttcatagctagacaggagaagtcagtgccaggcttcaaagcttggaaggacaggctgactctcttgttatcaggtaatgatgctggtgattgtaagttgaggctaatgttcattgatcattccgaaaattctagggcccataagaattatgctaaatctactgtgcctgtgttctacaaatgaaacaacaaatcctggatgacagcagatctgtttacatcgtcatttactgaatatttaaagcccagtgttgagacctactgctcagagaaaaggattcctttcaaaatatacccactcactgacaatgcacctggtcacccaagagctctgatggagatgtacaaggagataatgttgttttcatacctgctaacacaacatttaatctgtagtcaatggatgaaagagtaattttgactttcaagtcttattacttaagaaatgcatttgtaaggctacagctattgtagatgatcagattcctctgatggaatggggcaaagtaaattgacaactttctgcaaaggggtcatcattctagataccattaggaacatttatgattcatgggaggagtcaaaatcttaacattaacaggagtttggaagaagttgatcccagcccttagggatgattaagggattcaagagtttggaagaagtaatcgcagatgtggtggaaatagcgagagaactagaattagaagtggagcctacagatttgactgaattgttgaacctcatgataaaactcgaacaaagggggagttgcttcttatggagcaaataaagttgtttcttaagatgaaatctacttccggtgaagatggtgtgaacattgttgaaataacaacaaagaatttagaatattatataaacttagttgataaaacgaggacagggtttgaaaggatgtattccaattttcaaagaagttctactgcgggtaaaatgctatcaagcagcatcacatgttacagagaaatcttttgcaaaaaaaagagtcaattgatgtggcaaactttattgttgttttattttaagaagttgctacagcttctccaacctttagcaaccaccgcccagatcagtcagcagctatcagcactgaggcaagatctcccacaaacaaaaaggttacaacttttgctaaaggctcagatgattgttatcatttttcagtaataaagtatgtttaaattaaggtatgtgcattgttttttagacataatgctattgcacacttaatagactacagtatagtgtaaacataacttttatatgcactaggaaaccaaaaaatgtgtgtgatttactttattgtgatatttgctttatttctgtcatctggaatttaaccccaaatatctccaaggtatgcctctactacctgtagttgttgtgattattatatggtaatttatataaagtaccaggaataaaacctggtacctggtgaatgttctctaggcactaataaactaactgttattatctactgcccatctttttccccaacttgatgaagacagaggtattgattctccaatgttgcctctgctctgtggaaaagaacttcagggacccaagaatatagaacctcaccctttcctctcacaatcaaaggtaagtaagagccaaacaagacaaaaaggaaattatcaacataaacattactttcccctggctctaaggcacacaagcagcaactcaagctaagggattcctgggggttttgtgttgctctaagtggcacttttctgaacagtgaaacttgatgaaggaaaagaccaattttaagtcatctggatcacaaccaacattgtctgtgattacccttgtcagtgtgtgttaagaactggtggtgaaatatcaagtattaatgaaggttgctaagtaaccacacaattacataaatcttttcaagtgcatttttgagtatttttaaataatgaggtaaaatgtaggacatcatatgaataactaaggtaatgcaaccacatgcatgtttaaagagatttctaggcctgattttcttagaaaaaaataagtatagtatttcccagggaaaatattgtctgtcttggagaatgtatcagttgcaatcacttctcttaaagtagtaaataaagaatagttttatcagaaacgactacaggggaatacagacatttttagaggaattgcttcttcaagataaccaagcatgttagcaacatgaaataattatagcaaaaattatattatttacattatgataacactctctcaacgacagcgtaagatacaacttcttggtccagattaatacgaaagctacattcccaacatttgagataatgaagccaatgatgggaatcatttgaaaatttaacaacactcctcacagtaacaatagtcagaagaacagacaatatcacttgcaaaaattggttcaatctgtgaactgataaaaggcagcagtcattcattacatgtactaccagatttcaaagcatgttctggccgggcgcagtgactcacgcctgaaaccccagcactttgggaggccgaggcgggctgatcacgagggcaggaggagaccatacgggctaacacggtgaaaccccgtctctactaaaaatacaaaaaattagccgggcgtggtgcgggcacctgtagtcccagctactcaggaggctgaggcaggagaatggcgtgaacccgggaggcggagcttgcagtgagccgagatcaggccactgcactccagcctgggcgacagagcaagactccgtctcaaaaaaaaaaaaaaaaaaaaaaaaaaaagcatgttcttcattttagaaatggcaaatatatgaaaatccatgctgattacgaaacatacaaaaaacattcaggaatgttctcttgggaacacttctggaaccccctttctggagctatttaagagaaatgtcacatatacatttttgaggctgaacaaagataataattgatagagacaatttagatgattgctttcactgtgtgacaatcacaccctggtcttaaataccacatcactggctaaaagagaatcaggcattaattgcacgtgcaagatcacggactttgatcatgggaaaagacggtctaccaaggagcaagcttcactcttgataatacaactggaatttaaatctcaaactttttttctcccctcttggtcatctattcccagtttgcttaatgtcatacaaatctgtaatgtatccaatttaaaaatttgaattcagaaaaaagcgttatgcaccatctctttttattaaattggctggaatatgatgctctcaaatttcaatccgagttcctttactcaataacactccaatttcaccctctcctaatgcaaagcactgaatagtaggggagaagatccaagtaatgactcaggaaaggagacgctacgcctcgtctggacttttcagacggcagagatctccctgccatgtgatgccatccactggacaattagaaggatgaaaacagttttcattcagacaaaatctgcctccttttatccaaagcaaagcaggctaatcttactcctttttccaatgacagctgcttaaatacttgaagacagatgagtaacagcatctaacttctctgccttaagcttaatttttcatgtcctctcacttactttagtacttcacatcccctccccggcctacacgggttgttctgttcactctgctcaaaagatgggcagagtttctacatgttgtcccctaagtatgcagtgcttgggatgggataccatacactctgtgtgttctgactatttccaggcatggcagaagcatgcctaccttcatctcggacgttacaggccaaacaggaggatttaaggatactttatccacaatttttcagagtataaatgtgacatctctttatagaaaattaaaattgcctatgatatcaaatatcccagaatagttacaatcaatattcagtatattgtctcttaactgtttctctaggtatctatttttataaacaaaattgggatcatattacatataacctttttttggatggtagaatcattgcaaacaatataatatttatttattcactcgtttatttaacaagcgcgtccatagattacacatgctgttgcattccagcctgggcgacagagtgagaccatgtctcaaaaaaaaaaaaaaaaaaaggagaaacaaagaagaaaaggaagaaattatctaaatttcttatccaatttcttatatttagataatttcttatatttagataatgtcttccttttcttctttgtttcttcctttttttttgagacatggtctcactgtgtcgcccaggctggaatgcaacggcatggtcacggctcactgtggccttgacctcccgggctcgagtgattttatttcacatttcagcatagtttttctccacatctttccaagtctttaaaattctcattttgagttatacaatatactgtcttgtggatatatcttatttaaccaccccggtaagttgaatagctatgcgatttcaaatgttagctaccctatgtttaaccactctaattttattgtatagctctggacaagttaatctacttgtgaaaaagattttatctttttaattcatattgtcaaattaatttttatacagataataccaatgcacacacccaccatagcatttagaaacacttgtctttctattgctcttgccaggattgcatacaattaatttgaaattttaaaataaaatatattgaaaaaaattgtcatctctttgtcttaatttatgactagaaaggttaaactcttttcccaatttttaatagccatttatatattttcttttatacatggtcagtttaagccctttatctagtttatgtgaaatcatgatatttctgaattgtttaattattttatacattcagaatatcaaaatttatttatcttgctccaagtattttcagattatctctatgcctttcaattatatttttaaacacaaaatcaagtttttaataaaatgtattagcccgcttattttgtgatttattctgctgtctttatgcgtgaaaagttctctagatcctaacattagctcaacgtaaacctctgtttcaaaacagctatattcatagctctactatagatctcattatagtatttgcataataattattcatttacacccccgttctacttattctggactctgagtatctcagtcactggggcagtatttttcatcctcttctctttagcctttagtgtgggaaactataaatgttggttgaaagacatactaaatgaatgaatcaactgtgtaatgcacagatttttttcagtgaaaatcaaagaaatgtaccactttacttctcttattcctttttttcttgccaaactattgtatgaatagtatagttagaaaaatgtattccacaggaataacgatattttatcatatacttgtttgtttaaagtacacaattaatatacaatcatgcctcagaacaacatgtggggtgtccatacaaccgtggtgcaactaatccttcaaaagataattttgaatttttagcattctctgaagaaatattttgcatgtatcaattctcatccaggagaaatcaatggcaggatttctcacaataatcataaggagaaaaatatttctcttatgattagtgtgatttttcagagaaaaaatatctgagtcatttttgtgggactctgcttctttttaaatcacattgatcatgtcaagaatgaatctaccaaataagacaaacaaagccaagcacactgagtaaagtagagaaccaatacatgggctttgtattttacttcaaggtcttgtctatatggcatacaaagacacacagtggaacaaccatcagcttttctatataggtggacctgatgttaggcaagtaaaattcactttatctgctgatatcaccacatgacgctgttttgttcttgtggtcggatattttgttgagttcattatactctcctatgatgtgccctctgtttcactttgtaaaaaagttatatctctatttttttttgttatgtcatggactttatttttgagtagtttaggtttacagaaaattgagtacagagaacagagaattcccgtatgtcccctcatcccaccccaaagtcccctgtattattaacatcttatattgatgtggtacattgtttcagttgttgagccaatattgatacattaatagtaattaaagtccagagcttgcattggggttcactcttggtgctacatacactgtataggctgtgataaatgtataacaatatgtatccaccattaaggtatcttacaaaatattttcactgtcctaaaaatctgtgctcttcctcttcatcatccctgctttcccttcaacccttcatctttttcctgtctctgtggttttgccttttccacaatgtcatagagttggaatcatatgataactggccttctaagactggtttctttcatttgtacgatgcatttaaagtccttccatgtctttttgtggcttgatagctcatcccattctatcattgaaaaacattctgatatggtttggctgtgtccctgcccaaatctcatctgaattgtagttcccgtaatccccatgtgttgtgggagggacctggtgggaggtaattgaatcatgggggtggttacccccacgttgttctcatgatagtgagtgagttctcaggagatctgacggttttataaggggcttctcccgctttgttctgcccttctccgtgctaccaccatgtgaacaaggacatgtttgcttccccttctgccatgattgtaagtttcctgagacctccccaaccatgctgaactgagtcaattaaacctgtttcttttataaattacccagtcttgggtatgtctttattagcagcatgagaatgaactaatacaccttccattgtatgaatataccatagttattttttgaaggacatcttgattgtttccatggtttggcaattatgaataaagttgccataaacatttgtaggtttttgtgtgaacagaactttcctattcatttgggtaaatacgaaggagtgggaatgctatattgtatagtaacaattcatttagttttataggaaactcccaaattgtctttcaaagtagctgtaccattttgcatttccaccagcagagaatgagagttcctgatgttccacatcctcaccagcattggatgttgctagtgttttggattttagtcatgctaataggtgtgcagtggtatgcaattgttgttttaatttagccctaatgacgtgatgttgagcatctttttgccctctgtgtatgttttttggtgcagtgtctgttcagatcctttgtccatttttaattggctgttttattactattgttgagttttaagagttatttgtatattttgaataccagtccaaaatatcagttgttttgctaatattgtcccagtctgtggcttgaattctcataacatcttttatagagtaaaagattttaattttaatgaagtctaattcattagtctttataatatggatatatgatttttttctttttagcctgtagaagtaatcaattatatcaattgattttcaaatgttgaaccagtcttgaatacctggaataattcccacttcactgtggtgtaaaattcttcttgtacaacgctggacatgatatcctaatattttgttgaggatttttgcatctttgttcatgagagacattggtgtgtagttttccttccttgcaatgactttgtttgctttgggtattggggtaatgctagcctcatagaatgagttaggaggtagccactctgctattttctggaaaagattgtaaagaattgatataatttgtccctctttgctagaattcatcagtgaacccatctgggctggtgcttcctgtcttagaaggttattaattattgattcaatttcttcatttaatttactgttttttaaatttttgagacagggtcttgctgtgttgcccagactggtcttgaacaactgggctcaactgatcctcctgtctcggcctcccaaagtgctgggattacaggcatgagccatcactcctggcctaatttctttaattgaataggttaatctttaataatagatgttaagatgtaggccttctcattaatatatataggcccatatatattatctattttcttggtaagttttagtacattgtgtttttctttctttctttcctgttttttttttttttttttcttttggtccatttcatctaggccttcaaatttctgggcatagagttgtttagaatatttcattattatgcttttagtgtcacagaatcagtagatatagacccttttatatttctgatattagtaatttgtgtcttctccctttattccttagttaacctggctagaggattattgactttactggttttttccaaaaaaagttttgattttattgattttctctatattctcttgccattctcattgatacctgctttaatttttatcatttcttctcttctacttactttggatttaacttgttctcctattcctagtttccaaatgtggaagtttagattactaattttagatctttctttcttctagtacatgtactcaatgctataaatttctctctaagcactgctttcactggatcctaaaaattttgataaagcatatttttattttaagctagtttgaaatatttttatatttctcttgagactgcttctatgacccatgtgttatttagaagtgtgttgtttaatctactagtattttgagatattctagctgttctgatttctagttttatatcattttggtctgagaacatactttgtgtgatttctattctaaatttgttaaggtgtgttttttgacacagagtgcaatctcttctagtgagtgctccatggaagcttgagaagaacgtgtattctgctgctgttgtattaagtattctatagatgtcagttagatccagttgattgacggtgaacttcagttaaaccttgttcttagttccttactgattttctgcctgcttgaactgtaaattactgatagaggggtattacagtctcaaaataaaatagcgtatttatccatttctccttgtacttctttcagtgtttgcctcatactttgatgttctgttgttaaatgcatagacatcaaatattattatgtctttatgaagaattgatctttttatcattatgtaatattcctctttatctctgataattttccttgctctgatgttggctttgtctgaaattaatctagctactccagctttcttttgatcactgttaacatttaacttcatattttaatggatttgtacacacacaggcacacacacgcttgcttcgccaggctattctatacaaatttatttgaagaaaaatagatacgtagggacatttatgggactacaggcaagatagaagaaagacaagagaccttccaaatgaataacaaatcctctttcactctctatgccttcctctaacaaactgaccttgtatcagggtttaactattacctttagcttaatgagtttcagaatcaattctatatcccaaaacatccctcaaattttggtctcatgtctacaactattgacaagatctcgctccatctgaatgtcatgtcatcacactcagcatgccctaaaacaaactcactgttccaaatctgctacgaacccttagcaaaatcctttgtaaatttcatatgtccaccattttctcaactactcagactcaatattttgcattaagttgtatgctacaaaatgttaggtttaggatagggaattgaagacagactttctgctcttcaagagatcatggtctgacagatgttaaaacaagtgatctggtcagggtcaacgaaaatgctacaaaatgctgattatatattggttttaaaaagcataaataaatcaactattctcactactttgtgattaggatttgcttaaattgaagtcaggaagaattcaatgattattgtttctatattgaacattctgatgaagtacatttccatttctctgcttaagcatttttatccgtgacgtctttgttgaatgcttggcatgcattcaaccctaaactaatagactggggaagcaaagaaggtgatctaattcttattgcttcagtgctggaaagaactctaaaattatgaatctcattttctatccagtgattgccttttctccattctgtttctggctcatgacttctaatctacttgaatttatcatttgcatcattagaagttggcaatgacctttagatagctttgagtattaggaagcttttatattgatattttattttccagtcattttcatagtagtcatacagaacccaatgtgtggtaaaccaataaactttattccaactctgtttaataacatttcaaaataggaagacactttccatgggaattctcattcctagggtcactaatcttattaataatttcacaatttttttttgttcttgcttttttttagtttgcctccttaccgtccatccattcacctcttaactccagctcatccacattctttttaaagtatggtgcagaggattgggcacaaaatgctaaaattgagtttcttcagcactttgacaagtagaagtttcactgcaatttagctagatgttaaaatcctgttaatacaagctactaacgcattattctttgtgtgtgtatatgtgtggggcttcattaaattattgaaacattaaatacacaagtcaacccaaatactatattatctttgtcatcctacaatttggtgtatttctcccactatattcttcagtagttagtttctggcaattctgtctggagtccttagtaagttaagagtcctttttagtgttatgaccttaatttttttttctggagtaaatgttgacatacttaggaggctaactttattttatagagatattaagtactagaatgattattctgtgtcaatccgacctaaaagtgacctcatggttttttgaaaggtaaaaaatcatattatgtatattttctacactctaggtaaaatgcacataatatatcatattttacattaaattgactttaagtatattttaaagattctgaactgttatttcaaatttccctttcctcactacatttctggctaatggcttccaatccattcttgaggttggaataataaatgctcgtgtcaaatcggatcaaataaaagtattcaaaaggcaaggtagcatatcacctttacttgaattaaaagctttagaaggatcaggtgttacctggtttttttttattgaaaggtgtaatagcagaactgtgaaagggaaaacaaaatgaaaaacattcaacaaaaatgctgttaggataactccatttctggcttttgaaaataaagatactttatatatttatgaaggcaaatcgattcaggaaaatataatgacataacttaaaagtctttcagttagatcgtgtcacagatctgtgatatttaagctttttattctaatgggaatatcaatctcaagacttttaaaattgatagtgattgcttcatagtttttcaattaaccttctgaaaaaccataacaaaaataagaccctactttcttatctctttttttttacgaataatttctgtaaactaaatatgtgtgtgtgtgtgtgtgtgtgtgtgtgtgtttgtgtgtgtattttagagacagggtttcactctgctacctaggctggagtgcagtggcatgatatagctcactgcaacctcgaactcctggccgcaaggaatcctcttagcctcagcctcctgagtagctaggattataggcatgcaccatcatacctggctaatgttttgtagagatggaatctcactatgtcgcccaggcttaaatatagtttatatattttaaaaattttaggccgggcacggtggctcatgcctataatcccagcactttgggaggctgaggcgggaggatcacttgaggcctggagtttgagaccagcctggccaacatggtgaaaccccgtctctactaaaaatacaaaaaattagctgggcgtggtggcatgcgcctgtaattccagccattcaggaggctgaggcaggagaattgcttgaaccggggaggtggaggttgcagtgaggtaagatcgcaccactgcactccagcctgggcgacaacgtgagattctgttttaaaaaacataaataaataaaaataaaaatgtagatcctttttgaaataataacgtatgtaggttgttacacaatattatcatatctaaatattgaagataggacttatcaggcagccctgttggcaatagccctctagggtgtatattgtataaacatccctggcaggggtattctacacatgttagttggattcccctaggtcaggggtgtgtggtctataatatatgaaaaatgccctgaactctggacttttaaaaacagcaaaaggatatgtgaaaaccgttttaaaataccattttaaaatacaacaagacacctataaatacagctattttttcaaaagcaaaaggacatatgaaaaccatgagtaaaatataataagacacctataaatacagctatatcctctgcggactattgcattctatttattctttctttttgcaggatagatacataaagtcaggatctcattcttgctggagctacttacctgcctggacccacaccaccccctagttccaggcctggctctcccaccgctagctctgaacctgagtacgtcctataaacaacatgagcatctgtatctcccttcagaaaacaaatggtgcagtcatactcatcctgctgtgttaatgactatgttcataaaatgcgacactggactacgagttttaggaatcaaggagtgtgttttagtccactctttatgactggccttagtataatatctggcacatactgatatagaataaaaggtatcattacatgatacctttctatattatatccacatgtatcccatgatccatgttccatattatggaagggtggcaacgccctgtttcacgagtttcagattcaacttttgaaggaaacatgttttagtcattgcattggcagatggctccaggacttacatatttaaataacaaaaatgttggggataaaagtattccccaaacagttcaaaaagtttcataggtgggtaaaggaaccatccctttgaagaggaaagtcaacagtctgacttatttcaggtaaacaggttgataaagacaaagaaaggctgctttgttctaagtcttgcgttcctgcacctagaggacagatcccacattccagaataaaggcttaaataaaaatgcaagcatacaggaaataaaagagttcaaaaataaagggtactaagagagaggggtcatagattagcattaacaccatggtgaccacatcagccttaagtcaaggtcagactatttcatgcaagttatccctaaatggaagagtggaatgataaggctggaggaaaaaagagatggctatgggagtggtcttcagagttattctggttgggacctcagaactgaagacaaaggttgtgatgctccttgattgtcctctgtgagattcatagatgtcattaaaaccatgaagtacaggagctgcatttgcattatctgtttccatattccattttttttttgctttttcctttttttttgctactctctgtttcttttcacgaagaaagctgaaaatttattgtctttcacctgtcaagtgagatgctaaagtgatctgctagctgcttttacccatataatctcatttaatgttcaactaacactgcaaggtaggtagatatatttccattttataagtaagactgctgaatcttagaaagggcaaatcactgtgcaaggtgggcctcgtaaataatggactcatgtctatctgattccaaagcccacctgcttcccactctgccccaggtctccctattcccttttttactggttgttggctgacataataaaaactggaagtgtacacaataggacagtctcttagatatggacatcttctggtgaggggcggtatgcaatatcaggccccaggccataccagattaagcctctggacagtttgagatactctctggtattttcctacacgtggtctgggattctacgttgctcaggaggcaataatttggtgttaacatggaagacctagcttcctagcttcacagatcctgtctagaagacacttaaattttacagtgaatactacaaggtacaaagagtctttcattacagccacagtcaggacagactatgaagaagaaactgagctatagaaatacctattcactttaactctgggatataggatttagggtctaaatatattaggattgattatgacaactgcagaattcatttctagggacaaatgtaaaagtgtagacattcttagaaattatcacaatattgctgttttcccctatgccactttttcttgagggggcctagttaccttagaaagttcttgtcattgcttagctaacactacagccagcaaatagagatagagcttatgtgtttggctgagaaaataacataggagctctcttaggagaacctttctgttaatgtccctgtcatcatcatctttgtctattaactcacagtaaggacccaaaagactaaaaacaagataaacaccagtacctgtatggcagacacagcctttggacaagtgtcagcatttcgcaagtgcctgagatcacttcaaaatgtttaaatttttaaaatgccaagagggattacctctaaagtaatacaggaagttataatgttaagaaaaagaaatggttgaaggtaggattggttttaggcgaacgccattctcagaggctcatgacaacccgaagctctattttcctctagaaaataagggatgatggccgggcgcggttgctcacgcctgtaatcccagcactttgggaggctgaggcgcgtggatcacgaggtcaggagatcgagatcatccttgctaacacggtgaaaccccgtctctactaaaaatacaaaaaattagccaggcatggcggtgggcacctgtagtcccagctactcaggaggctgaggcaggagaatggcctgaacccgggaggcggagcttgcagtgagctgagattgagccactgcactccagcctgggcaacagagcgagactccgtctcaaaaaaaaaaaaaaaaagttcaacaagggagatggagccagtggcttctgggtggtttctgcctccagatcctccttgggatgactttctagttggaagcctagtgaaggatgtggtggaggcctcttggataacactcatatgtgctccttgctggtgggagacacgaaagactagcgcccgacttgcactggatagagggaaagacaactttgatcagattctgcctccaacagaggcacacaaagggctaaggcaatggagcaggggagtgtttgaggtgggatcatgtgtcatctctgtgagcatgagagtctcagagcatgaaatagacgtgggcagtgcaggggagctggcatggtgtgagtccttttgggttgccaggaggatccaggtcatggaagctaaacgaggctagagatgagccaccagatgtccaggggacaaagtggataagcacaggaacataacacattgactggtttctagaggttgcttaaaacaaacaaaaaaaataaaaatcctacttaatgtccttgcaatagctatgcacctgacctcataatcctttttcttcatgaacaataaaactcacactgaattttcagtagcaaagccagttaattctcagttgattctctttgaatctttccagaattcaaaagagagaacaaattcaatatagcatttaacaattacattgctatctgaagctgaaatatgtacatatataaacaaacctttggagactttctattttggtctgactctgaaggtagttgggagaaaattgtaaggtattcttatcaatcttgatttgtctttcatgctatgaacctattatttattctaataatacttatataaatattattctctactgccttgtctgtatttaaataaatctacagaagaaaatgatacagcatcaaaatagaaggaaatatacgaggttgtcttatagttgctggtaaccactgtttaatttcatccataaagttttctggtattaattaaggatattcattaatattactctgaggcacgtagtttaacattaataaggaagaaagccagctaagttattagagatccaatgttatgtcattaaaagtgtgagctgatttgaatttgagccacaggaaatgaaagtctgtgaaagtcaacaaccaaagcaggctactaataggttttaagaaagaaaatcaggctgggcacggtggctcatgcctgcaatcccagaactttgggaggctgaggcagacagactgcttgagctccggagttcaagaccagcctgggcaccatggcaaaactccatctctatcaaaaatacaaaaaattagccaggcttggtggcacatgcctgttgtcccagatacttgggaggctgaggtgggaggacggcttgaactgggaggcagaggttacagtgagccaagatcatgccactgtactccagcctgggccacagagccagatcccataaaaaaagagagagagagaaagaaagaaaagaaaagaagagaaaagaaagaaagaaagaaagaaaagaagagaaaagaaagaaagaaaaagaaagaaaagaaaaagaaagaaaagaaaaggaaagaaagaaagaaagaaagaaagaaagaaagaaagaaaggacggagggagggaaggacgaaggaaggaaggaaggaacgaaggaacgaagggagggaaggaaaatcagggcaggaataacacttgtactatgaagccagaaaaatgtaaacaataaaacatgaaaaactgttttgttgcagtagtttttctttcaaatgtatacagaagcatcagataccttcaaatagcaagagagtaagcaagcgatatcatggtgggaaaatgcatggttttataaattaaatacgatgctattgaggtctagtcatcctacacaaaagtggtgatcttttcttaatgaattcaccaagataccatggagcgtgcatggggtcactacagtctttcacttactttggcagggcacccctcacttcccacagacggagaagatggattcaagacgagagtgcgacgcttgcttaccacgggcctgtgcacgtcccagaacgctctctcttggctgtcaaggatcttcctttcaatcttgtctctcttcttgtccactctgtcaacacagtaacaatagataacatttagtattaattgtagtgcctctctgaacaaaaaggccacaactggaacaaatcttccaaacgactcacaaggactcactttgcttgtgcttctgcttgcatgaaaatgaactcccacttccgggcaaatgctctctgcagcctggccaggctctcctgaaaaacataccccaggtgaagacatttggtgttcattgtcactgctctcttctagcttagttaccacttgtatttgtcaaggaaacaaatagagagtttctaaagccctaagtgtactgtggttctcaatgataagtcatgctccctgaattcagctcatcttcatattggcagtcttaaaggaagcagaaaaacctgttacaaatatcgattttttgaattactgactttggagaacaggactacaaacccaatatgtatctgaaaaatactaaaattacctagtacataaggaggtgctcagatgaacccactggatttttcggtacccactttatagaggaacagaacatcagtacattcctactacgcatgcaatcagcctattcagttcctgacaatacatggcacaccctggcggcccacaacctattcctacacagtgctttgaattcagaaaatctaacatagcaaccatctgcacaaatgacagcagatgacttttatctgctgaagatcactgtcagcagagacaattttggcaaaacccactctttcccagggtaaatggtctttaatcctcagagtttggatatcttcactatgtaggatgtatctgacatttcgacagttaagtcgattttagaaaataagatatgcttcccttttatactttgagtttatgtatttagagttttgccatatgcaatgtgaatgaagagaggaagtaagcaaacagggattcatgcacccactgtgatgccagatccctagaaatctgacccttcagatccatgaatgaggctgggcgtggtggctcgtgcctgtaatcccaacactttaggaggctgaggcgggtagatcacctgaggtcaggagttcaagaccagcctggccaacatgacgaaacccagtctctactaaaaatacaaaaattatctgggcgtggtggtgcacgcctataatcccagctactccagaggctgaagcaggagaatcacttgaacctgggaggcagaggttgcagtgagccaagatcgtgccactgcactctagcctgggtgacaagagtgaaactccatctcaaaaaaaagaaaaagatccatgaatgaagagttaacatcctgcccagaaaaggctgtgggccttactgctgtgcattctatgactatctttgccagaaggtccttggtacttacagcctcatagtctgcgagctccagtcgtgccttgttttgcattgttctcttgcagaggtaaacggctgaaaaaaaaatcaatcatttcttgcctgcttatcaacaccatggcactataagtaaaagtacaacattacaaatcaagggcattgcacttttttcccaagttgtaatttttgatcattttcttagacaaaaaataattatgtaataacattattactgaaattcaagcatcatagtatttatgataccctaataaaataaatatgctaagaaacttggtaacttttttttttcagagatggtcttactctgtcaccctggctgaagcaagtgtagtggtaagatccttgttcactgcagccacacactcctaggctcaattgatcctttcgcctcagcctcccgagtagctgggactataggcgtgagccaccaagcctagctaattttatcgttattattattatttgtagagcagcttctcgctttgttgcccaggctggtcttgaactcctgggctcaagtgatccttccacctcggcctctcaaagtgctgagattataggcatgagacataatcatttaaaaatttttattaaatggtcatcacagtttttagcatcttcaacaaataagaggagaaaacaaaacctcctaaaagggtcaccaaatgaacttaaaaatctatatatccaaataaaatcattttgtgaaaaggaaattatgaattagtggcacattcaacgatgtccagattctactgtcaactgaaacaatctgttcatgtacactgaagacttcttgcatcttcttggcttcatttcacaagagccaatcttccatcgttttgtcactaggagaagggtatcacatcttacctaccttccacagtatttccattttcctgaggagtcgatggcctgggctaccatggaaagtccatctgggcagcagatttataggagaaggtggtgacagcagtgttgcaattgagcaaatttcttcaattatttcagggtattccagtgactctcatgacaaactcaaggcattcacagccctctggtagagtcccaattgccagaacatttttgtcattgtttttcactaaatatgcatgatatttgagtctcatgaaactcaagatacattgtatctgttctagatgctgagtaaatgcattggatgaggactgtcaaatattacttattgtaagtctacctctgtgagtttgccttggaaatatcacctttgcactacacttaccaccccaagttttggataacgacgtccagctggtatcactaaggaaacacactacacagaaaatttaagaccggtgcaaacaggaatactatttactcaatttctgtaaggtttcctgtatgaaagtcaagacgaaggagagagccaaccacagaatgatgctgacattcctacaaatgctaagaacccagtatatagtattagaacacatctttgtacaatctaccataataattttattgttctactaatattagtaatttttaaaagtcagacttcataaacaaaagtgacatgatgtgttcatttcctaattcatcataactgatgctcactcccgaaggatctcttactatagacgccactgtgacttgaataaaatatctaaaatgttctaagcagttgtaaaagaaattgaagcgtaagtgaaatacccctgagggtgtctcttcatgagagaaagatcaaattttcttaaatatctaattgaataatttcagctttcctgtggaattacctctgatgaaatttcaagccccagctatgccctccatcagtcacacctcctgtgtcctcctgcatcagcttctccttgctttattggttttgcccatctaatctttattatttgcaaaatcagctccctttggggaaatgtttctcaccattaggtaccctaatgccttaaagcaagagtgggatgattttattttttacatgactgctcacaaagacattatgtatcttgtaatacaggtgtcctatgatgtgatttttctttaattctctagggaaaaaaatgaaggtgcgggcagacagtgccaggcataaaatattggtatcacaaatatttgttgaatgagtgaattaacaaatgaatgaataggatatcttcagaaggagctatttcgaggtcaaatcaacttaagtgataaaatctccctaaatgtctacttgattctttggtataaagaaagacaggaagcagggcatggtggcttatttctgtggtcttagctacacttgggaggctgaggaaggaggatcatttgagactagtagtttgaggctgcagtgagctatgattgcaccactgcactccagactgggcaacagagcaagactctgtctcttaaaaaaataaaataaaataagaaagaaagaggcaaaaggtacaagtctgagttagcagtgtacagaataatctggtaactgttgaagatacagcaaatatgctcttgaccggataggcccagacctcatcagtctagtccagacacagttgctgtatgatgacaggtacagataatactttttattctttattagcagagagtatcagcattggtcaagatgtggatgaggcagaaggtccaagtagatcaaagatgattccaattcaggaaatttcccaattcattgaagactgacaaaatgaatgcactcatgcatagtcaaaactacagctcaggctgggcacattggctcatgcctgtaatcccagcaggttgggaggccgagatgggtggatcacaaggtcaggagttcaagaccagtgtggccaagatgctgaaacctcgtctctactaaaaatacaaaaaaattagccaagcatggtggcaggcgcctgtagtcccagctactggggaagctgagtcaggagaatcacatgaacccaggagacagaggttgcagtgagccaagatcatgccactgcactccagcctgggtgacagagcaagactccgtctaaaaaaaaacaaaaacaaaaacaaacaaacaaaaaacttcagctaaggcaaggtgcttttgtgccaatcctaattattttggcactgaacatgctctatatggtgctaggtatagacctaggcccagacccaaaagagtgaatcttttataacataaccccgaatatttcctgctgtgatgaaatattgaaaatatcaactaatgatgccatttttggggttctatttaaaatattttctattattaaagatgtaatttcaataccaagtttaaatatatctccctgcagtagttttctgggagatcatcaggagacaatttggaagacttgggaggtcaaacaagtaatttaacaggaggctatgccactaagtgggagaaagtttgggcaggcctgaagtgctactctggctaagaaagctccatagataaggcatagattttggcccaaatgcaacttagaacttagatggaaaagtcaaagtttctggatcccatctttgagtagaaacagaatagaaagtgagtgctgacgtcaggtcttcccctttaatttataaagctctagagaagctggagtggtctctcagacaacactgatgcccatgacaaaggtatgaaagcacatcacacaggtcagcgagaaaatcactaagaccccagtatcaaaatgtggaaagagtaggaatatatcattcaccaagactagaactacaaaagtccaataaatattttaaaattacccagcttacaacccaggtaatgcaaattaacttacattgtcatgctattcttttttttttctcttttaatgtttagtttgtggctaattcttctcttgttcctgaattttaaacagtcaggcagtttgtacaatcttccttctcatgcttgagtaattcaaagagtcccaagttatttgagagatgattgggtcatgaggatggaaccttccttaatgagattagtgcttttattaatagactcgaaggaggtggttcacccttctaccatgtggggacacagcaagacagtgccgactatgaaccagaaagtgggccctccccagacatcaaatcagttggcactttaatcctggacttctcaacctccagcattgtgagaaataaacgtttgctgtttataaacaaaacaaaacaaaagggtaccaagttattaatgagaatgttcatctcaagtaatgatcaaataatcatgcaaattgtgggtgagaagaagtgtgagtggcttctttctcccctccccaactcccttttgtgactctcaccaagaaccatgaactgaggcctctgatcctcctggggctggagtgtaggagaggaaaggggaagactgacatttttattacatttttcattggaatagaactttattatatttgatggagattttgaattttattgctgagataaaaaattaaatctggtatgtaacaaaaataaatatgtgcttcacaggagctttcctttattattttaacattaaaaatttttaaaatattttagttgataaatgagaaattgcatatatttatattgtgctacgtgatgttttaatataggttatacgctttgctatgactaaatcaagctaattaacatttccgtcacttcacattcttaccactttttgtgatgagaactttgaaaatctactctcggccgggtgcagtggatcatgcctgtaatctcagcagtttgggaggctgaggtgggcagatcacttgagctcaggagctcgagaccaacctggccaatatggtgaaaccctatctctactaaaaataccaaaatttagctgcgtgttgtggcgggtgcctgtaatctcagctactcgggaggctgaggcaggagaattgcttgaacccgggaggcgggggttgcagtgagctgagatcccaccattgcactccagcctgggtgacaagagcgaaactccatctcaaaacaaaaaacaaaaaacaaaaaacaaaaaactactctcttggcaattttcaagtattaatggtaactatcatcatcccgctatacaacagtcttccagaacttagtcctctaactgaaactttgcgctctttaaccaatatctgcccccactgcccccaggccctggtaatcaccattctactttttgcttctatgagataaacttttttcagattccacacgagtgacatcacgcagtatttgtgtttcagtgcctgacttatttcacttaacataatgtcctccaggcgcatcatgttgctgcaaatacaagattttttgtatttttaaaggctgaatagtatttcattgtgtatctatcccacattttctttacccattcgcctgttgctggacacttaggttgattctgtatcttggctattgtgaataatgttgtaatgaacgtggaagttcaggtatcacttccaaatactgattttattttctttgggtagatccccagaattggaattgctggatcctatggtagttctaggttcattatttgaggaacttctgtacagttttccataatggccgtactaatttacattcccaccagcaacagtgtatcagggttctcttttctccacattctccccaacgcttgttacctttcatcttttcaatcaaagccattcttacaagtgtgaggcaatatctcactgtggttctgatttgcatttccctgatgattagtgacggggaccaccttttcacatacctgttggccatttgtaggtcttcttttgaaaaatgtctatttaggtttcttgctcattatttaattggcttattcgtcttcctgcttcattgataccaccagggtgatctagcttgccactctctagacttggcaaaagtttaaagctccttatgatttttacggtacctttagcctctctctatgatgctgtttgcccctccagtctgccatgtaggacaggactgtctcacacagggtttagatgatgcctaagagaaacattcacacattttattttttgccttaatagaaggctgcagaacagagccacctccctttcaactcttccacccatagctagacagcctgcctcttgcccttcagaatcccatggcctacaagtctgtggcctattgtgttcccaggggtgcgtgactctcatctagcactctcagcagccccttgaagtctcttatcaggagtgagataaggcgcggtcacccctggctccatccactcagggctggtggaagcaatggctcccaacatcctatggattccagactcggtcttcaagacaatgccttgcccttagacccttgatgtgagcagaaagcaattactgggatcatgcatatgttagtggaacacagcccctttacacctgatcttgacccacttaacactttggctgggtttccatgttaacatcctgttacagaaaccattttccactcagcaaaacagcagagagtttaaaggggaataatccattctggcaaaagaagagtgaaagagagctgctggtgggcaaataaacaggggaaagtctccttggaaaggacgtgagagtgagtaataaagccttaaaacattcatggccataggctgggtgtagtggctcacacctgtaatcctagcattttgggagctgaggcaggcagattgcttgagctcaggagtttaagaccagcctggataacatggtgaaacccaatctctactaaaatacaaaaaattagctgggcttggtggtgcacacctgtaatcccagctccttgggaggctgaagcaggagaattgcttaaacccaggaggcagaggttgcagtgagccgagatcaggccactgcactccagcctgggcaacagttgaatgagactttgtttccaaaaaacccccaaaaaattcatggccataattctaggacttgcttttctaggactattacccaagggaataacaggaaagctagagggctaagaatacactatattaaatatggaaacacaaaggaaattgcaagaaaatcatgaatatctgttcaacaagatactagatcatcattcaaaatgatgtgtacaaattgttctacctaaaaagctgaaataacttgatttgtaaaacccttaattcctcctcattgtaaaagtccagaaaaatatataaagtaaaaaatatacagtaaatatatatgtctaaagtatttatatatttatatatgtaaagtatttatataaatatataaagtaaaatatatacagaaaaaatatataaagtaaaaaatcattataataccatttctgtcattatttggtatatagtttgattttcttttatatatacatctgctaatacacatatgaatatctgtttatatacaaaatctatatgcatatatttattttaagtgtgctcaaaactgtaccacacatgctgtattataaactttcttctttaatagtctgttgtggctaacttttcatatcaataagtgctggtctataatattttttaaaaaattatttcatggtaatccagtgctgagatgtaatgtaatttattttaatgagttcttattattggacatttgggtgatagctattattttgctattatatgctaacagttgtgtgaacatacacgcatgtatatatatgtgtctttatgtatgcatctttatttgtttttgaaattgccagtttcctgaaagggttattgctgagtcagggcccatgcacctttcaagacctgtgatctttataaccaaatttcagaaagtttagacatgagcatatatcagatgcttttcaactctggagagtctattttcagcaaagccatcagagttattctgttaagacataagtcagatagtcagtgtactcaaaaccctcccttttatctactacttcccatctcatctctctctaggaaaagccacagtccttactgccccattaagtgaccctctggatttatctcccattcaccttccaccctgcctgagcctcacaccagatgtcccctatgtcttctctcctttccgtctctggagagccctaccccagagctgaactgaattctctccagaatatcttcccccttctccaccaagcccctttcccagtttttctccacacaacttttcatgtcctaatgtacaacttatgcattcatttatgtagttaacttcttagtttttctccccctattcttcttccctccaccgacccaccagaatgtcacctccaccaggacagaggtttgcctattctgttcaccaatcaatccgcatggctagaagagtacctggcacatagtagatgctcaaaacatagttggggagtgaaaacatttgcctagtgttcattcgaggttttgtgttttcttttctttcttttcttttttctttcttttttttttttttttgctttgatgaattaactaattaactataatttgctgatttttctattgggtatttaacatttttaaattagacttaaggcccattaatacattagagataaaaactaatgttaggtatatatgaggaaatatgttttttccccaggttttgggggaaaagtttactaaacaatgcagaaaatattcagcatacttaagagaatactgatttggtgtatacacacacacacacagaggatcaacagtacatggtctgcaatctgctttttttcacttaaaataacattactgagatttacccaggctgttttcaatagatgtagcttatttcccttaactgctgtagtctatcctatgaatgtagctcacattgattagtcatatccctattactaaatacacaagttttttttctttttattttttcctttttctattacaaagaacaatccagtgaaagtttctctaagcatatattcctagaaatggtatcaaagggttgtggcgataggcacagtttgaattttatgacactgccaaaattgtcccataatacttgtccagtaatgtacaaatattcctaccttcattccagacttgaatttttgccaatccggcttgagagaggtgcattaaagtctaaccctttcagtagatttctgtgtctgttttcttgtatctccaacagttttcatatcacagattttaatttcaaaaatgtctacgaatcgattgtccccttcactaatgtggctcaatttaatactttttaccttggattattttttacttgaccaatattgcaagttcaaattttattttctacatgtatttgcctggtatatctttgcctcaccatttattttaaacgagtcagtgtgtcttacttctctttcctctggaaagatatttgtagattttatttaggatctaatctaaagatacttgttctttttacagatgaatttaaaaatccccattcatttttgaaagctgtttgtattccttttctcaagtcttcatcactctccctctctctgatggtatttcttttgttttctaccttttgttagatggagtgagttttctttcattcctacgtttataactggaaagtgacaaaacttgttaccactccgttagtggccatgctcatatctttgtacaaatgcttaaatatgtatttcttgaattttaatctcagaaactgaacactgcttattattgcttccctccataaatgatggagaaattagcatatcttcactccctccagtctttccaacttttttaattactagaatttatcataaactctgtcatagttttaaaaaataattatagcattcacattccattcagaaaatatttttatcacaattatttagattctgcagggcatgcagagaaagctggtgtcttggaaaattaaggctgaaaattttgtcttggaacagtggtttttttaaaaagtctatatttgctgaaattattttatcaaatctcagatgctccaaaattgggcacttcctatcttattttattattctatttgagacagggcctccctctgtcacccagactggagtgcagtggtacaaccattgttcaccatagccttgacctcctgggcttaagtaatcctcctgcctcagcctcctgaatagctgagactcacaggcacatgccaccatgcctggctaattttaaattttttgtagagatggggtctccccatattgcccaggttgatcttgaagtcccgggctccagcagttctcccgctctggcctcccacagtgctgggattcaggcgtgggccatcgctcctggccctgtgttaagttactcttatttctggtctttggagtttgcttgctcatttataagtgaggctgctacactggtgaagttcaaatagagactaatgctattaatcttgggtttcccatcacggctgttgaccagccactgcagcaatccttcaaggccactgcattgctctcctcccagtgtctcccctctaccctcgagcttgctccccagtgtctgagagagcctgtgctgctctataaactgaggtcacggacaaagctttctcctctggtgccacgctcatgcctaagaaaccttgctccaagatggggaaagcctttctgccctcccaggacccacttatttccagccctcatgcatcaatatggggaattcctactggggttggtcagaattccatccaatgctaatttctcgagaaagtctgacaccaccatgtcccttccatttggctaaattttattgattccagaaaaatgttaatttttcaaatgagtagtgtgtggtaccattctaatttccactctgtgctaataattccttttcctctggttttgctttctttttattctttgcaggaagagggagggaaaaattttggtaaacttctggaaagtatggtgtattagccaattgttacttgtaacatcaaccccaagactcaaatatattttgtaattatatttatgctgaatacacatatatttagaaccacagtgatttttggatttaaaaaaacacatactgcaattattcttattttcatgctaaagaaaaagataattatgttctttaaaaacagcattttcatggaatatgatgcagccataaaaaaggatgagttcatgtcctttgtagggacatggatgaagctggaaatcatcattctgagcaaactatcgcaaggtcagaaaaccaaacacagcatgttctcactcataggtgggaattgaacaatgagaacacttggacacagggaggggaacatcacacacggggggcctgtcgtggggtggggggctaggggaaggatagtattaggagaaatacctaatgtaaatgacgagttaatgggtgcagcaaaccaacatggcacatgtatacatatgaaacaaacctgcacgttgtgcacatgtaccctagaacttaaagtataataataaaaaaaagcagggttttcaaaataattcttcaaataaaggtattttaaatttactgttagtagagtactttaaaatctagcattaatttaaagatttagacattagcaatgcacttataagaatgaaaagttaaagaataatttggagaattttatttttaaaatttatgactcaacagcaactgaaacatttattaagtgcaagggaaattgaatcttaataaaaacaactagcaataatattataaaatttgtttttaattatttaattttctgatacatagtaataaagactgtgttgtcataaagtaagagtaagagttaactactatatgggatcatataccttgataaaagaagatttactaggataagaaaggtgtactatgaacgttgaatactggactataaaaatctttttttttttttgagagagagtcttgctctgtcacccaggctggagtgtcatagtggcatctcagctcactgttatctccacctccctggttcaagctattctccagcctcagcctcccgagtagctggaattacaggcatgcatagccaggcccagctaacttttgtgtttttagtagagatagggtttcaccatgttggccaggccggtcttgaacccctgagcacaagtgatccacccgccttggcctcccaaactgctgggattacaagcatgagccaccgtgcccggcctgtgcaaatctttaaataccctcctgggaggtggtgtccttaaggagaaagaattcctttaggacagttctggaataatggccaggaactattaataggaaaagaattagacctgtgaatttctgtttctcccaaaggaaagggaaatgtcattgaacgattctaccatgagcctacttacaattctgctctatcataaggcggttacatgtattatccagagccttaaattaacaatccaaggaagaagctactgtcctgtttatttaattgatggtaatgatgaaacccagagagctcaagtcctctctcggggccacatagtatgtcggcaagtcgggggttcttgggtctcagtgatcacaaaacagatacgacacacaaaacgtgaaggcagtggcaatgaaggagacaattccactctggctctcagtgctgaaaagggagaaatatgcttctgttctttgaagtgtccatttttcttggggtccattttttttcatttctgagaatatggcttctcctttaagaactgttattgtcattctaaaggtttactgattgaattcagctccctctgcattcatccctaaactacattacagattgtatgttacccttactctcactgcggaaattgctgatgaaacaaaatagagccatttaatttaccctttcgttttaaatataacaatgtcaccggtgtctgatgttccccttcctgtgtccatgtgctctcattgttcaattcccacctatgagtgagaacatgtggtgtttggttttttgtccttgcaacagtttgctgagaatgatggtttccagtttcatccatgtccctacaaaggacatgaactcatcattttttatggctgcatagtattccatggtgtgtatgtgccacattttcttaatccagtctatcgttgttggacatttgggttggttccaagtctttgctgttgtggggtggggggatgggggagggatagcattaggagataaacctactgctaaatgacgagttaatgggtgcagcacaccaacatggcacatgtatacatatgtaacaaacctgtacgttgtgcacatgtaccctaaaacttaaagtataataataataaaaattttttaaaaaaacaaaaaacaatgtcactataacaaatctgaaaggtgtggctgcttttctcacgttcatgcgttttggcaacttgtagttccttaaggtgtgacggatactctcttcttcccaaatgtactttcttcatctcctttaaacctcacattaaatcctcattatttgctgattccctgcctggaaattgcctacttactaaaatttgtttgtagccctcaaatcaataactcatggagctttcacggttattcatggccattcacagagtggcaaattctcaagtcacctaacagtcacatgaccagctgatgtcaaccaagacaatgctcggcctcctgttccagctctcatactgtaaacaaacatcctttttgtgggacatgtggtgccacattttttgcatttatgcttttggttgacaatcttgctatttaaaatggcccctgggcatggtggctcatgcctataatcccagcactttgggaggctgaggcgggtggatcacctgaggtcaggagttcaagaccagcctggccaacatggtgaaaccccgtctctactaaaaatacaaaaattagccaggcgtggtggcacacgtctataatcccagctactcgggaggctgaggcaggagaatcgctcgaacctgggaggcagaggttgtagtgagctgagatcacgccattgcactccagcctgggcgacaagagcaaaaactccatctcaaaaaaaaaaaaaaaaaaaaaaaaaaaggccccaagagtagtattgaagtgctgtctagtgtttctcaatcagggaaggctgtggcgtgccttacggaaaaattaacgtgttagataagcttcattcaggcatgagttatagtgctgttgcctgtgagctcagtatgaattaaaaatatacattaaataagatgtctttaaacagaaacacatatgcatgaagattgtgggttgatccattgacaaaaaaatgtgaccaggggcttgcaggaaacttatcctgtatttcccccaggatcaatgattcagtatcccctaattcagcgttcaaggtaactttataaaacattgctactctggataagaagaatcacacatgtgtttgtgtcttattccctctgctggagaacactgatgaatgtttttgtatactgcagggctacagtaaccaaaacagcatggtattggtacaaaaacaggcacatagagcaatggaacagaatagagagcccagaaatgagggaacattcctgcaaccatttgatcttccacaaagctgacaaaaacaagcaatggggaaaagattccctattcaataaatggtgcgggataactggctagccatatgcagaagattgaagctagatcccttctttacaccatatacaaaattcaacttaagatggattaaatacttaaatgtcaaacccaaaactataaactctggaagatgacctaggcaataccatcctggacacaggaacgggcaaagattttatgacaaagacaccaaaagcaactgcaacaaaagcgaaaattgacaaatagtatctaattaaacttaagagcttctgcacagcagaagaaattaccaacagagtaaagagacaacctatagaataggagaaaatatttgcaaactatgcatctgacaaaggtctactatccagcatctataaggaacttaaatttacaagagcaaaacaaacaactgcattaaaagtgggcaaaggacatgaacagacacttttccaaacaagacatgtatgtggccaacaatcacatgataaaaaggttcaatgtcactgatcattagagaaatgcaaatcaaaaccacaatgacataccatctcacaccattcagaatggctattactaaaaagtcaaaaaacaacagatgctggcgaggttgcagagaaaagagaacacttgcacactcttggtgggagtgtaaattgttcaaccattgtggaaagcagtatggcaacttctcaaagagctaaaaacagaactaccattggacccagcaatcccattactgggactatactgagaggaacagaaatcattctcccataaagacacatgccaatgttcactgtagcactattcacaatagcaaagacatggaatcagcctaaatacacatcaaggacagattggataaagaaaatgtggtgcagctacatcatgggatacgatgcagccatgagaaagaatgagatcatgtcttttgagggaacatggatggagctggaggccattatccttagtaaactcatgcaggaacagaaaaccaaatgccacatgttctcacttataagtgggagctaaatgatgagaactcatggacacgaagaggggagcaacagacactgggatctacttgagagtggagggtgggaggaggaagaggagcagaaaaacattaagtattgggtaccaggcttaatacctgggtaatgaaataatctgtacaccaaacccctgtgacacgagtttatctgtataacaaacctgcgcacatactcccaaacctaagataaaagttttaaaacaggacgttttctgtaacaataacacatacaaaactctcatattctatacctcctaacttcattctttcataggtaacattatttgctcttttgcttatcgtattatttttaaaccaatgcaatatctattttaaaaaatgtaataaagtaagaaataccatactttaactgttatgataattataattctgagccactgttccaagcaaaatggttaaaatatttccatgtaaatgttcatgtaatactttcatgtaaatctcccataatactaggtcaagggttcttaatttctctgtctcttatttaaacatatcaaccaaagtgacaggttctgagagtttgcacctttttaaagtaccacaataatccatccagtggaacatgacacccaatggataagcccagaggagccgtgtgactttcaaaggaaagttctgtcattcaaatctgtgctcattgaatctggactaaaagaatcatggttgaattattcgttgaatattttggtaaatgagacactaaaataactgtatccaaccctgtggcatcttgcttaataaaataactgtctataaaaatgtaaaccccaaatgatcttcaaacacatatttcattgaatatctgaacctgtttccacttgattccttcccattcccactcctcaccgctctctccctttctctttctttttcttctttctcaaataaaaagagagagacataagcagagtgttaaaaataaaggatgatctaaccaatacgagactgagagtcccaaactgctgctaaattactcaggacattagagtcagactatgcctagaatagaaaaagggcaattttcaatctttttctccccaaaaggcccagcaacatggggaagaaaatagtgatcatttgcttaattgtctgatcctctgatcactaatatggaaagacacattcacagatattctagaacatgccatgtggtataatagaaggaacaatggcccatgagtttgaagaccttgggttctggccttcctgttaactatgatattggatgagtctctagaccatcctgatttgctcacctgtgtaatgagaataaagatacttggtgtgtctattccataggactgaggtaagaattcttggagatgatgtgttggagagttctgtgttaactacagacggaaagtaatgtatggaattactagatatattgtactttcaggtcactgcataagtttctactcaaaagaaaattatagcaagttcttttataaatgaaatatccttttgaagatcattttgagtatataggttttttttttttttttttttgagatggagtcttgctcttttgcccaggccggagtgcagtggcgcgatcttggctcactgcaagctctgcctcctgggttcacgccattctcctgcctcagcctcccgagtagctgggactgcaggcccctgccaccacgcccggctcattttttgtatttttagtagagatggggtttcaccgtgttagccaggatggtctcaatctcctgacttcgtgatctgcccgcctcggcctcccaaagtcctgggattacaggcgtgagagtatatagttttatatagagttcttttttaagtgagataccacagggttggacctagagttatcttagtgtctcatttgacaagtgtctcttccttgtagaactgcaatgaatttgcactgccaagatttgtaaacaatatcgattaattacatgtgtctgttgcatcttgaatatactgccaatgatttttaaatatttttttaaattatctcaaaatatatttcaatttaaaacatgtaactagttttattaagtgtttaatggatacctcagtgtcattaaactatatttttaattttctatttaattattaattctttctgttccctcattccttttatttgtgttatcacttatcttgctacccaaacgttgcatacaattaatcagctgatcactattttctatcagtagcttccccatgttgctgggccacttggggatacaaaagattgaaaactactctttttctattcacatatttattcaacaaacatgcactgggtgcctactatattggtgatgggattgggagtatagacaaagcttctatcctcaatgaggttacattatagagaaatactaagcaaaaaatgtcttggacagggcagaaaagacagcactgcagttgcacccgcacaggtgatgtccctcaagaacgcagttcctggagctgggaccacgttaattcttctgtctacctgcagagggcgccattgcaccaggtacgctttcagtctcacctggtaaaactagaagatggcagctttacaaagaatttcaagaatcctaaaacagtaaaggggtcttatgtgggctaattgcatgaggtgctgaacttaagtatcttcagttgctggagaaaagcagaaattctgcgtttaaggggagaaaatggaggaaaagtgagacaggtgtgtgtggatactggatgtattcatttgtttcaccttgtgcccggcttttcctaaggcctggagacccggcgatgaacgcagttggctatcattgctctcagagggcttactttgtactggtctgtggtgtgacaatgtagaataatgtgaataaagtaataacaatgtccaaaatttattgaatgctttccatgagccaagaactattcaagaatttcacatacattatcttgtttaaactgcacagccgcgcgttgagaagaggtgctatcaactttcccattttgctgatgaggcaatttaggctggatgagaggacgagactgagtactactttcttggtggaggcgacagtcaaagccaggcattagaccggaatcgactcagttaaccactaggctgtgtgtgacagctggaggttagggaacgcggaggcagagagagggaagcagcgggtgcaaagggcagagctacttcggattttatgacggtcaaaggcctcaatgaagaaagaggtaacatttgtttttgttttgtttttgagacggagtcccactctattgcccaggctgtagtgcagtggtgcgatcgcggctcactgcaacctccacctcccgggttcaagcgattctccttgcctcagcgtcccaagcagctgggactacaggcgcccgccaccacgcccgggtaatttttgtatttttggtagagatggggtttcaccacgtcggccaggctggtcttgaactcctgacctcaggtgatctgcccgccttggcctcccaaagtgctgggattacagacgtgagccactgcacctggcgagaggtaacttttgaattgaaatctaaattgtaagagggaatcaactccaggaatatctagaggcagagagcaccatcggtacagcaagggggactgccctgagcagaaaataagcagggaacgtttcagaaaaagtccaggaatgggacaccagcagcagggtggctagagctggagggaagggagaggttatgtcagggctgagccgggagcctacggagccctggctaggggctcaggttcgctatcgcaatggaaactcctgggagctgtgagagcagtgatatgatgggatttacacgtaattatttctccgcttctaggaggcgactggatggtaaaagcaagagcaggtagcagacttttaaataacaataataatcgtggtaatgatacaataggaaaacaacacagcattggtgttatcttgatcggtgaaatacattagttttttgttgttgttccaaatcagcccacttggttctgttacttatctaactagagatcagtctgatatgacgcatggtgattttgaaataccagcacagaacatccctgagatgacggtgatctgaaaagagccctggccctgttcttgtagtgtcccctcctccatcgcatgcgcacactagaggctgatggtggttcgcggatgctaccaagaaggtacaaaaagctgattttacagggatttgtctgacccgtgtacaattatctctcagagtttccaccttttgtttcttcactcctcctatttgccaaaacagtcactggtttgcagagacttccctccccacactctgccctcccgtactcagtcctgcaaaacggagcttgtgtcaaatgaaacaatctccgtttcctggtggacatacttccttgatctctggggcttctgcccttcttttttttttgagacggagtctcgctctgtcaccaggctggagggcagtggcgcaatctcggctcactgcaacctctgccttctgggttcaagtgattctcctgcctcagcctcctgagtagctgggcctacaggcgtgcgccaccacacccagctaatttttgtgtttttagtagagatggggtttcactatgttggcccaaatggtctcgatctcttgaccttgtgatccgcccaccttggcctcctaaagtgctgggattacaggggtgagccaccatacccagccttgcctcctttttagaagaagattatgataatactaacaatagcttgaagataataatgagaataatgaaaataagtattgcttaaagttaaaaataatgaaaataaataatgcttgaagagaatgataatgaaaatagtaacagcaacaataataataatagttaacatttcactagcatttgccatgtgccaggcactgtgattgtgctttatagattaattatttctccaaacaaccctgtgcagtgggtgtattattgttacttctatttttcagaaaaggaaactgaggcacagagagtttacaggatttgttcttgttgcacagctaataaatggctgcattggaatttgaacccagttgtctgggaagagccattctaatttggagaaatatttagtacaatctctgatcaaggacaaatcctaaaatgtagcttggagagcagtttaatatccaatggcaagaaccgccattcattttgcaccaacctaatgcatactcctgctgaaaaaaagaggcctacgatattcttgagagtgcaaggaaaggatagtgacatcacctgatcaatgcagaaagaaaggattatagtgagacaaaactttgcaagactcttaagaaacagtggctttaacttcatcaaatttgctacctgctcttagttgagtaacaagtaagtcatctgtcctctctgagccagattcctgaaaaacaggtaatttaattatttttttccagcatcactgggggggtggttatgaaaattgaaggaaattatcaatgtaaaagctttctgaaagcttgtaacatattatgcaaatgtaagattaactatatctgcaatgcaactgattatcagttctttagtgaagtgtaatgataattctaagtgttacttcagattcaaatgaacatataattttagaaataaactagaatttggcctcacgaccttggccataactttcttttttataataaccaaccatatatttatattcagaatctctctataatgcatctatttcttcaagctatatttaaaatatattaagtaagaaattaaaatgaagtcatttttttcaaacgtacaatgtaattttatattaaattttaaagctaaatgcattcattcagtgattaatttgtttaatgtgccaggcaatattccaggcactaagatagagatatataattcagaccaacattcttagtctcctaattccttgtgttaaatggaggaaacaaataagtaggtaaacaataattaattttaatattttgctatacatttcacaggtaagtggataacccccatgactttgcaattcaaatttagtgtgtcagacacttccatatatgttatctcctgtgaagttcagggtagctgtgtgagttaaaagaaccacacatttaatttgttgctttcttattagatggctcagaatggaaaagggttggcgaaagttttcagagctagaagtgacagagccagggctggaatagaggctttagggcaagaagttctgagaagaccccagagactctgagaggacgggaggatcttatcatcactgagcaagatactgccccaggggtggtagtttatggtttttattcctcacactgcttccttatttagtgagcatgtaagttaattaaatcagagtatgtataatgcatcatataactctatgctaatggttcccttagtatatcttatgtttctcttatgtactttgcttgcattctcttctgaggcccctagtaatgacgtgtccttttagaatatgaaattaaaaccaagtattctaaattgctttcatcatctggaaattttgatgtatttttgacatcttacaattatgtcccttaaaatttctctagaggttctagaacaagggctatttttttgtatgctcacttgactgcaatttcaagctatggaaataagtgatcaatattctcccaagccaaaagccccgtaggacaaccataaagctcctcagtgaaattcagaaatggtcatctaaaacgttgcttttcacagccctacatttttctttcttactgctgttaagttgagcctaaagctgtcttcttacatattttaagttgggcctaggggtttctccatacataataaactggaacctaactgtatgtgtaaacaacctactcttgtaccaatcactgagttttggtcaacaaaaggcagctcactgttgaaactgtgtcaaataaggaaaatgtcaagctgaaccaatctggctgtttcttttcctcacttctattttccatgagccgtgttctgttttctgtccataaatctttttcaaccacagtctctctgaacctattctgatttggggctgcctgatttggaaatcattctttgctcaattaaactctgttgaactatttctctaagatttttcttttaactatcaatctgagtatagatacttagtgtctttagagctaaatgtgttgcaactagatcacataataaatttcaagaatcaagaacacttatttattcattcactcaatacatctttttgaatatctagttaagtgataaatactgtcctaggaactaggaacgctaagataaataagatgtagttcttgaactcccaagaggatcaatccagtgaaatagacagctgactgacccagtcctcatgaccaccatctactgtggggccagtgaaaatcgaagaaggctttcctaaactggcaatacggttgttgagtcttaaaggacctagagtgttaacatagccataaactttctacgtgactcagtttttctttgattaacttatccattgcattattaagataaatccattaataatgaatagttgcagtaaagacatctttaagaaaacgattttgcttttaagtaaagcagcaggtgagtttttatatgtaagagctcgtcaggagttaattttctttctcttccctgattcatttagcttatgttaaaccaggcatatttctcccatagtatttaaaaacaaatatttaaccacatttctctgaaaattatttaggaataggtcttaatatccttctatttgaaatgagagccttcccttattagaaaaatcttcatgatgcttagaaagactgcattaaaaaaaaacaaaactccaaaacttgagaatatatagtcctttaaatctgcagttccactgaacaacctaaaaagttctgtgaatacccacagaggaaaaggaaacccagttctattttgcaacttccattgcaatttcttccttgaaatttttaattattttgagtgagattaaaagttactaagcatatgagattgaagagtttttcataactgatatattattgttatgtgtcattttaattccactttgacttgaacttcaaaattaatcattgtaaaacaatcagtgcttatttgggcattgatcaatttcttttatccaaactgcttctcgaatctcattccttttttcttggtttaatttcctgcttatagaaggctatttttagtagatctcttagtgatggtctgtgaatggaaaactctttcaatattggttgtcaaatttaaataatatcatatctggctatacaaatataggttacctgatattttctctcagtgccttgaaactattcttcatttctgaccttcatgagtgcttatacaattttggagataggctacgtatttattcttttgctgctttaaaatcctcctttataaaagtaaagtctctttttccttgagtttcttcaagtttggggaggtgcatctattggcagactttacattttcaccaactgtaactagcgctcagtgtctttcaaaatttgaggatttatgtccttgttcagttctaaaaactacctcaactatgatttcagtaaatactgcttgtttcttgtgctctcctactgaaacccctctcatgtgttctcttctgggtctaacatcctttactctatgtgttttaacctctcttccatattttccatctccttatgcaactgtgcagcattctagatctttcttccaatttacttgtgcactgaggttttaattataacgaccatatttatttgtataatatttgtattattacaaagcctctttggttgtttatcaaatcttcctggaatttttcctgatttttttttctaatattatctagctctcatatcattttttgcgggtaattttatataattttaatggtctaaaaatattatttagattattctaatataaatttcttgtcaatctgtttacttttctttatgatacagtgttttcttgggtggtttctcattttcgttgctagctcaccttcagaagaataggttttcttatgggaattccatgtgcaatggactaggaaacaatattctatagcaattttagctttactttttccaggtgatatagtttggatatttgtccccacccaaatttcatgttgaattgtaatccccaatgccagtgatggggcctggtgggaggtgtttggaccatgaggatggaacagtccgtcatggcttggggctgtcccatgatagtgagttctcgtgagatctggtcatctaaaagtgtgtggcccttccccctcactctctccctcttgctcctgcactatgtgacatgcttgttctcttttcaccttccaccatgattgaaagctccctgaggcttcaccagaagccaagaagatgccagcacgatgcttcctgaacagcctgcagaaccatgagccaattaaacctcttttttctttctttttctttctttctttctttcttttttctttctttttagttatactttaagttctagggtacaggtgcacaatgtgcaggtttgttacatacatatacatgtgccatgttggtgtgctgcacccattaacgtgtcatttacattaggtatatctcctaatgctatccctcccccctcctccaccccatgacaggccccggtgtgtgatgttccccatcctgtgtccatgtgttctcattgttcaattcccacctatgagtgagaacatgcggtgcttggttttctgtccttgccatagtttgctcagaatgatggttaccagcttcatccatgtccctacaaaggacatgaactcatccttttttatggctgcatagtattccatggtgtatatgtgccacattttcttaatccagtctatcattgatggacatttggcttggttccaagtctttgctattgtgaatagtgccgcaataaacgtacatgtgcatgtgtctttatagcagcatgatttataatcctttaggtatatacccagtaatgggattgctgggtcaaatggtatttctagttctagatccttgaggaatcactgcgctgtcttccacaatggttgacctagtttacagtcccaccaacagtgtaaaagtgtttctatttctccacatcctctccagcaactgttgtttcctgacttcttaatgatcgccattctaactggtatgagatggtatgtcattatggttttgatttgcatttctctgatggccagtgatgatgagattttttcatgtgtcttttggctgcataaatgtcttcttttgagaagtgtctgttcatatcctttgcccactttttgatggggttgattttttcttgtaagtttgtttaagttcttcatagattctggatattagccctttgtcagatgggtagattgtaaacattttctcccattctgtaggttgcctgttcactctgatggtagtttcttttgctgtgcagaagctctttagtttaattagatcccatttgtcaattttgtcttttgttgccattgcttttggtgttttagacatgaagtcctcgcccacgcctatgtcctgaatggtattgcccaggattacttttagggtttgtatggttttaggtctaacatttaagtctttaatccatcttgaaataatttttgtataaggtgtaaggaagggatccagtttcagctttctacctatggctagccagttttcccagcaccatttattaaatagggaatcctttccccatttcttgtttttgtcaggtttgtcaaagatcagatggttgtagatgtgtggtattatttctgagggctccgttctgttccactggtctatatctctgttttggtaccagtaccatgcggtttggttactgcagccttgtagtatagtttgaagtcaggttagcgtgatgcctccagctttgttcttttggcttaggattgttttggcaatgtgggctcttttttggttccatatgaactttaaagtagttttttccagttctgtgaagaaagtcattggcagcttgatggggatagcattgcatctataaattaccttgggcactatggccattttcatgatattgattcttcctatccatgagcatggaatgttattccatttgtttgtgtcttcttttatttcgttgagcagtggtttgtagttctccttgaagaggtccttcacatcccttgtaagttggactcctaggtattttattctctttgaagcaattgtgaatgggagttcactcatgatttggctgtttgtctgttattggtgtacaggaatgcttgtgatttttgtacattgattttatatcctgagactttgctcaatttgcttatcagcttaaggagattttgtgctgagatgatggggttttctaaataatacaatcatgtcatctgcaaatagggacaatttgacttcctcttttcctaattgaatatcctttatttctttctcctgcctgagtgccctagccagaacttccaacactatgttgaataggaatggtgagagagggcatccctgtcttgtgccagttttcaaagggaatgcttccagtttttgcccattcagtatgatattggctgtgggtctgtcataaatagctcttattattttgagatacatcccatcaatacctagtttattgagaatttttagcatgaagtgccgctgaattttgtcaaaggccttttctgcatctattgagataatcatgtggtttttgtctttgtttctgtttatatgatggattacttttattgatttgcttatgttgaaccagccttgcatcccagggataaagccaacttgaccatggtggataagctttttgatgtgctgctggattcggtttgcccgtattttattgaggatttttgcatcaatgttcatcagggatattggtctaaaattctctttttttgttgagtttctgccaggctttggtatcaggatgacgctggcctcataaaatgagttagggaggattccttctttttctattgattggaatagtttcacaaggaatggtaccagctcctctttttacctgtggtagaatttggctgtgaatccgtctggtaccggacgtttttcggttggtaggctattaattattgcctcaatttcaaagcctgttattggtctattcagggattccacttcttcctggtttagccttgggagtgtgtatgtgtccagaaatttatccatttcttctagattttctagtttatttgcgtagaggtgtttatagtattctctgatggtagtttgtatttctgtgggattggtggtgatataccctttatcattttttattgcatctatttgattcttctctctcttcttcttgattagtcttgctagtggtctgtcaattttgttgatcttttcaaaaaaccagctcctggattcattgattttttgaagggttttttgtgtctctatttccttcagttctgctcggatcttagttatttcttgccttctgcaagcttttgaatgtgtttgctcttgcttctctagttcttttaattgtgatgttacggtgtcaattttacatctttcctgctttctcttgtggtcatttagtggtataaatttccctctacacactgctttaaatgtgtcccagagattctggtatgttgtgtctttgttctcattggtttcaaagaacatctttatttctgccttcattttgttatgtacccagtagtcattcaggagcaggttgttcagtttccatgtagttgagcgcttttgagtgagtttcttaatcctgacttctagtttgattgcactgtggtctgagagacagtttgttataatttctgttcttttacatttgctgaggagtgctttacttccaactatgtggtcaattttggaataagtgtgatgtggtcctgagaagaatgtatattctgttgatttggggtggagaattccgtagatgtctattaggtctgcttggtgcagagctgagttcaattcctggatatccttgttaactttctgtctcgttgatctgtctaatgttgacagtgggatgttaaaatctcccattattactgtgtgggagtctaagtctctttgtaggtctctaaggacttgctttatgaatctgggtgctcctgtattgggtgcatatatatttaggatagttagctcttcttattgaattgatccctttaccattatgtaatggccttctttgtctcttctgatctttgttagtttaaaatctgttttaccagagactaggattgcaatccttgcttttttttgttttccatttgcttggtagatcttcctccatccctttattttgagcctatgtgttgtctctgtacatgagacgggtctcctgaatacagcacactgatgggtcttgactctttatccaatttgccagcctgtgtcttttaattgaagcatttagcccatttacatttaaggttaatattgttatgtgtgaatttgatcctgtcattatgatgttcgatggttattttgctcattagttgatgtggtttcttcctagcatcgatggtctttacaatttggcatgttttagcaatggctggtaccagttgttcctttccatgtttagtgcttccttcaggagctcttataaggcaggcctggtggtgacaaaatctctcagcaattgcttgtccgtaaaggattttatttctccttcacttaggaagcttagtttggctgcatatgaaattctgggttgaaaattcttttctttaagaatgttgaatgttggcccctactctcttctggcttgtagagtttctgctgagagatcagctgttagtctgatgggcttccctttgtgggtaacctgacctttctctctggctgcccttaacatttttttccttcatttcaactttggtgaatctgacaattatgtgtcttagagttgctcttctcgaggtgtatctttgtggcgttctctgtatttcctgaatttgaatgttggcctgccttgctaggtaggtgaagttctcctggaaaatatcctgaagagtgttttccaacttggttccattctccctgtcaatttcagatacaccaatcagatgaagatttggtcttttcacatagttccatatttcttgaggctttgttcatttctttatactcttttttctctaaacttctcttctcgctccatttcattcatttgatcttcaatcactgataccctttcttccacttgatcgaatcggctattgaagcttgtgtatgtgtcacgtagttctcatgccacggttttcagctacatcaggtcatttaaggtcttctctacgctgtttattctagttagccattcgtctaatcttttttcaaggtttttagcttctttgaaatgggtttgaacatcctcctttagctcagagaagtttgttattaccgatcgtctgaagccttcttctcccaactcctcaaagtcattctccatccagctttgttccgttgctggcgaggagctgcattcctttggaggagaagaggcactctgatttttagaattttcagcttttctgctctggttactccccatctttgtggttttatctacctttggtctttgatgatggtgacgtacagatggggttttggtgtggatgtcctttctgtttgttagttttccctctaacggtcaggaccctcagctgcaggtttgttggagtttgctggaggtccactccagaccctgtttgcctgggtatcaccagctgaggctacacaacaacaaatatttcagaacagcaaatgttgctgtctgatccttcctctggaagcttcatctcagaggggcacccagtcatatgaggtgtcagttgacccctactgggatgtgcctcccagttaggctactcgggggtcagggacccacttgaggaggcggtctgtccattctcagatctccaactctgtgctgggagaagcactactctcttcaaagctgtcagacaggggcgtttaagtctgcagaagtttctgctgccttttgttcagctatgccctgccaccagaggtggagtctacagaggcaggcaggccttcttgagctgcggtgggctccacccagttcgagcttcctggccgatttgtttacctactcaagcctcagcagtggcagacacccctcccccagcctcgctgctgccttgcagttcgatctcagactgctgtgctagcagtgagcgaggctccgtgggtgtgggaccctccgagccaggcatgggatataatctcctggtgtgccgtttgctaagaccattggaaaagtgcagtattagggtgggagtgtcccgattttccaggtactgtctatcacagcttcccttggctaggaaagggaattccccgaccccttgtgcttcccaggtgaggcgatgccccaccctgcttcagctcatggtccgtgggctgctcccactgtctgacaagccccagtgagatgaacctggtacctcagttggaaatgcagaaatcacccgtcttctgcgtcgctcatgctgggagctgtagactggagctgttcctattcagccatcttggaacaagaaccaaaactcttttctttataaattacccagtctcaggtatttacagcaatgcaagaataacctaccacaccacgtattccaagggctcgaaagcctgaacccagtttttatgtttatttattggcttggtgattcctgacatcatacttacgcatagcacaggcttggggttttacttcttctaagatactaacttgtttctctttccacttccttattgcttccctgggttggttggcatagttataatggcttgacgttgaggtcctgtctttcttctggggtctcagtcactactcctcactacgtatggtctccaagtcatgttcactgtcactttgggagcattactcctcattcccactcctagtggaatattaaatccagtattctcccagacctctgcaggctttcaaacttatcactcttcatttaaattcattcttcgtttctcacatctagttatatattttctctgatacacctagtaatgtattgttacatttttagctaccatttctttgtgtctaaagaaatagggcatttgttttagttctgacaaccctttatgttaagggtcaatagagccatcgaaatgtttttctctccagattttattcatcagaaaggctgctttcctttaggaagttgtcccacaaaatggtttccataaattcaatcaattggtaagacagaaggtctcagttgaaaactatttcaaatgcaaactactaaaaccatcagggaggtaaaaatctaatgtttcttgtcaactatatagaaaaatatgtttttgtaaacaattggttgagtttaaactacaaaaaactacaaataagaagcattacaactatttagacatatctctacttactatagaacctttgctgtgaagagctaatctcatggtaatattttgccaagatgatgaaataaaatgttaacttaaaataaatatattttatttggctaccattgttatttctctttttttctggagtacactatcattacatttctttgcacctttaacagggaaattttaggacatgattatatgcatgagccctgggtcacattttaagccacaaaaccagaaagacaagatgtttctaatgtttgatgctgtcccttctattcaactgccatatatgctcatatattttaattttttaaaaatagagacaaacttccactatgttgcccaggctggtctttaagtcagacaaatgcaattacttgattccaagatggtagattactggtttgtttacaatagagagaaactaggaaacaaaactaaatatttaaacaactatgggacatctaaatgacagaacgttatgcaactattaaaacaatgtttttgtagagaattaaatgatattagtaacttatcataacataatatcaagcaaataataggacatacaattgtattttgaagaatatgtatatgtgtttaaaagtagcaaaatgcaacatagtataattttagaaatgctaataattcctaggtcattttaggttgccttgtgttatcttgtattttctttccatactttgaaagttttctacagggaataaaaattacttttataataaaaatccaagaaaaacatattggtgttctgatagcaaagtttaaataatcatgaaggcagagttcagacttttcaagaccatgctgcacagaattatgagtgacaacaacatgggttatgccacaaagaatcagctgtcaaaaagaagaggaaacaaatatatcaaagtaggccagaaaatttgctcatcagtgctgtctgctagaactttctgtgataacagaaatgtggtatgtctgtgctgtccaatatgatagccattagccacatgtggctacagagcacttgaaatgtgactaggagatgaaggaacagaatttttaatttaatttaagtgatatttaaattttttaatttaaatagtcatatgtaattaatggcttccatgttggacagcacaaatctccttcgtcacttaagggttattgcctattcattagtgggaagaataatatatttatatcaatgatatgttaattatatattaaaaataaataattatagataattatagttggcagaactggcctagttattttccccacaacaatgctgatcttcctatgatgagtccaagattttgcaacatttggcttttgctatggtttggatatctgacccctccaagcctcatgttgaaatctgatccccatgatggtggtggggcctaatgggaggtgtttgggtcatgggtacagatccctcacgaatggcttggtgccatcctagtggtaatgagtgaattctctttttagcaaccataagagctggttgttaaaaagagccttgcactttcccacctcacttgtgcttcctctcttgcaatgtgatctctgcacgtcagctctccttcaccttctcccatgagaggaagcagcctgagggcctcaccagaagcaggtgctggtgccatgcttcttgtacagtctgcagaactgtgagccaaataaacctcttttgtttataaattacccagagtccgctattccttcctagcaacactaaatgaactaagatagcttttaattacaacggtggcatctgttactactctgcattctcatcttcattccaggtaagtaaattttaagttttggcttctcttagttccaagacacaacataagtcattccctgtttttgggaggagagagtcaggatggagaaaagaataaaatttattgaaaatttaaaattaagataattaactatgtgaactaaaagtgagtaatataataccttctcccagaaaagatcaggacgggagtgttacaaagctttgacatttcttaaagtgcactctgctgcattttgtgtgtggtctatgtgtaatagctcatcttcaacacacacatacaaacacacactcaagtgtgagaataaaattaacttattttcttatgtaattttggagtaagtttatttagagtcatatgttttgtatttttattgaaatatatgcttgttacctgcagttttgtaaaaggatagcatttattctctctctcttccttcctctgtctctctcaaattgcccagagggattaatcaacagaaatctaaattttagaaaacctgctttaaaagagtacttgttctctattttgagtttatgggacaaatgaaactgttctttcaatgggtgttggcaaagaaggtctggaaaagtttatatgaattgccaagcatggaatattgatcattagccaatcaagctggatgatactggacattatacttagtccacagaagaataatataggtatatggatataaacatatttttaaaatgttgaataagggacagttcagatctttttcaatttcagttcataatgcatggtattttcaatgctccatgcatggctaaatacacaaacatcataaatgattctaaagcatgatagggtgcttgcccttaaaaattaccagtagctaacacttttgccagttcagggtacaaaaaaaataaagaccaggagatgctaaaatgatccatatcactatggttataaactttgaaacttacaatgcacaccttaaaatcaaagtttccaaggaaaccaatgaatatattttaagacaagaataatatgatttgcaaatcaaaatccatttaagactgttgccacagcactatgtgttgattggtgcttgccatatttttttaggaagtcagaaaaaaaaatcttatgttccatgaatccagcaataactaagactgcaaccctgattttcttacccgtctgccttgttaacatgatatatgtcaaacataatgaagaatatgtaaaagaacccttgttaccaacaaagattttgcaatatcttcaatacagagaatagaagaaccagaaagaagcagcgacaggtaggcggagagaggaagggaggaaactactgactgagtaaccatgtatgattgggaataaaatgggatctcaaaatcagattccattttgcacccaaccacaactgagaaaactgaggctcaaaaaagtgaagtcattgacacaaggtgttgactattaattgctgagtcaggatatgaagcccagttagtctgattccaaaacttatattcttcctggtggatcagacagaaggaatgggaaaatgcaatgcactcagggtgctcagtggaagcgttggagtgtggagttcaagtcctgagcgaatgtattcctggataaagaattagtcatcaggggaaggtcatgctggagctacgctgaagggtaaagtttgtttttggactctacctgtttcctctccttggctctaagatgacatgcaccagggatctcacctctaatcccgccattgcatgaagagaatgccttgcacatgactagatgctcaacaagtatttgtaaatgtgcatcttaaaaattggtcatgtcagttacgatgtgaaattcaccagtgaaaatgctagctggggctttgaacctggagctactaatttcccaggttccatctcataccatctgcccggcatagtcctaccacccatattgccacactggttttagcagggcaatcctctgaaagtatttttgctacagtggcttgaggcatagtaatactagatggagactaggaactctaagcaaatatctataaagttcacaacaaggctgtgttgatcactctggaaagaggtggtgaaacgattctctttgatgactcctcctgtgtctgcgtatctgtgctttggatagcccacacaggtacatcattaaatgccctcccagggtactgcaccagcctttgagcaggatttaaccttcagagtgcactcagcaattgcaaagtagtgtgctggtgactccattcccagacgtccctcttgacacactgaactctagagtgtttcatctcgtggtatgaaccaagaattggaacagtcacttgggcagagggattctaggtcctccgtataacctaagcaaagacatttttcttttccaagctagaaaaacatgcctaaaacagaaataagtataagcagtctttgcaagccttaccatttctacctccctctggggaatccaacctgtggtatagcactggacctggacaaatagcacagtgatctactaggagtacaatgtgttatcactgttgcttttattataacagctggcagctggccaaagctttgcaaagaaaccagaaagcaacagcagggcactgggctgccttagaaaaacatttcttggctcaaagaggagcctctttaacaagaacccaacacctcaaacctagcaaaaaagcatagctcaggtcaatcacataaaacacagcttcacaaaatctgtcccataacaaagctagaaatacaatggtgtaataaatttggtatacctaagagcctgagaaaaggtacagctgcttaagaataagttatagaaaatctttgttaaatactctagggaaggattcaggcatcttcctacttatctaactttttagtgtattctaaacttggccaggaaggagaggtgtgatcttggcttggtgattcctgtagatctccggactttggctgcctcacctttacctgaaactgttgaatgggatgctagattccctccagctctgacattccatgactaaagaaagtcaaggtttaacactgaccttgacatcctggggcaatggagagttttagtgtatgcaattgtcatgcctgaaaaaatgtcaaaacatggttagggttcctctccttgttcaggagaataaaatagtatattttaaatatgctagtataaatcttataaataaaatagtataaatctcccttctgttaagagaatgtagaaataaaataaataaaatactaaatactaaatagtattagtatagtaaatagaaataaaataaataaaatactaaatcgtagaaataaaatactaaatactaaaataataaaatactaaagtttgctcaaggaaaagatgaagttagatatgtgtttccttttaaggaggttttcatgaaagaattttttttggcagatcacttgagcttaaaaggagtattgttgtttcagaaatagcacaaaaagctgttccccaacaagggatgcagcagaggcagaatgtttaccacctagggtgttagtgaaaggccctgtctctaaacatcccacgttgagataacttcaatgtttgatcaaaaagtaaatcttatcccgtaataagtgagcaacgttctgtttcccctcacccctcaatattgaagcaatgacaagataagtcctctcctgtagacacatttaccaaccaagtgaaacatggcgtcttgtcggccttaaccgctagacttgagagaatggaattttcatgaaataagagtgccgatccataaaatacatgccattcgttttgatttaaattataaacaatcttatccatggtcttcttttatttttattttttaattttcccttccattctttgatttttaaggagtctccttacaaagtcagaacagtttttgtttttaccatagccaccatggttaactttttctttagaaaaatgttcagtgatatccaagggcagaaaaccaaacaccacatgttctcactcgtaggtgggaactgaacaatgagaacacctggacacagggcgaggaacatcacacaccggggcctgtcgtggggtggggggaggggggagggatagcattaggagagatacctaatgtaaacgacgagttaatgggtgcagtgaaccaacatggcacatgtatacatatgtaacaaacctgcacattgtgcacaagtaccttagaacttaaagcataataaaaattaaattaaattaaaaaaagaaaaattttcaatgaaacaaatgcacttcctgaagttactaagcctacacaaatgaatgaatgaacgaatgtctttcctgtagttcttaagcccacatgaacaaatgaatgaatgaatcaatcaatcaacgtctttcctatagttgttaagcctacatttacgtaaaggggagttgctcttacactgacactgtcaaaaccctctacctcccttccactccctccctgccaggtaaaagctccacctaagatagaaggcaacccaggttccaaagtaattcctccctcacctgtgaatgaccagaattattatcctctaagtgcttctattgtcacttgaaaaaggtacctgcttacctgattcaattaattcacaagaaaactaggaggaccgcttggtttacccaaggaattgggactaggaaagtttgttaatgtgaacaagccacctaaatctgtgattctcaaagaaagacctgaattccattgctctgaggactagaaaacagcccagggctgcaagtgtttccttcaggttgcagggaaacaacatgcaaaaaggttatgctaacatttggaacgcacgaactaaatttgcttgttaataaaatttcctgagacctctaattcggactttcctagaaagtctgcctgtcacatcatacgcagcagaatcacaaagttgtgaatgcacacgtccttggataattgggattccagtaattttccattccaagaggatgttttattactgctcctcagtgttctgagttggtcatgattttcagagactgatgtttatgaatttaagttgaaaatttatgtttatgttatcctcatcaatttagtttgttataagttgtttggtgaatcccatacagtgcaatgaagcatatttgcatcaatgacatttctagactataaacttccaattatttcaccaataaaatatgtatactttacagtacaaatgcgagttatccataccccatcttctgaaacaaatatgtctgttttccttgtatattcccacccctagtctacaattttgcctatatagtgtcactttattattatcgctaagttatttttctacctataacttacctagagtaagataacacagccatggaatcttttaccctacctaaatgtgtcataacaagatgtctttgaaactcagctctaaatgctagcatggatggaaaactatggttccatttgcaaggctggcttacagagcacaaggagatacagttatgaaagggctggactacgacagaagtagtaggccaatagatctatatagtcagctttttgtcatgtaatttattaactatgacacaaatgcatttaagaatatcaagtatttctctggctcttgacacagttgacttaaccttttgctgtctaaggaactgaggctttcctgttctgggtgctactggcaaatgttctagtacttgaagtcgggatgcacagcttcaaccactgacttatcagtgcagccacctgtgtattgcaactggccattaaattaaacaccgagccacctgggtttagttcggtcacttccataagtgtatttagcattggtagccctgctttattaaagtgcagcagacgtgctcttctgtcccttctgtcccttctgtttgtggttctttgggaaagttctgatatttgcttttgttttgtgcttgctttcgtgtttttatatcttgtatttatccctgaacatatttcgaacatttttttaaggaaagaaattcttttgtgtatatatagatacttgcatgatatactgtcatcaagtttcggttcctcaaaaggtcttggagctgtcaggtgtgatgtactccaaccatcaaagttctgtggaacacggtttgtatgtaaataaatgtggggcgtttggcccttgaaaccggaagacattacggtaggtgaaataagccagaaacagaaagttaaataacgcatgtgctcattcatatgtggaagctaaaaaatagttgatcttacagaagcaaaaagtagaacagaggaaactagaggctgggataggcaggaggaagaggggttagggagaaattggttaaaggatagaaatttagagctagagaggaggaataaattctagtgttctgtagcactgtaacatgactatagttaacaataatgcatggtttcaaagagctagaaagaggatactgaatgttcccagcacaaagaaataatagtgtttgagataatgaatatgctaattaccctgatctaatcaccgtatattatatgtattgcaacatcactatgtaccctataaatacatacaactattatgtgtcaattaatttttttttgagacagagtctcactctgtggcccaggctggagtgcagtggtgtcatctcagctcactgcaacctccgcctcccaggttcaaggggattctcatgcctcagcctcccaagttcctggaattaaaggtgtgtgccacaacgcccaactaattttttttatttttagtagagatggggtttctccatgttggtcaggccaggcaatgatccacctgcctcggcctcccaaagtgctgggattacaggcctgagccatcatacctggccaattaaaaaaaaattttttttaaagaattctctagttcattcctactatattctgggcaaaagctaaacatctgtgccagacgcatttattgtctttctctctctcaatctctctcctttcattgaagcttccctttaattcccaaataaatccaactcccttccatattgaacaccataccactgactcagcatcatttacatcttgcagggaggttctttctctgtctttttccccttatctattcatccatccatccatctctttctctcatttcattgccaaatatttgggaaagcagtccaaggttactgctgcctttgcttcttcacctctcatcctctccctgaaatctgatctccctacatctctcattttctctcttgattcttcttctggtgatttcttcttaaatgttaatgttctctaggttccaacttgggccctctttttgtcttagtctacatgtcctctctgaatgatctcatccacgaccatggctttaactataacctgactctagtgattcaaaaatctttctgtccaacaccaatctcttgtctttactttagaattggatagccactgcatactgggtgcctatagctaaacatccagctatctgtaagtcttgtaaacacaacaacggtatggaaatccaactgaaaaacactcatgcccagtggaccatgaatttaaggcaagtctgatggtgtgagaaaagcataaaacccagtcagaaaccttgggttccaatcccagctcaattgtttttagtcatagggcaggtcctctatctatctgactgtgatttttcacttgtagagtatggcttactgtactttaaagattttctggccgggcgcagtggctcacgcctgtaatcccagcactttgggaggctgaggtgggcggatcatgaggttaggagatggagactatcctggctaacacggtgaaacctggtctctactaaaaataccaaaaaaaaaaaaaaattagccaggcgaagtggcaggggcctgtagttccagctactcgggagggtgaggcaagagaatggcgtgaacccatgaggcggagcttgcagtgagctgagatcgtgccactgcactccagcctgggcgacacagcgagattctgtctcaaaaaaaaaaaaaaaaaaaaaaaaaaagattttctgtgagggattaaatcagataatgtatgtaaaggtgtgatgtaagctggtaagtgttattccaatttctgatatgctattatttaaaatgtagttggacaagcaggagtaacatttaaaatgagacaaaaagtacaagccaccagaaatgcaaatatcaaattaatttgtcccagtaaactaaatataaatagtttttacactttaatgtacatctgaaagagcttattaataatgtcaatgcttgagctacagcccagatttaattggttgggaaagaggtcagtaatctttacttcaaaatcattccaattgtcacaggcaagtcagggccacacttcaagaaatagtgaaatataatgcacttgagggatggtcaatcctcaaaatattctaaagacttgtaaaggcttcagaactagttccttcttgagaagcacattgcttcttttgctgagttcaaattgtaatgaatttcaaggcttccaattctgggcttcttacataaagcaatcattccttcctcactcccaacacaaacacataatttttaatatataaataaatatatatatttacatttgcatattctgttttcattaatggaatttttttcctgtatactacatgagtaataatgtaaagacacgaaataaaacagacactaattaggcatgtttgaacatctgttgctaccaaacattttctatttctcttttcatatctctgctgatgggtttagatgaaaagactacaagcctgcatacttacagggaggaaggagccaaactggaaaaccagtagcacaggtcggtaggaattaatctcagcaggctcgcttcagcattcggagacacaaccagcaaaacacttccaagctggtggctcagttaatatgtgaagctatttttagtacaacagagagcatttctagagattgagattataaaccagggatacatcccaaacatattaatatggttttaattttattttacagataccatgtttcagaatattttaatctccatgtgaataattgtttttattttgtatgtatgcatgatgtaagtatgcatacagtacatttatatgcacgagcattattcatatacatgcatacctacatgtaaaaatctgggtaagagagtaaatcagatgttttagtccttgtatatataaggtaaaagccagaccttttaatgacttacacatttgatcaggaagttttgtgttttgaaatgacaaaaacttggaatattttcgaaaggagtagaatactttcggccataattttcatttttaagatgccttaaatgttttagttccttttaataaataatcttacacaatgagttggttctcactgtcgtattaggtaaatgggttttgttgttgttcgtttttgctaaaatgggttttgttgttttttgtttttgctaaaacgaaaaaacttcctttttattaaggaagttatatgaaagtccatcacttccacaaattaggaggctacactactgcaatttggctgaatcagtggatatttttaatgttgcttattttgtgctttaaaattgcagttatcccagagcatctgtaattttgttttttttttattttgaacaaactgttatctgttaaattaacaataagaaaaatgttattttatctatgtttattcattcttcaaaattcttccttttgttttttttgtttttttaattttcttttttttattattattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccacaacagaatgatgatgagatattcctggtaagatgtaatgttttatttttcttcctggatctatctctgatcttgttccagggcacatcaatttagaaacactcatcgattatgatagctttgagaacaaacattggaacattaacatgctaattttgttctttacaggttgatggtagaaaatgtataaagtttaaaaacatgcaagtcttattagcattctgcttagataaatacaatcttattttatttctctctccttttattcatgccctgccaattgagagtgccaggtttctctccttttctgtttcacagcagctccaaagctaaagggaaaccaaggtggaaaataattaccccaaaagagacattttccatgacactaatggctggatttcagatactttccaaagctcattggaaagggagaactcatggagaagaaacaaccaactttaagtatcccattactctcagaggttgactcagagcctattccatgtagaaatactgaagagggtgtaaaaaagaacgaaaagcagaaacaaaataaataaataaaaacaacatagtcatgctttgtttatccttctttcccttgcaaacatctgctctctggagtctgctctggcatttaaggagcttggaagtcatccctcccatccaatctcacaaagaaaaaaaaagctgaagaagtaaaaaccaacaattcctctgaaatccctcagaggattgatgtcagagggcaaaccattgaccccatgattggagacaaagacagaaatgtacagagaatcatgacctagagtaacagaaacctttgggaaaaccaacattgggatagaaaaacttaaactgcaactgattagttgttcgaggctcaatgtggattaatttgagcattaaaaactcctttgaggatcagggagcagttttaagggggctaccacacatttgtgacttttacttccaggagccctactaggtttgcacaatgagggtcagggagaaatttcctaatgcttccaacaaggaacagggaaaaagtaaccattccgaaatacacccaggtcactctgttcttcttatggcctgtctcaaaagaaactgtattacccagagcccaacagactgagattatagcagagcctaaaccaccggggagtagggaaatatccaactccagcccctctatccttcccattgcacctaaagaggaaaaacccccaaaacccaaggagcacatgtggagatcatggcccaggggtagaggctcactgtgggactgggtcctaatcatcagattatacaaagcatcccccttcccctgcaccttaccacaataccagtagggctcctgtataataacagatgaacgcaacggaaagaactgtatgacccatgccttatttaagaagaagtttctaggaaaacccaaagacaacagcggggaataaaaacaaggacatcagaggagatgttagcctctaaagcctctagctacagcaaacagtaaacacagctcaattactagccagataaacataaaacctcacagtaatggcctgtatgcctcatttatttagtacatcacatcctactgtcaacaacaaaaaaaattccaaggcacactaaaagacaaaaaacacagtttgaagagtcagagcaagcatgagaaccagactaaatatggaaaatatatgggaatcatcaggtatgaaattaaaaggaactatgatgaaattcaagaaataaaaaacataatagaaatgaagaatgaaaaattagttcatcaatagactggacatgattgaggaaagaatcagtagagtttggacatgtgtcaaaagaaacctccaaactgaaatacaaagagaaaaaaaagtataaaaaagacaggaaatgtcaggcgcagtggctcatgctgtaatcccagcactttgggaggccaaggcagtctgatcacttgaggccaggagttcaagaccagcctggccaacatggtgaaaccctgtgtctactaaaaataccaaaaaaaaaaaaaaaaaaaaaattagcacatggtggctcatgcttgtaatgccagctattaaggaggctgagcatgagaattgcttgaactcaggaggcagaggttgcagtgagccaagatcatgccattgcacttcagcctgggtgacagagtgagacactgtcaaaaaaaaaaaaaaaaaaatagagagagaaagagaggacagaacagaatgtctaaaaactgtgggggtaattataatataaaaggcataacatacatgtaatgggaaaatcagagaagaaagaaaagaacagaagacatatttgaagcaataataactgagattttccccaagttaatgacagatattgttatgagcttaattatgtcctcctgttcccccagcctcaacttatgtcaaagccctaactcccagtaacctcagaatgtggctgtatttagagataaagccattaaagaggtaatgaaggtcacatgagatcataagggtgaggtcccaatccaatatgactggtgttgttctaagaggaagagactcaggagatgggcctatacagggaaaaggccatgtgaggacacgggaaggtggccttctgaaagccaaggagagagcctcaagagaaatcaatcctgccagcaccttgttcttggacttccagtagccagagcacttctaccctcatatttattgatgagataataaatttctattgtctaagccatacagtctgttatattttgttatggtggctctagtaaaggaatccaccaagccacacaacaaggaaactcaaacaacaccaagcacaataactatcagagcaaccacagacatatcacattttgacttcagagaaccaaacatgaagagaaattttgaaaggagcgagggtggatgggatgagggaaaccttacctggagagaaaaaataaaataactgctttgaatttctcatcagaaaccatgcaagcaagaagagagtggggtgatagatttaaagtctctaaagaaaaaacccattaacctagaattctgtatcttgtggaattatcaaaagtgaaggaaaaacaaagactttcttagaaaaacaaaaactgagagaatttgttgacaaaagacctgccttgaaaagaatgtttaaaaacagttcttcagaaaaagggagaatgatataggttgaaactacataaagaaaggaagactattagagaaggagtaaatgtacgtcaaacaaaatctctttatagaaagtttcttaattgatctgatggataaaaaagtgttcaaaatgataccagcaacaatgcaattggtggttatagcctaaaggaaaggaatgacagcaatattataagagataagaaggagaaagtaggaatactctgttatgggatagttgcattacatgttaagtgtacagtgttacctaaaaatggacttggattcgttgtaaatgtatattgctaactctagaaaaactgtaagacatttaaaaggaattataattgatactgggcaaaaagggaaaacagaattatataaaatgttcatttaaaatcagagaaggcagaaagagacaggaagacaaaaggaaactaatataaaacagttataaacattaatgtaacagttatagatattaaaccaacaatattaataaccactttaaatgtgaatgatatacatcaagtaaaagacagggactatcagagtggatataaaacagaaccaactatattctgtttagaagaaacttgctttaaatacaaagacacagattaaaagttaaaggatgaggaaagatatgccatgctaaaactaatcaaaataaagctaaattagataaattaatttcagacaaagactctagaaaaaacatttttcagggataaatttcttttattgcataacaacagaaggttcaattctccacaaagacataacaaccttaatgtgtatgtgcttaacgacagagcatcaaaatacttgaggtaaaaactgacagattacaaagagaaatggatgaacaattactatcactggaggcttccacacacatatatctgtggttgacagatctagcaggcagaaaatcaggaaggacagaatcaaactaagcagcaccatcaatcagctgaatttaatggccatttatagaataattaatgcaacagcaacagaatctatagtcatctcaagttctcatgacatgcaccaagatagaccacattctaggtcataagacacaccttaaaaatgtaaaagaatagaagtctttcaaagtatgatctcaaacaatagaattaaactagaaatcaacaacagaaagaagctggaaaatctcaaagtacctaaaaattaaacagtacacttctaaacaacacacgggccaaagaagaagtctcgggagaaattttaaagtatttcaagctaaatgaaaatgaaaatacatgttatcaaaattcacaggatgtagtgaaagcagtgcctagaaggaagttgaatgcatatattagaataaagaaagatctaaaatcaataatctaaattcccatcttagaaaactagaagaacaaaagcaaattaaatctaagccaaacagaagaaaacaaataataaaaatcagagcagaaatcaataaaattgaaaatcaatagagaaattcaacgaaaccaaaatctgggtgcttaaaacaattaatattgatgagcctctagccaggctaattaagaaaaaaaaaagaagacaccaattactggtataataactgaaaaggaggccatcactgctgatcccctttatcctaaaaatagtaaaagaatattatgaacaactcaaccccacaaatttgataacaaatttttggttcaaaaatttgaaccaagtttttgaaagatacaatctactgaaactcacactaggagaaatagataatctaaataggcttatacttattgaagaaattgaatcaacaataacaacttaccaaaacagaaagccaccaagcccagataacttcactggggaattctaccaaacatttgaggaagaaataatactccgtacaatctcttccagaaaatagaagcagaggaatattttctaactaattctacaaggccagcattactctaataccaaagtcattaaaaaattaccaaaaaggaagactacagaccaatacttctcataaacatagatgcaaaaaccaccaacaaaatattagcatattatatccaacaatgtataaaatattatacatcatgaccaggtgatatttattccatatatgcaagaatggttgacaatttatacattaattaatgtaacccatcacatcaacaggctaaagaaaaatcatgcaatcatatcaatacatgcagagaaatcatttgccaaaatctagcaccagtcatgataaaaacccttagcaaactagaaatatagaggaatgctcccaacttgataaaaaaaaatgcctacaaaaaacctacagctaatatagtacaaatgaaaagtctctcttctccctgccctcatgcctaagtcagagtctcctaaagaaccgaacagctgaggaagctcttcattggagggctgagctttgaaacaaggtgagagcctgaggggccattttcagcaatggggaatgctcatggactgtgtggtaatgagagattcaaacatcaagagctccatgggctttgggtttgtcacataggccactgtggagaatggggatgtggccatgaatggaaggccacacaaggtggatgggagagttgtggaaccaaagagagctgtctcaagagaagattctcaaagaccaggtgcccacttaactgtgaaaaacatatttgttggtggcattaaagaagacacagaagaacatcacctaagagattattttgaacagtttggaaaaattgaagggattgaaatcatgactgattgaggcaatggcaagaaaagaggctttgcctttgtaatctttgatgactatgactccgtggataagacggtcattcagaaataccacactgtgaatggccacaactgtgaagttaggaaagccctgtcaaagcaagagatagctagtgcttcatgcagccaaagaggtcgaagtggttctggaaactttggtggtgatcgtggtggtggttttggtgggaatgacaactttggtcgtggaggaaacttcagtggtcatggtggctttggtggcagctgttgtggtggtggatatggtggcagtggggatggctataatggatttggtaatgatgccagcaattttggaggtggtggaagctacaatgattttggcaattacaacaatcaatcttcacattttggacccatgaagcgaggaaactttggaggcagaagctctggcctctatggtgatggaggccaatactttgtcaaaccatgaaactaaggtggctatggtggttgcagtaacagcagtagctacggcagtggcagaagattttaattaggaaacaaagcttagcggaagaggagagccagagaagtgacagggaagctacaggttaccacagatttgtgaactcagccaagcacagtggtggcagggcctagctgctacaaagaagacatgttttagacaaatactcacgtgtatgggcaaaaaacttgaggactgtatttgtgactaattgtatgacaggttattttagtttctgttctgtggaaagtgtaaagcattccaagcattccaacaaagggtcttaatgtagatttttttttttcacccatgctgttgattgctaaatgtaatagtttgattgtgatgctgaataaatgtcttttttttttaatgtactgtataaagttagtctgctctgaagccatcttggtaaatttcccccaacagtgggaagttagaattccttcagggtgatgccaggttctatttggaatttatacacaacctgcttgggtggagaagccgttgtcttcagaaaccttgctatagttgaactgatagttactgttgtgacctgaagttcaccattaaaaggaaatagccaagcaaaatcataaaattattggttataaaaatgagtgttggcacatcttatgcaatatactaaattgaataatggtaccagaaaaaactatagatgggaatgaagattgtgtaacatctattatcatgtgtaatcaataaatgatttaattctcttgaagaaaaaaaaaactagatgctttcccactaaaataaggaaaaatgcaagaatgtcccctctcgctactcctatttgccattgtactggagtcctaggtaatggaataagacaagaaaaagaaaaaaagggtatatagtttgataaggatgaaataaatctttgttcaggaagacatgtttgtctaggtagacaatctcaaagaaacaacaacaacaaaaactcttagaactaagtgatcatagcaaagttgcagggtacaaaaaaagtcagcggttttcctatgtaccagcaatgaaaaattgaaatatgaatttcaaaacacaatactatttatgtaagcagcaaaacttaggcatacatctaacaaagtatatagaagatatatattaataagagtacaaaattcttttaaaagaaatcaaagatcaaaatcaatggaaagacataccaaatatgtggataagaagactcaatattattaagatgtgagttctttccaacttgacctgtgaattcaatgcaatctccatataaatcctagcatactttgaggatattgacaaaccgattccaaagttgaagtggaaagcaaaagacccaaattacacaacacaatactgaaggaatgcaatgacagagagttgacactaccaaacttcaaaacttactataaacctatagtaatcgaggcagtgtggtattggcaaaagaagaaaaaaaataaatcaaggaaaaagaatagagatttcaggaagagacttagacaaggtagaaaaggtaatcgaatggagagaagatcctattttcaaaaaatggtgctggaacaactagacctctacatgcaaaaaaaataaatatagactccagattttactaatttcacaaaaattaacttaaaataaattatacaactaaaaataaactgtaaaactataaaacctttagaatataacataggagaaaatctaggtgaccttgagtttggcaatgactttttagacacaacatcaaaagcacaatctatgagaaaaaattgtaagttggaatttattaaaatttaaaactttgattcttttaaatacaccattaagacactgaaagacaaactacagactgggggaaaatctttgcaaaacgtatctgataaagcactggtatccacaatatacaaggaactcttacaattcaacaataagaaaacaacacaattaaaaaatcggcaaaatataatatctgaacagaaaactcaacaaagaagacgaacacttggcaaatatgcatgtgaagaggtgctcaatatcatatgttattagagaactgtaaatttaaaaaacaatgagataccacatctattaaatgactaaaatccaaaacattgaaaacactaaatgctggtaaggatgtggagcaacaggaacttgcattcattgctggtgggaatgcaaaatagtgtagccactttggaagactggaagtttcttacaaagctaaatatactcttaccatatgatccactttcctaggtatttgctcaaatgaattggaaacttatgtcttcaaaaaaattctgtacatgaaggtttatagcagctcaactcgtaattgccatatgtggaattgattaagatgttcttcaatgggtgactggataaactatggtatattcataaaatggaatattcagtgataaaaagcaatgaaatatcctgccatgcaaagacatggagaaactataacaaatcttgttaagtgaaagaagaaaaggctctacactgtgtaattccaaccctatgacattctgtaaaaggtaaaactatggagacagtgaaaagataagtgtgtgccaggggttagggtaggggtatggataaataggcagaacacagagaatctttagggcagtgaaactaaatggtggataaatgttatacatttctgaaaacccacagaatgtataacacaaagaattaaccctaatataaactatggacttttgttaacaattatgtattaatcttggctcattaattgtaacaaacatactatattatggtaagtttttaattataggggaacgtataggtggtactgaggcattttgttggaactctctgcatattttgtttaattttctgtaaactttgagattctctgaaaaaaatgaagtccattaatttttaaaactctgctccctagaacatgattttaggagccactaacacctggcttcaaaaacagacatgcagggatggattcattaaaagtgaatgacaaaggcttggaaagttcttcagaggacaataaaatagaactgtagaggccctcttacagctcttataaaacaagcaactgtgtaaattaaatgccaaatggaatccagatgaaaaaaaaaaaacacacacaatttgtcttaacggaatggatatatttgaaagcactgcaatgttttagataaagaaataaataatgtctacttttagaaaaatgaatttctttcactttccccaatatcttaaattctcagttttctaatattatagataatggaattattaatggattatgcagatatttaaggcactgttattttatcagctattcaaggttcaagacacagttctaaagtcatataggctattaatttggttttatgtgtttatttcaaaattcttttaaattagttcaccatgtatttgatctctttagttggtcataaatcccttgtcatctcttccccaaaacaaaactttggatatggcaagctttctaccaatggtaactgaccaacttaaaatctgtccctgaaggaaaaattactatttatctcaaatctgctataattattttatgtcagcctacaattgctgtggttggccaactagaatactttctttttgctggcctcttattatcatgtatgaaagatgtattgattctcaacatccttttattattactttagtatggttttggcaagtggaacttcatcttgtctagttgtttgggagcactagctacagtctttctccatgggtctgaaaaccttcacaacatactggagaaaagacaggccttccattgaacatttactgaggcataaatcatcaccctacaagataatgcgatgttttgaacaactttaattgtttaaattgggaggttcttatgtggggaacaaatttttccttctgcaactgtcatatgttggttttgccatacacaccagaaagtctgtatctctcccacacacatctctcccttccatactaaatatgtattttttctggctaaatattccttgtccttcaaattcaaaatttaatccaattcaaaaattaatgtggttaccatgatcttgacaaaatctacattgtaattaaggtcttttaagatagcccaagaaccaaatgtaatattaattgtattaccactaggatggcgtgagtgatgcagtcacctcaggtgcaaaatctaagggagtgtcaaaaaactcggtaatcaaaataaataatattttaatgcaatatttgcaaaaataacattaatcaaaataatattttagtgcagtatttgaaaaaaataaaaattaatgcaaaaagttcaaatggacaaggatttgggtgtgatgggtgagatgagtcatacaagtaagtacaggggaggctcctgtcttttttggacatttcaatttcttggagttaaaatcctatttggatattagagattcaacccttgaaaggagccagcctaaagacattgttccatttgtactcatttctttttttcaataataattttaatttttagtttagattcagggggtacatgtgcaggtttgttacatgggtatattgcatgatactgagctttggggtatgactgatcccaacacccaggtagtgagcatagtccctagtaggtactttttcagcccttgcacccctccatcattccccccaccagtacctgccagcgtctattgttctcatctttatgcccatgtatacccaatgtttagctccctcttataagtgagaacatgtggtatttggttttcttttcctgtgttaatttgcttgggataacagcctccagctgtatccatgttgctgcaaaggacatacttttattctttttcatggctgtgtagtattccacggtgtatatatattacattttctttatccagtacactattgatgggcacctatgttgatttcatgtcttcgctgttgtgaatatcgctgtgatgaacacataagtgcacatgtctttctggtagaataatttattttcctttgaatatatatccagtaatgggattgctgggatgaatatagttctagttttagttctttgagaaatctccagacaactttccacaatgactgaactaatttacattcccaccaacagagtataaacattctgttttctccatagccttgtcagaatttgttatttattgattttttagtaacagccattctgactggtgtgagatcgtatatcattgtggctttgatttacagttctctgatgatctgtaatgttgagcattttcttgtatgtttgctggctgcttgtatgtctttttttgagaagtgtctgctcatgtcccttgcccactttttaacgggattgtttcttgcttgttgtattgtttaagttccttatagatttttgatattagacctttgtcagatgcatagtttgcaaatattttctgccatcctctaggttgtctgttaattctgttgatagtttcttttgctgtgcagaaactcttcagtttaattaattagttttatttagtttaggtcccacttgtcaattttggtttctcttgcaattgcttttgaggacttagtgatgaattatttaccaaggccattgtccagaatggtatatcctaggttttcttctagggtttttatattttgaggtcttatattaatctttaatcgatcttgagttagtttttgtatatggtacaaggtagcggtccagcttcattcttctgcatgtggctagccagttattccagaatcattattaaataaggaatcctttctccattgcttatttttgttgacttggccaaagatcatatggttatagatgtgcggctttacttttgggctctcaattctgtttcattagtttatgtatctgttttgtgatgtgtataaaatggtcatttctaggaccctttgtgtgcaatgtgtgtgtccagaggtaccagtaaaaaccctgcctcggcttctgtttcagtttgctacaactgacactgtctctacttcttaccaaagctctcttgagttttcctgtgcctttgtctcgagcccacactgcaagtccttagtgctggatctctcttgatgagcaaatacatctgggaaagcccatttctgactccactttaactggcttgaattagaatgctttttgtacttgcacacaaaataccagaaatcttatccaacttgattttcgaagaatggagtttataaagatataggccttttagtccgtattggcttgtcttagttattgaacagaatcaaaacattccatttttctataaaaccaagataattatgaaaaagtagtttttcatatcaactgatctattgaggcttatgttcagcagaacctacttggtaagtttaaactggggatggaaacaggtcaggatactaacaaaatgaaataaactggttttttttgttttgttttgttttgtttgtttgttttttgagatggagtctcagtcaccaggctggagtgcagtggtgcaatctcagctcactgcaacctctgcctcccaggttcaagcgattctcctgactcggcctcccaagtagctgggactacagacgtgcgccaccatgcccagctaatttttgtatttttagtagagacggggtttcaccatgttggccaggatggtcttgatctcttgaccttgtgatacgcccacctcagcctaccaatgtgttgggattacaggcgtgagccaccgcgcacagccaataaactcttctttaacctgccttatgcaataaagtccctgtgccccaaagttgtcttagaaaagacagcctaagtagttactgtgctttggacttcacagcccaagtacatcacaccatcaatatcctctttaaaagccgggagtgaggttttataaaagtatgctttaaacaaatggcagcaggaaattcaaagttgggtaattcatattgctgctataatttgtttgcacctaaaaagaaaaatcgtagaaaatgaagcatcattgcctgcaggtacagacacgtatggtgtctgagatcattgttattctcttcctctcatttttctcccatatcctcttaatggaataattacattattgtaatttacttgtatataattcaggcaagctaagcacaaccaataatatgtttcttcagaggaaaaaaacccaaacataataattaaagaataaattagttactgtaagtagcaagtattccaggtttggggagaaagtgtaggagatgatcccctcagaaatggacaccagtggatggtaacatgtgtgggaacaagagtgattccatcttggatgctaatctgccatgttggctcctgattaaccctgagtctgggaatgcctccaaggtgtctagttgatgatttactctctatgtagaaacacttatttactctgagttacacctttcctccacaacaacccttgatcttgttgcatacattacccgtagctgtaacacccatagcattctctcggccacccactcattccttccagagcaaatatacttttcctccaggatatataaaccctgggtctggaaggttgtagtgcgaaggcctacctttcttgtggccacccaagaccacgcttctgtctgtaagttccccaataaatcacccttttccaacacactggatttttctgctctgttctttggtttcttggctccttctgtatttggtggacacttcgcatatatgaccctttcacggaacaatgtgaaacttaaacatgcagcattttgggacgatctactttaagagatgttctgtaaatgatctgctgtgtaggccatgacatttcctcaggctcaccactgaaacatcaacctactataaaatgataaaacatgtgctttaaatgtgagcactctaacatatttatgaaagatgacacaacagatgggcagaaagaaacactgagaatgggaattttattttctttataatttttttttttttttttttttttagacggagtctcactctgtcatccaggctagagtgcagtagcacgatcttggctgactgcaacctccatttctcaggttcaagcgattctcctgcctcagcctcccaggtaagctgggattacaggcacgccctaccacaccctggctaatttttgtatttttagtagagatggggtttcgtcatgttggccaggctggtctcaaactcttgatctcaggtgatctgcccgcctcagcctcccaaagtgctgggattataggcgtgaaccactgtgcccggctgggaatttgcttttcaacagggaaaagaggcagtgtatctgccaggcaataatgatgacaagcacaaaacactaatttcaatgtattgagtatgtgagaggaccaatactagtttccttagctgtattaatttgaattattttaacaactttaggaagtcaatatgatttctgtttgaaaagtgagcaaacttaggctcagagatattgcacgcctaaagtcacacagttggtatgtggttatgacagtatttatgttcaggtctgtctgcctccaatgcctgggtttttctctatgagctccctcttagctgttccagtgttcctccactagaatttcatattctttagtgagacaatctccaggcattatcctagcttgaataaaatgctccagaaagttctccaactcaaatctacaaatcagtagtcgttttgtaaaataacttctttctccaaggacctcagttttgaggaatgtgtgccctggatgaagaaactggcattctcactactggaaagaaataattttgtctccgtattaatttttcggtattctggtttttagatttttttttcatgagttatgttagtttcgactcttttgactagagcctgaccattcttggatgatcgactaaattcaagtttctgaaatgacacacatgagagatagctttattgattttctatgaattttcttattttttcttcttataaaaatgtctctccaggagcaacaccaaagaaagccaagctgctgcaaagcttctcactgcctttgtatattatgccagctcctctacctcaaacgcttgccctgccttctcatctgaaaaatctttcctcttaagatccagctcaaatggtaccagttctctcgcaaaatcattctggaagaccccagggaaagtcaatttctcattcttttaaacattcacataattttgcatatatcactctcctattcacttgacactctacagtaactccttctgtataatcctattttcccatctagcctgtgagctacccaatggtgtcaatgaactcagtcccctttgcgaacctagcatcttctactgcactggcataggaagaaaaatactcaataaacacttgcagaaatgacatttaaaaaccatgcaatcttgtctttgaaaactgtactgttcaggaagatctaagaagatgaatacttactaggggctctttttctccttgaagagcttgagtgaaataatggctgttgaaccaagtttgttctaagttcactgaacttgatttattagcattgaattttcttttttagcttttttttttttttttttgcttgtaattggcctcttcatgtttaacacaaccctccacctataaaaatcataggatacttcacagaacagtgagaaaagcggacccttgggacgtcaagggacttactaaaaagcacacagctaagtgggagagttgaactagaactctggttctatgggtctattttttattctttctagtaggccaggttgctatgacaaaacaataacccctttaagcttatttacagctctttaacctaatcagaaggctttctttaatagttgcagagggcaccataccacagagaaagttgtcacgaggtctggtgactttccaaacaaagccgcttatcaattcaatgttaaaaatattggtcccatcctgagaactgtggtttccttttcttaatgaaaaaagcaataaaacgcaagtacacatccatctacacatacaggctgtcaataataaaataatgagagatggcactgaccataatctgtgttttccggctcccaacaatttgatggccaaaaatagggggtctgcggaatgaaaagaagtggaacccagattagacaaataaaaaattagtggagtttctggccagtgaattacatttatcttccacaattctctatattagtttgctatatgttttataatacagaacatgttccaagagagacattgaaaactctttgtctacatgtactttgctgaccaattgctcagcttctaaacatgtgtagtaccagcaagcaggtatttagaatgtcatccctttgctgtaattttacaccaactgacataaaggcaaaaaggtctgattgtatattcaagcaaaaagtattcatccacagagaggactgaaagagtatgttcggcaagactcaggatgaaatatatttaaatataacaaattgttttctatgaatcatgtatttcaacactgcttttggtagctccaaaaagctcaaccaaccgatagactctttctctgagatctgacaatgatttgcctggctccattagtcatataattcagttctcagcattgtccaatgagattaaagcaactttttactctcacttttaaagacatttcctaaattcctcttgtaactaatttctaccatttagtcgtgcaacagggtgactcgagtcaatagtaacttaattatacatttaaaaataactaagagtgtaactggattgtttgtaacacaaagaataaatgcttgagggaatggagatcccattctccatgatgtgatgactccacattgcatccttgtatccaaacacctcatgtattccatacgtataaacacctattatgtacccacaaaaattaaaattataaaatttaaattaaaaaaacctacaaaaaataaataaaaatagaaacatttccttacaaagacacttgtttctctaaagttttaaactgcacaaatcagagattttttttaaaggaatagtgtcttaattgagtgatacaatctgcaataggcagaatccagattctgtagaatctagaaactgactgactaaactacaaagaaaatgtctgaccgagagaaactttattattatcattaacatttatattttctaaaaggactttcctagccctgctagctgaacatgcttggctcctgaccacgaagaaacctgatgatcacctgtctccttatcaacccctagtccctggaatgatgaggcctgcaggactcactgtaacagtgatggcaaatatcagtactgtgggcttaattctatctgttagctaattacactaactaccatgtgcaataagcatatttggagtcatctctgattatctgatcattttcccctctagaagagagactctaaagaagggaaaatgggtagatagggagaactgtttgaatctctacagaaaagtctttccaaactgtctcagaggcccccccgactaccatcacccagggatttcaacttaccctccgttctttcttgggaattacagtagtaaaataaagaaggctactaacagtagttttgtgaacatgagaacaaaatcatcgtaggaattctgaagaaagaaaaaaagactaaactgctagacaaaagaggatagtaagactttatgtgggtcacccttatcaccccaatctcacttgactccataggagatgaagctttgagaattcgatttcttaaaaataaaattgaatcaggattctaggatagccctagggggacaaagtagttaaaactttgctttcatgtagggtgtcactttttttttttttgagacagggtctcactctgttgcccaggctggagtgcagtggtgcggtctcagctcgctgcaagctccgcctcccgggttcacgccattctcctgcctcagcctcccaagtagctgggactacaggtgcccgccaccacgcccagctgagtttttgtatttttagtagagacggggtttcaccgtgttagccaggatggtctcgatctcctgacctcgtgatccgcctgcctcggcctcccaaagtgctgggattacaggtgtgagccactgtgcccggcctaaaaacgattttctgatatgctatttcttaggttttataagagatatatttctactttggtatctttctttttttttttttttttttttttttgagacagagtctcgctctgtcgcccaggctggactgcagtggcgcgatctcggctcactgcaagctccgcctcccgggttcacgccattctcctgcctcagcctcccgagtagctgggactacaggcgcccgcaccacgcccggctaattttttgtattttcagtagagacggggtttcaccgtgttagccaggatggtctccatctcctgacctcgtgatctgcccccctcggccccacaaagtgctgggattacaggtgtgagccaccgcgcccggccggtgttactttctgagatgcttcttacggagtgcattgttccctctgggtagtttctatattttggggagtatatatgtgtatgtataggtgtgtgtgcaggcatatctatttatctaaccttaaaatacctattctactcagacaagacatatacttttttcccacaaaagcacaaaaaatattctcaactgcattcttatatttttcttcattctccatcatttactttagtgagaatttaatgactgtaaaattaaagcataaagtaattttttcttgtgatattatgtggaaatgccactaaaccaatgttcttcactaatatggaagattttttctaagaagtagtgttttgatctgtagtaaacgataatataggagaacaacaaactcttacagttttttttggaatttaaatacatactttcatagttctaccatacattaggacattttaatgcatgagtttcttgatttttcaatattggcttccttagctaggatgaaactcatccaaaactgttcaactgttgttcaataactgttggagcatatactaatgtattgaaagtcatgaaagagagctaaagaattacatcagatctcattttcagttagctaagagaggatgattagacaattgtgactttacggtaaatttaaaaaatcacatgattaagacatgtactacaaatttgagacaaatatataaactgtcatgccaatgaaataaagatttctgtttatctcaaattaatgctttgaagactctttagatttttttattattattattttgagatggagtctcgctctgtcacccaggctggagtgcagtggcaccatcttggctcactgcaaccttcgcctcctgggttcaagcaattctcctgcctcagcctcccaagtagctgggactacaggcacgcaccatcacatccagctaatttttgtatttttagtagagatgacgtttcaccatgttggccaggatggtctcaatctcgacctcatgatctgcccacctctgcctctcaaagtgctgggatcacaggcgtgagccactgcgcccagcctagattcttaatgatggttagactcccaatcattcactggaggatttgtaaacacggcatcccaacttttctactttaatttatgattttaaaatatccttccaaggagttgaatttcacttcggtgtaataaagaactttcgctgcttggaaccaacgtaaaaacagaagtgaagaccttgaataataatttgttttctattattggaactcttcaaatatggactggttaatgacttggtagacattatagtagaaattcagttacctctgagttttctggtgttttttaaaatcttggtttcagaactctaatattattagatttacaaatgtgtttgttatatttagatactatttcaaatatggatgcatcattaaaatatgtaacatttactatttagcactaatgtaattttaatgtgtatatgtatagatagtttattttatatctgcctatctatctcagcacactgaacttgacaactctctgtctatccctagtagttacataattcatatgtcatttgtacccattcccttgctttgttctaaagctcttttaaaaattctctccttttctcctgtgtgtatggtgatcccttccttcacatggcttttttttttttttttttttttttttttttgagactgagtctcgctctgtcgcccaggctggagtgcagtggcacaatctcggctcactgcaacctccatctcccaggttcaagctattctcctgcctcagcctaccaagtagctggaattacaggcacatgccacaacacccagctaattttttttgtttgttttttttttagtagagatgaggtttcaccatgttggccaggctggtctcaaactcctaacctcaagtgatagcccgccctggcctcccaaagtgctgggactacaggcatgagccactgtgcccggcctcggtgcccttttagacccatgagcatgactaagacatgtaaaccttgtctgtctactacattttctgggaatagagatttctttaaaaaaatcaggaagcattagtcacataaaaacaatttatttgctgatcaccaataattcctagttattaaaaatttaatcttggggccagaagttactttaataatatgctattttaagctaccattagtgtaagttttgctgtataaagaataaagctccattaatgtaaagcttttttaagttacgtaatttaactaagtgcttgaatacttaggtcagtatcacagtttcaggatacagctttatttcctcctagctcttaagtccaaaactgtcctacgattatttgccttggaagaaatgagtccaaggaaggggcagtgagactgttctatgaggacaataatctttaaaatgattttttaaagcaaatgattaaagtgatttttaaagcatatttcctctttgttctcagttttcccaaacaaattttaggtactctgattactattcagtcatttatgtagacatagagcatttaataatacttagaacaagtgagaagaaggctccaaagtctgaaagttggactgtggggagaaccctccagcaaatacctcttggaaatggattagagtttgacatccagcattttatgtgccttaattttacaggctagaatctgctaatcagttattaatgagccataatgtctactgaaatgtagaatatactttaggtaaatcaatgtgaactcaagtgtcaaatatacttacaatgactgaaatcagagtccacaatcattgccagaaagaataatagcatctgtgtcatttgcaaatgacctagaatgactcttatcagtttgcaagttatctgaggtgtcctgttgcagttgagtgcacacacacaatatatcatcatgtcagtctttacagatttgtagaagagcctaggatgctgagagtttattaattagctgaatcctatctggagtttcaagcattcctgttaaaatttacttgggctgaagatggtctggatcacaggcaagggtcagacagaggaagactctccggtccttccgaatgccattaagtcactttatgaatttcccttaagcttttcatataaaatagaaattcaatcatcacacaatttagctttcacacatcatcttgactaagcatactttatctttctctgtgtttattgctttttatgtctttagtttaatgttaatcagtttctaactagcctaagtcaaagtaaaataagtcatagtttttaaaagttctgttcaaaagaaacctaactaacaaacgaaatgcgggcttctagtttactgttaaagaacatttctaataaacttacttgaaaccggtaaaaggtgccatcatccttgagtgtgaggacatgatctgagattggaaagaagtagccgtgggcagccattaatgttcccaaatggagcgcctccactgttttatgaaaacaaacaaagaacataaaaaagccttttaaatgtattcttttataggaatgtaacgtttttgtgtggttccttttgtcagatacagtaagttcctcttgaaagatttaatttctgacttccttgttctttgctctcgagataaacttccttgtcccttctcctaagctacctgctctgtaaacaacttctcctaccagtcccagtctgtaactcacatctcttccttatttggaaacagtcctcctttactcctggctacccattctgtaaactgcccctcccactgaaacaggtcttccagccaaaactacacttcctgcctttgccgtgccctgacatgcccaaacatgccttgtaccgaaacggacagcctctcccttcccacctaattagccatattcaattttaaacagtagccaatcgggtcagtttagattgtgtggtacgactccagccaatggggacaggacacagaagcagggactaatagcgttagggataaaaaccccttccctcctttgttcggtgtgctctcgcagtggccagaagtgcgagtggcacccttctgcagaagtaaatttgccttgctgagaaatcctttgtttgagtgctcgttttccttgcgactcccagctcttgtttctaacactttagagtacattcttggcattctgaaaacctggctttgtgctttttcttcttttttcagctctttctcacaagacactaagatggttctagttcctggtagcaactgccatgaccaacctcatccaatgacaacaagtccatgagaagataaagttaagaaacattaaaatgggaaggctcttctcaatctgtagagtatgtctccctcattttatagatgtgtgttggcccatgtgataatgttctctcacaggcagttgcatttggcatttatagcactttaaacttttaaaagttttcacttgcatcacctcattctcaatatcatagcaatctagtaccatcagtaatgtttctaatgatatggaccattattttgtgatgctatgagggaatgttaaggcatcaaggaccatgtatgctgcactattgaatctacagactggtgattgtaaagattgttctagcttttactattctatacagtgttctaaatatggagtaggaagagatttattggacaatgtaaacatatagtctgaaactaaggctgtaatactcatactgtttatagctgccaacaatttcttccaacaaaagggttagtaaaatttggtcaatagttattactgcgtttgtgcagagatgacataaagttttctaacttaaaggctagaaaatatgaaattatgcaaaatagttttctaccccaacaaaaaaaatatatgtacagttgtcccttggtatcctcaggggattggtttgaggacctgcacagataccaaacatcaaggatgctcaagttccccactttgccctcccacatctgtggatttttgatcatgggtggttgaatccacagatgtggaagtcataaatagagagggcctactgtatgtagaaaataccagaaaagttagatttatttatctgtttatgtatctttatgtataattcatttataaatttatttctgtttcttagtcaagaagctaggattcttacagcagttctaggacaacatggatctatctatatctccagccatcaaccatggggagcttttacacctcagttaagaactgagtaactaagtagctagctatggtacagcaaagcataagaatcccatccttttaccccttacacctacataaataaacaatttgttgttaaatttttatctgttttggggtactatgatgccccttgaaattgttatctagcattttgcaaacatttcaattgataacttctacctctgatctctccctgcattgttcttgccgataataaagaacaactgccaattattcttcattctttgccctggctttggaagactgttactaactgctccagccatcatctccaaactcgcagtcaagtctctctgtatagaatgttgttttttgtacagaggagcatttttttttcatcaattttgtgcgtgtgtgtgtgtgtgtgtgtgtgtgtatttccatcatttcaacatcctttcagttcaaagtcaaggccttctcaaagcatgcattgctcatagcaacatgcctacctatccttgttaaaactttagtgccagggtgtcattgtggaaagaacaagaactttggagacacccactgtcttctgttactttcattctctgtgcctcccccatctattaataaaggtcataaacctacctggcaggattgacgtgagaatgacataagcacacttgtaatgaaattggaatcatgcttccagcctagtaggtactatgtatatggtagctactgtgcttcattatttacacacaaaataatttttacttttctacaaaccactttcagagaatctacttccatacatttgccttctgctaggttgagtgaatatttccaacacaaaaaaaacataaaactttgaagtgatagatatgttaattattctgatttgatcattgcacatttcatgtattgaaatattactctgtaccctataaatatctaacaaaagttttaaaaagctaggctgagtgaggaatcctgacagtcctaagcagccacgttcatcaacatcatcttattctctttttttttgactgtctgtaaaattaaaatggtaagaggatctagaaagatagttggcccataacaaatgagcaggtggttatagtcctggttaaattctgaatccctaagtacccctgtggacgagtgaagaatatgccatcccaaaataccccagattgtttcaagttgaaaacactggatgaattgtagtttcagaaagggctagctggcctatctcttcctatatgcagcaagccataaagattcctctgggaggggtatcttgcttttgccagggcaagaaaatagctcttatcaccagagactgggagttgggggctgcaatgaacctgaataaagggctggatgcggtggctcatgcctgtaatcccagcacttcgggaggccaagacggatggatcaattgaggccaggagttcaagaccaccatggccaacctggtgaaccccgtctctactaaaaaaaataaaaaataaaaaacttagctgggcatggtggcaggcatctgtaatcccagctacttgggaggctgaggcatgagaaccacctgaattcgggaggtggaggttgtagttagcagagatcacgccactgcactccagcctgggcgacagaacaacactctatctcaaaaaattaaattaaattaaattaagaaataaacttaatcaagtaacccctactttccactagttttatgcccccaatatattccctagtgattctgctagaaaatttactgccttcagccagattttctttgttctgtcatttttttcttaaatttattattgtttgtctaaaaagtatagaagtgtcttgctttggccatttcttcagacttcacactcttgtgaagatccccatgtacatgtaaaactaataaaatgtgtatgattttctctattaatctgcctggtatccacctggtctccagatccacagaagagcttaggggggttgcagatgatctctgacttccttacacctgttagggaatatagggtggggcaacatgtaacatcctttgtaggtggcccatctgtcttcgtatagccatctttattattttagtcccagcagtctgtggcctgggaagatagtgttagcacactttcccggaagaaaaattaagttacggcacataaggaaatctgcggagtatagatacaagaagggaaaactgagatgcccaggaagatagacagtaagaggagcttctgagttctaagcataggaaagagtgtgactaaaaccaagccaaggaacaacaaaaagcaattgggtgttaaagtgttgatgaggattagaaaaatagagtgaaagtaaatatagagatgctacaaaaaagaaaaacagaagtgagtgatcataagactattcttgactcctgcatctcattaactactaatttacaagttatatacttatagagtgcaaagtgtatgttggcaggttcttcttcatgtaatactaccataattagtcattaataaatgcttgcaaatgagtatgagtgaattagtaaaattctccttccttttttgaggtacaatattttcatttgatttgatgatatgcattctcattttacttctcttctgagtgatacttatgttccataattttacaattaaggaaaatttgttttgatacttttgcatcatgtcatgaatttagtagaaatatactggtggtgatacaggtaagacctagatttaatttctatgtgagtcacacacatttcatatgtcaaggtgaaatcaaaccttttgacttaatagttaagaggactgatcttctcacaatgcttacaaatggttttaagatttttggtcaaatagtaatctagaggtactgaaataataatagatattttgtgttcattacaggatctccagaaaatatagctccagagcaggataaatgcctagatgaaaaatcagaaagttggggtgaattttttgcttcatttaggatgacaagtttagcactcagcatatccatggcaaaagtagcaagtgaatcaatatttgctaaatcaatgaacaaggacatttatgagtaaatgacacaccaagaatattaaaaacctaacactgcatagaaaaacaccaggctaattattgtgtgttataagctgttgaggtggggctattgtagctattttgttgtgagaaaatataatagtgatattaacaagataaatgccagtaagaatggacttggggcagtattctcaagacagacttgtttattgttagggacaaacatggtgccacagttccctgtggtcccactgctccgaaatcttagcaccatcttaatctaataagaatccataagaccgctgacaatcttggaacaaagtgttgaaagagtttactgagtaatctgtcaagatcactctcccaataacggcacaccagatggcccagcagcatcacgcttcacggcaaaataatcgctaattaatcttctcgtacatgtgttattctcttcacccacacagctaaagttcaacaataaacctactaaaaaattccagcttatttttttgtttggatattcaagccatgagcaagctgagaaacaaaaatcaatctccaaacacctctgattaagtgaacagcctagaacagctttgttaagcctgataccaacataggatgatttcaccccaaactctaaaggaatggtattatcaacatcctcggatagcgaagagaattctccacagcataatttgcttttgaccacaacgatttcaaaaagttaacaggatgaaaaccacagtataaaagaggcttgtggaactccaggggtgcaatcggttagctcacggtgcttataaaagaggcttgagtacttgagtgtaaagtactctatatttacaatgtaattttaaaactcagtaatatttttcttacccagaggctcaacttcttgcagcctcctcttcttttaaatacagctcataattttgcaacgattaataaaatgcctctgagtcaagaaagtaatttaaaaacttcactgaatcctgtatttttatcactatcatgttatttactcttatttatgtgcatgtattaacatttttttcatttccaacacagtataagtatcagtagtgtgtggggagaaatattttaaaagaaaatctaaaaagaaaaaagatggcagctgattatattaaggaaacagagatgctaaaatgaagacaaaggtaagttacttaatgataaaataacaggtattcatcaggacaattctgagccataaaaagaagatatgttagacttgttactttctgtttaagaagacatggaagtggtcattttagaaatccttcaaaatattatgctttattttttagaactggcatttggaaaggtaagattattcatgtagaaaaatctcatatgcggaacattttattctccaacaaaaccaagtaaaaatggactattaccatatttagaaatttctgaagtaagtttattttctcaacagtaggagttagtaaaagaagtacctcagctttcatctttttaaaaaaaacatcatttgcatgtaagaaaaatcaagtgccgctttctcaacagcaatcataattcgggatagagaagtgaataataaggtgacatagaatagataagctaaaagagattctatttgggagaaataaaaacagaatcataatttatatcaacattgaggaatgcaataagaaattaatataagtaaacgctatttccaaaaaaggagcagagtacaaaggctatgccagtcccctgcctaggttcacatcccgggtccctcatttgctggctgtgtgacctgagcaagagacttggattctctgggccttggtgccctcatctgtaatcatctgtaagaagttgacaaaataataatgccaaagattagcagtaaggatccattgagataatatgcacaatgcacttaaaacacagtctaccacacagacatgctcctgagatgagagttattatcagttgatacttatgaagtgtcacattcaggagcacttaatctagtttaaggggcgatgggaaacattagtagctagtgttgctctgggtttcccagtcatgttaaacacttccaattcaactctattttaaacgccccaggtgatcaaaccagagtgttttgtgggctgaaatatgcctatgtttttccctacagcaaagaacactaacaaaatcccaaaaagaaattagggacaaacttattatatatcacagggatagccacagatttccaaaggcggcatgctccacacgctaggtttacaaaaccatactgtgaataccagatgccaatgagagacctgcctgctttagaggaggactgatgtgaggacaccctgaacctgacagtagaagaataacagggacagagagagcacggggacagcaatcagaatgggagatgaattcttagggaagcataatatttgcctaggactaaaaaaagaaaatcgacattaaaataataaagcaattggcagtgagagcaacagataatcataagtcaacgatcttttttacacacacagagtagaccagtctagatgtctaatggcagttatgacatcttaggcattctgcatagatgaaaaatcatgctgaaatttgaaaaaatgatccatgtaatactggtgtgaataactggtttcagatctacattatacagcctatatgatattagcatgttcattccccagatttagataggtagttccatcagccaatcctttaacaagattctgttatattatatgtgtgtgtgtgtgtgtgtgtgtatatatatatatatatatatatatatatatatatatatatatatatatatgttaggtgcatagaatagtattcagatgagataaaaatcatgcttacttcatctaagtacagtgtgaggaaaccatcacaatggcaagggccagggcagtaataaattacagtggaaaacaacattccatctaaaattcagtatacattctgcaaaatttccattagttaatctggctgaatgagctggaagaaagtagggcactgaattaactttttagtaggcagaggagtttctacagcatgtatttcttcaaatcagagagagcacacactgccaaacaagcacatgtggaaatcatgggaaaaaaaggctcaactgcaagtcatggggcttaaattctaatcctagtgcctgtaactgcatgtcaggagtaagtcacttcctttcttttgttttgagatggagtctcactttgtcaccagtctggagtgcagtggcgcgatcttcgctcactgcaacctccgccttccaggttcaagcgattctcctgcctccgcctctcaagtagctgggactacaggcatgcgccaccacgcccggctaatttttgtattttagtagagacagggtttcaccatgttgggcaggatggtctctatctcttgacctcgtgatctgcctgcctcggccttcccaagcattgggattacaggcgtgtgccacgcatccagccaagtcacttcctttcttagagctggcatctgtaaatgcagcggggatcactaaagactttttagttctgagtccatgacaagatgtgcagtcaaaacactagctagaagttgtggcagagcagccgccatccttatttttgcctccttgtgtcaaagggaaatggatttttctttatttctcagacattcttgccattgcccatgtcccaatactctaacacgaaagagaaaaatagcccaatacgaaatataaaagctgattttaatttcagttgcttataactcaatcctgatgattctcaagggctgctatagtatagagtttttgtacacagagcaaatgaatgcttattccaaataggaactggttttatgagtgtgttctatttacacattttcaaaaactagttgtaaaaacgcacacatgtcttgggattagccaataacacatcccatgtgccaaaatatcctgaatgcattttgtttgaaaatcaaatatcactcctaaggaataagcaatatagtcttctcataatacctgttaatggtatctcttttaaaaatcactattccttaatatttgaaccataatgaatgataagtctaatttcaaagccacaggcttggtcactgaaacagtcacagtttttatgaaatttcaaaacaaaatcagtggaatgcacttttatctgtattttgcagaaacaaatgcttgaattgagaaaagtgtgtaggacgtcaggactgatgtttgcaacttttgaataatctttacagcaaagtatcattttaaaaatcctagtttataaaagcacatgtatttatcaatttttatttttaaaatctctgtgtgtatatgttggtgtatgagttttagtaactaaaataatctgaaaataagaattttagattttagaatacctaaaatctaatacacaagctttccatgaacctactggatagagatcatctttctcaaaattagtttggaaactagatatgggtaaatttgttaaataagatgtattaaaacattttttctgtttgctgttttaaaaccagcacagtctttcataaacaatttgattgtaattttaaataccacaattaaaattataactactgcctaacaataacaatgaggcaggttcagaatccataatgagtaaattcagatgagttatttaaagtattaacaactcccctcaaaaatccccccctcttttcttcaccattctgcttgctaatttcactattttttgtaattagccagaatttaaacatcagatgtttttaaagaattaaaatcaggctgggcatggtggctcacacctgtaatcccagcattttgggaggccaaactgagaggattgcttgagactaggagttcgagaccagcctggacatcatagtgagactccatctctacaaaaagtttcttaaaaaattagcagggcatggtggtgcacacctgtggtcccaggtacttgggaggctgaggtgggagaattgcttgagcccaggaatttgaggttgccattagccatgatcatgccactgcactgggtgacagagtaagaccccctctttaaaaaacaaaaattaaaaaagaattaaaatcaattagcctccaagaaaatatggtttcataaggttcttttaataaagtacatagtgagacagctttatttccagaattcaaataaattctaggggaggtgggggactgggacaggctggtcaatgggtacaaaattacacttaggcaggaagaataagttttggtgctctattacacagtagggtgactatagcaaataacaatgtagtgtatatttcaggatagctagaagaggagattttgaatgccgttaccgcaaagacatgataaatgtttaaagtgatggatacggtaattgccctgatttgttcattatattatatatacatgcattgaaacatcacatcataccttataaatatatacaactataaggtgccaattataaataggaaaataaattctagatgctgtaggtgatattaacaagaagaaatgtctggagcctcagtggatcagtaatcttggtggacaacacacacatgccccctggtgggaagagtactgcattatatggggcaatggttatgaggctggcctttgagccagactgccctggccccgttgcatcttagcagttctttagtcttcaaaattcaaatttttaccattttcattatgtaataagctttcctataaatgtgatcatcattcttagaacacgtatcttcagactggcttctctcctaaattcctgtatggtattctgaacagcctttgtgacatctccacgtgaatattgaataaacatctcaaattcatcatgtcaaaattgaattgttggctttcatctgaaacccactcttctcgcagttcttctcacctgagttaatatcagtgactttcattccactgctcggaccaaaaagcttggatcgtctgatgtctttctcccattcaccgactccagtccagaagcaccttctgatgatcctgttttgctgtatgttcttagaatctgccctcttatcagccacccacatccaccacctccaccaccccagtccaacctcatatcatcctgtggctgagtcactgcaacaacattcaaactaatttcattcacactttgccctttgctatgatgattatcttaaaacatatattagatcaagtcgctcctgtgcaagccctcaacaatttcccctatttctcaggatcgaaataaaattccttgtcataggctttacaagatcttatatgatctggccaccccagttacttctctgtcttcctttcctatttccttgcccatctttacatatcctcctctagttcacagacctccttgttgctcctcaaacataccaagcatgcgcaggccttaggctttgctaggctctctgcctggaatgctcagaacccttcctccagagagcagaacaccccacttccttccttcagttggattctagccaaagccactacatcagagacaccagccctgactacactggtgtagaagaccgcgtatcttttagttggctttcataaaaaccatttttatttagtactcatcaccacttaccatataacatatttacctatttttttattgattattatcttgtctagtgaatattttaagctctaggtaagtatggacatttttgtctgtttgcttggttggttttagtggtttgtttgcttgatctactctctgacagtgacttaatttctgagatattgcaaccaactaaaaaatatgagagcggaaatggataaaaggatcttacattagttcatagcacaaattcttagaaataaaataggggagccaaaagacgcacatattttttaagtgttgctattttatttatttatttatttttttgagacggagtctgtgttgcccaggctggagtgcattggcgtgatctgggctcattgcaaccacccctccctggttcaagtgattctctggcctcagcctcctgagtagctaggattacaggcacgtgccaccaagcctggctaatttttataattttagtagagactgggtttcaccatgttggccaggctggtctcaaactcctgacctcaggtgatccgcctgcctcagtctcccaaagtgctgggattacaggcattagccaccatgcccaggctatgtatgtctatgttttttaaacgtaatattgttccatctccagatggcatctggagatggcattattagcaataatacatatatagtataacatacatatatattatatatatataatttaaattctcaccaaaagggtataaatgtgttggtatccctgtaaagtagttaaccacttggaattattatttattttctcgttcttcatttgctgggaagaaatggcattttgctttaatttgacttaactggagttatattgaattttagctaaaatgcacagtcttttaatacacagtatgagtgaaagaaaagacatttcaagttgacagggaaggtttcacaaaagggtaggttagactaggaatggaaggattttagactgttggtcaagagggaggtccttcaatttctccccagttctcctaaaaatgctctcttttcttattttctcacctttcaattttgatttgtttcctaggcttatcttatgtaattaattaataaaaatgcattccctttttatttttcaaattctttgctccattatttactcataccaggttttattaatttaccctattagacttcatttcttcagccattcacctgtcatccatccacccatctgctatccactcatccaccatccattcacccatctgctgtccatctaacagataattattcactgtctgcttggttttaggtgcttaactacaagccacagatataaaagtgaaggtgacactctccctctctctaccctcaagagactcacagtgacatggagtatcctgtgctttaaaaagccaaggatgggccgggtgtggtggctcacgcctgtaatcccagcattttgggaggccaaggtgggcagatcacccgaggtcaggagtttgagatgagcctggccaacatggtgaaaccccatctgtactaaaaatacaaaaattagcagggcgtggtggtgcatgcctgtagtaccagctgctcgggaggctggggcaggagaatggcttgaacccaggagacggaggttgcagtgagccaagatagggccactgcactccagactgggtgacagaacaagactctgactcaaaaaaaaaaaaaaaaaaaagccaacgatgacttctggttttaactgagacatttaaagagcttagaagctgtcactctcatcctttcgacaaaagaaaaccaaacaagctgaaaatcaactatttttcctggaccattcagagaagtaaagttgtaggacaaacctccattccaaaatctgcatagacaggctcatccagagacatgaccaagatctacttacttggagcagaagcttttggatccataaactgacagaaacatgaaaatagctcttctgacaaagaacttgagactcagtgtgaactagcttgacaataaggaactcgaggggctcatagtgttggtggggaatggagcacatgccttcatgagctacacttccagaaatcccaccagattctcatggtgaagatccaagaaagatccctcatggctctggcagaagagggaaaagtaatcattgcgaaaaatgcccagagccctctctataacaaaggcctctaccccaaaggaaagacattgtcagacattattctcaccagggaaagggcatttctccaactacagtcccctctagactttgtctctcaccgaagggaggaataaaagcaaacaacattaacaggggcagagcttctacaaaatagtttgggaaagctacagctgggaaaggaagatagtggtgggagacaggggatctatacttctggagaacacttgcaaaggtcacagctccaagggacagactctgaaatgctgagatttcattgaaatattatataattctctcattccctaacaactatccaccatacctataggctatggtataatatcagattacagctgaaagagctgttaagacacaaacattctctgaggtgaaatacttagaggagctcaaagtcacagaagaataaaaataaaagcactagaggaatttgaagcttctgtcatttataaccacagcaaacattaagcacggtccaagtactaaaccataaattagcacactaaaggcctgagttcccattacctaatacaagatgtgcagctttctttcctttctctctctcttttttttttttgagatgggagtttcactttgttgtccagctggagtgtagtagtgtgatcatggctcattgcagcctcgacctcccaggctcaagcaatcctcccaactcagccttccaagtagctgagaccacaggcacgtgcaaccacaccgggctaattttttttatttgcggagatggggtctcaccacattgcccagtctggtcttgaactcctgggcttaagctatctgcctgccttggcctaccaaagtgctgggattataggcatgagccaccctacccagccatgttcagctttgaatgtaaaattacaaggcaggcaaaaaagtaagaaaaacacagtgtgaagaggcaaaacaacaatgagaaccaaattcgaatatgacacagaaattggaattatcagacaggaagtttaaattgtaattaatatgttagggactctaatagaaaaagtgcaaaacatggaagagtagatgaataatgtaagcagaaagattctaagaaagatattcgaagaaagaatcaaaatgaaatgttagaaataatactaaaaaagaaataaagaatatcttgctgggctcattagcaggctacacaactctaaggaaagaatcagtgagcttgaagattaaccaacagaaacctcaaaaactgaaattcgaagaaaaaaataacaaggaaaacaaaaagaacaacaataacaaaagcatccaaaaactgtgggacaatatctaaaagtgtagcataacataattggaataccaggaggagagcaaagacagtgcagcagaagaaatattgaaatgataatggctgaagactctccaaaattaataacaaatgccacactacactcagagagaaagaaaagtaaataacaaaaaaatctaaatctacacatatcttattctaactgcagaaaatcaaagaaaataatcttgaaaaaagcgagaaaaatatccttacctatagagaaacaaaaatatgaatgacagtgcgcttctcatcagaaactatgtgggcaaaaaagagaatacagtgaaatatgtaaagtgttgaaggaagaaaacccactaacctagaattttacatcaagtgaaattacccttcaaaagtagaggagaaataaatattttctcagacaaacaactgaaagaatacattactagtgggcttgccttgccagaaaggttacaaagaagttcttcacagagaacaaataataatatagaccagaaacttctacatacataaagaaagaaagaacatcagggaagaaataaaggtaaaacaaaatctcttatttttcttattcttagtttatctaaaatataactatttgtttaaaataatagtaacagtattaggtgattataaaatatggataagtgaaatgaacaacagcagtgtcgtaaaggaagaaagggatgaattgggaatattctgttacaaggtaccttcatggtatatgaaacagtatagtgtaatttgaacatggagttagattaattaaaatgtatatcgtaaactctagaacagctgctaaaaactttaacaaataagtacaattgatatgctaagagaagagacaaaatggaattatttaaactgctcaattaaaaccagagttggctgaaaaagaaggggggaaaagacacaaatgaacaaatgcaatggagaaaatgcatgttttgtccaaatgcattgcaatacaatgaacaaaatacatacaaatatgtaagaagaatccacatatatcaataatcaccttaaatataatggtctaaatacaccaactaaaaagcagagattatctaagtggattacaaggaaaaagacctgactatacatgtatataataaactaattttaaatataaagactcatatatgttaaaaggggggaaaagagataccatgttcacactaatcaaaatcttttgaaatagtatctaatacagaagcaatattaagtttaggcaaggcagacttcataacaagcaagtttatcagggataatggaaagcattatctaaagagatcaattcttcaacaacaataaattgattatgaagatcacttttctattacaatcctaaatgtgtaagcacttaacaacagaatgttaaaatacataaggcaaaactagagagaactgaaaggaaaaataaactcattattacagttacaaacttcaacaccactttttcattaattgacagaccaaataagcagcagaaaatcaagcagtcagaatatagttgacctgaaaagtactatcaatatataaattgatagtatatcaatgatataaattgacatttatataatgttctatccaacaacagcagagtaaattattctaaagcatacatgaaatattcatcaagatcaaacacatcttgtgtcataaaatagatcttaaatctaaaagaacagaaatcatacaaagtatattctcagatgcaaaggaattaaactagaaatcaataaaagaaaggtagttggaaagtctccaactatttggaaattaaacaacataatctttagtaacccataggtcaaagaaaatgtctaaagagaaactgaaaattatttttaactaaattaatatgtaaatgcagttgatcaaaacaggtggactgcagcaaaggcagtggttaaagggaattcatatcattattaagcattaatgcatttattacaagaaagatacaaaattaataacctaagattatacgctagcaatattagaacctagagaaagaagagcaatttaaacctagagtaatcagaacaaaagaaataataaaattacatcagaaatcaataaaattgagaacaggaaaacaacagagaaaaatcaacaaaattaaaagctggttcttgtaaaaggtcaacaaaattgacaaatctctgcccaggcaaaccgtgtgaaaaagaaagaagactcaaattaccaatatcagaaatcagagagtggtcatcattaaggatccatagaattaaaagataataaaggaacactatgagcaatactatgcccacaaatttgataacttagataaaaaatgaacaaattacttcaaagacacaaaccatcaaaacttgcataagatgaaatgggtagcctgaatagctctatttctagtaaattattgattgaatcaataattaataacttccccctcaaaaaagcaatgggcctagataattttactggtgaattctatcaaacatttagggaagagatgattccatttctccacaatgtctaccagaaaattaaagcacaggtatcccttcctagctaattgtaaagccagcattaacttaatactaaagtcagataaatacaggaaagaaaaacgacagaccattttctcttattgacatagaaacaaaagtccttaacatattatcaaatggaatttaacagttaataaaaagaattatacaccacaaccaaagggacttattgcacatatgcaagcctgatacagcatttgaaaatcaattaatgtaattcaccataggacaagctaaaggtgaaaacttatacgatcatatcaatttgtgacaagaaatcattagacagaatccaaaacttatccatgtaaaagaaaaaaaaactcttagcaatctaggatcagaggagaactttctcaacttgatgaaaacatctacaaaaatactacagctaacatcattactaatggtagaaactggacagtttctctctaacatcagaaataaggcaagagtgtcctctttcacacttcatttcaacattgtattggaaactctagctagttcaataaggcaaagaaaaaatgttatacacattggaaaagaagaaatagttaaaattgcctttgtttgcagatgattataattgtctacgtagaaaatcccaaagaatctacaaaaacactcctgaaatttaaaaggtagaatatcaagtttataggatacaagctccataaataaaagttaattgctctcttatttaccaaaaatcaacaattggaacttgaatttaacaatgccattcacaatagcagcaaaattggaaatagtgataaatctaacaaaatatatacaaaatctgtgagaaaaactacataacactaattaaagaaataaaagatttaaaaatggagagagtccatgttcatggactggaatgctcaatgttttaaagatgccaattcatcacaactgaaaaactgaactaaagattcaatgctataccagtcaaaatcacagaaagctattttaaagatactgaaaaaatgactgtggagtgcatataaaaggaaaaagatccagaataaccgacataataatgaaggataaaaacaaagttggctttaggaggccgaggcgggcggatcacaaggtcaggagatctagaccatcctggttaacacggtgaaaccctgtctctactaaaaatacaaaaaattagccagacatggtggtgggcgcctgtagtctcagctacttgggagtctgtggcaggagaatggcatgaacctgggaggcggagcttgcagtgagccgagatcatgccactgcactccagcctgggcggcagagcaagactctgtctcaaaaaaaaaaaaaaaaaaaaaaaaaaaaaaaaccgatttggaatatccacactgatttcaaaacttagtttcaggctgtagtaatcaagacagtgagtactggaaaaagaacagagaaatatataagtaaaacagaaaagagagtccaggtatagacccacagagtcaattgattttagacaaaggagcagaaacaattcagtagaaaaagaatagtgtttttcatccttatttgttgttttaacacaacacaaccaattgttatgtaaaaaagaaaggcctgacactacacgcaggtcttattagttttcacaataattaactcaaattgtattatagacctaaatgcaaaatgcaaaatcagaaacctactagaagaaaacataggagggaatctgtctgaacttgtagcccacgatgggttgtcaggtatagcactaaaatcactagtgcaacatgaccttacataccaggatgagtttgtagagatagcactaaaatttagaattaccagtattacaaaatgaacctttatacatacgtatttcattcttaccagaacagtggaaacacttgcacaaagctaacgcaattgtcttcatttcacttgatgcacacactctctacctttggctccctgatgagtaagcaagggctgggaacaaaagcaacaatgggttgccctatctgcctttcctgtggaagagaagcaggagccaactccaagagttcccaatggccaaagataaaaccatttcagaaaaaaaaaaattgaattaagtaattttatattttgagattatatcccaaagtaccaaaaacaaaaaacaaaaaaacaaaaaaaaaacccactatgggttcatgctgatgtaaataaataattgaataaataaatagaaacatcttccctgccaagaattccaaataatttacgtagatactttagcctgaatgaggtggagcataacactccactccttcagtgggggccacatttagtacatttagtaactgtttttccaaaaagtatacaatgacaaagggaaaaatatgagtcactttacaatatattttacatcagcagtgatgtcatgtttatagtgtacacacttaaatgtatattattaactgaaagaagccactctaaaaagcctatggagtgtatgactccatttacatgacactctgaaaaaggtaaaaagagatggtaaaaggatccatggttttctgacgtgatgacaacagcactttccctttgtgattttcctcccccaaacccataacctcagactaatcaggagaaaaaaaaaaacgttaaacaaatcctaattcaggggcattttacaaaataaccaagtagtactcctcaaaacggttaaggccgtcaaaaacaagaaaagtttgagaaactgtcatagtctagaggaccagaagaggtgtgatggttgataataagtgtcaacttgattggattgaaggatgcaaagtattgttcctgcgtgcgtctgtgagggtgttgccagaggagattaacatttgaggcagtggactggcagaggcagaccaccctcaatctgggtgggcaccatccaatcggctgctagtgctgctaggaaaagcaggtggaagaaggtggaagagcagacttgctgagtcttccggcctccatctttctcccacgctggatgcttcctgccctcgaacctcagactccaggttcttcagcttttggactcttggacttacaccagtgctttgccaggggctctcaggtcttcggccacacactgaaggctgcactgtcagcttccctccttttgaggctttgtgactccgactgagccactactggcttccttgctcctcaccttgcagatggcctatcatgggacttcaccttgtgaccgtgtgagtcaattctccttaataaactccccttcacatatacatctttctattagtcctgtccctctagagaaccctggctaatacaagaggcatgacaactaaatctaatgtgatgtcttggatggaaccctgggacaggaaaaataaaggaaatcagaaagtattgacttcagttaatattaatgtatgttaacttctttaatattaactgacttagctaatattaaccagtaccaatattggttcattggttgtgacaagtatatcgtactaatgtaagatgtccaataatgagggaaactggggggtgggatatatagaaactttttgtactattttgtgatttttctgtaaatctaaacctattctaaaataagattttttaagagcaaattacaattaaaaaatcactctactgcataacctgtagtgaaggtctgtgcagcatctcaaagaaacacataggatgaagaagccagagacgattttacagacccagtgacccttcttctcacggagacttgaagaattagtaggagtccaatgaggaagaaggcactgaaaggcagaagaaggcacaaaaaggcccctaggcatgtggtggctgggcacccctgataaagtgcagttcatctggcagaactacaagttgagaaagcctcaggccggagaaggatgcaaggctgtgtccttcctgaaagtccttattggcatttgttcctctgagaaggcgaaatctttgcacaggtttaagtgggaaagtggcaaaacaataagagcctcattcatttctgctgtgttccagatacgatgtcagatttttcagcttcgttatctttgatcattacaaaggatccttgtatttacaaggttagagtttgttctttaggagatcattctccaaatctggagactagattgaaaggtagcaaggctggaggctctttgcggaagtaactgacacatcttttcatcacttcttgtctgttggcttttgtcagtgtgcttgaaaataatttcagctgtttcatgtcatggaattagatatgctttgattacagtttctgctttcttgccttcacccaactcactccttagtgatgctctgcaggacgacttttattctttctctataaagaaactgctcctctgaactcaccctgcccaagccctgcctttacattatgtatacgagttcttccagtcaaactggatcacttagtgacttggagcaggtggcactctcctccgtacctctcctttaacatttatgtatatgtcaaaaagcttccttcttgcttttcttcactgggtataattctgtccaattccctgggtccacccaaatacagccctccctcatgagaccttttctgacctcctagagcaatctatccctccaatgagccctaaatgcctgatatcttttactgtagctaattgtgtgctgttattagcctttcctatacttttcataaagatcttgaaagacaggcaggcacgctgcttaaactctgtttgcctggccgtgcacactttacacctggtataagcagaacgtatcatttgaactgaaaataaagtaagaaaaagtaaatttaactttaaaataaaacacttatttcagagtggttctttgatacttataataaatgctcactttgctttgatactggatatgactaaagtttactttatttggacggatatattacctttgactgctgaattaaaagaatcaatgccttgatttaagctgtgcagctaacagtagctctgagaataaacaagaggaaaatacagccatgtatctcatgcatgagagatgcatcttcggtgatttcatcattgtgcgaacttcatggagtatacttacacaaacctagatggcacagcctactacacacctagactatatggtatagcctattgctccaaggctacaaagctgtgcagcatgtgactgtaccgaatactgtaggcaactgtaacacaatggtatttgcatatctcaacatatctaaacatagaaaatgcaatgcattactctataccattatgatagctacagtatcactaggcactaggaaactttcagctccattataatctcatgggaccattgtcatacatgctgtcctttgctgaccgaaacgttgttatgggatatatgactatatataatttttatgtaagaattttacatttattttttattttaaaaaggacacttcaccataacatcttgataatttattaaattgcaaatacataagatgataaaaaatttcaaatgtcatcttctctatttttaattaatgcctagtgagagcataaacattatttcaacctaccagtccatattttaaaatacaagttcacgcttaaatacatttggagtgaaaaatgtctaaaacatcctaggcatggtggctcacgcctgtaatcccagcactttgggaggctgaggtgggtggttcacctgaggtcaggagtttgagaccagcctggccaacatggtgaaacctcatctctactaaaaatacaaaaattagccaggtgtggtggcgtgtgcctgcagtcccagcctctatggaggctgtggcttgagcctgggaggtgaagattgcagtgagccgagatcacatcacagccctcctgcctgggtgaaagagtgagtgagactccatcccccaacaccaaaaaaaaaaaagtctaaaatattgatttgcttttcttcttcttcctcttcttcttctttttttttttttttttgttgttgttgttgttggggttttttttgagacagggtcttgctttgtcacccaggctggagttcagtggtacaatcatggctcacttcagtctcaacctcctgggctcaagccatcctctcacctcagcctcccaagtagctgggtctacaggggcacagcaccatgcccagctaatttttgtattttttgtagacatagggtttcaccatgtcacaggctggtcttgaagtcctgagctcaagtgatcttcccgcctcagccttccaaagtgctaggattacaggcgtgagccactgtgcctgggctgttctttttttttttttttttttttcccagaagtctttgaatccaactttaaaagccaagtgaaaacctcagaaaacaaatgaagcctgagatgagactcatggaacttgattccttacccgacctatttagaagacattccttaacctatgtacagtcacttaattctgcccatgaaaagcaatgttgcatttcctcacagctgaaaatacttttaaaagaaagtaactataataaattctgaaagtggaaacttaatttataaaagcaatgaagcttgagacctaactttgtgggaaaacaatgcaggtatcttttttcacattaaaaatgttactaatgaactttagtctgattacaaagctatctgaaggaaatagcatgccaagtgcaattatgaatataggtaagttggataccagaatctgttttaattaagtaaaattatgaaagtgggataaaaggacaaaagctctgaaaaacaaatggttgattccagaaatttttattcagataatgaataagacagctaattatttggatcatttagttattgattaaaatggtaaaagtaataaaaattatctgtaaagtaatgtatataaatatagccaattagaaaaaaaaagagcaaagttgctggaagaaataatggcatcaaaaaaattaaaatatcaccatttccttcagctaaagattatgcaatggtagaaaaacatactataacagagaaatgagtttcatatcaatattttacttccttttttaatctcctctgccatctcctcctcatcagataatccaaagtgatgtcatgcaggggtgacagtttgtacatatggatgaataacatcaatgtatccaccttatataaaataatctattatcagggagctcaatttagctttattggggtctttagaaatttactattaatatgtgcatgtttattttcacttacttcaaatgaaaattgctttttcaaactattgagatgccaaaatataccagatatagaccagaaatgtgtagcaatttgctacctattgtcatactctagctaactttaaatttctaacaacccctgtgaggtctacaatggcaatgcgcaatggggaatgcaaaatggcttaaatggcatttggcattgaactggtacctttctgaggacaacagtttatagggggaagaacagtttcaaggacattaagaggcagcagagagttgcaaattcagaagttttatcaacattgattctgagattccacattctatctttaattgatgattatattgtccaaaacttttcactttatgcaagctcagagagaaaaagagagaagaaagtgagtaagggagggaagaaggcagagaggaaggaagggaggaaggaaaataaaaagagagagaagaaagagagagagagaagaaaagaatctgcccttaattttgctaccttcctaagtgcgaccttattgcaatttgctccccttccttttgagttcatgcctcatgaaagagtattacacacgtatgttccttactttcaactcccaaccccttccttagctcaccgtacttgtcttcttccggcagaagtctactgaatctgttctctcaaaggtcaccaatgacttcctagtagaaaagttctaccacttccccactctctcccagtcttctctgcttaagctctggtgaatctcccttcctggagccctctatgtggctgctgtcacgctctgtctactctgctatctttctctccggctcctgacctagttttccctaccttctgactcctgctctctatggttaaaagtctcttaaaaatctatctctgctgtagcttcccctttcctttgtttctctctatattctttcttccttggcaagctcatctaatttaaaaggtctgcttaccaaatgtgtacctcagtcatcatttattcaatgtaggagaacaaaacccactagacaaggtgccagctctgtctataggaagtcagtagtctatttaataggtgaaactggcaaatcaacagacacttaactacacagtctaataatttcaacagggaaaaaatgcagtgtgttctggaaaaacattaaaggaagatccaatctaatcttgggagctcagggagatttcctggaggagttgatatttaattcaagttctaagtaaaaagacaggagtatgaagcaagagaaggttccaagcaaagaaagcagcatatgcaaattattgtgattagggatataatgtcatttgagaaaccactatcagttgggtggcttgaagacacagcatgggttgaaaagtgatctgagcagatgcaatgatataaatatggctatatcaaaaagggttttaaatataagctaaaacgcttgtttgaacattatcctgaggaaaatggggggatctattagttattgaacttcagaagagacatgattagatctgagttttggaaagatcattatagatgcagtgaaatgaattgactggtgtgggaaaagaggaaaaggaatatgaggtagaaaacagtggcagttcctagtgagatgtgttgatggttggaatgaggagtgagatagtgggagtagagagaggtggacagatctgatatttaggaggcaaagtctgcacagatttggggatagaagaatttcgtccatttagatttgttcagtctatgagatgcccatgaaacgtccaagtagagatctatagcagacaagacagttggccaggagctcagaagagagtccagaggtatatttgtagtggttatcataccaacaatgggcaaaataaggaagtgcataaactgtgaagagccaagaaataagaaatctcatgcctgggtctccaaaaccctgaaagttaagaggcaaatagagaaatctgtgaaaggtactaagatggagggtgatgaagttatggcacaacaaagaagagagtaatggaagctaaaaaggagtgaaaaatgctgcagtgaggccaaattgaggactgagaagtaatcattgaattttgcaacaagaaaaatatcagtgatcacagcaaataaggtttcagtgtataagtgggggatacacaccagattccagtgaactgagaaataaacttgagagagaggaattaagagacagtaaatgcagctgagtttgtgaaaataggagagacataggagaatagctagcgtggaccatgaatcaatgtaagagtgtattatgatgggagagaactgtggtgagtaagcctatacagatatggctggttaagatataaaagtgaaatataagaatgaaatgttgggcatggtggcccacgcctgtaatcccagcactttgggaggccgaagcgggtggatcacttgaagccaggagtttggggctgcagtgagctgtgattgtgccactgtacttcagcctaggttatagagtgagaccctgtctcaaaatgaaaataaaaataaaaagggatgaaacaacactgaggtggtgagagaggatggggtaagaagcacagggaagctcaacacagacagcaagagaagcaagaatgggtgcacacagagtcaaagtgtatttgtaaagcagagcgagttaaaacattagagacatttcctccttgctttctatttaccctgaaagattatggtctgatattgagaatgactgagaatgtagcatgccagtagaggaagtggagaaagctttgaataatcatcccactaaataggagatcgatccgattacagaaaggattgccaggaagtcaggaaggcctgattgaggttgggaaccatgacatcttggtagcaataatttataggattgagtgacttttcaacagcgacgtgcagaatttcagatagacacgggaatacaacaagattgatccaggatcagaaactctcttggtggatgcactgggaaaccaagactggaggaagttgagagcatttgtgagttgtagtgtctgatcgtttttgctgttggtgtaatgatttctttaatgtcactcttgcctgtaagaggggcagtgatgtgtttattaatcatcactgtacctccagtgcaaggatggggacattttgtgtgtgcattaacaatttattaaacgcatcacagtcctacctgcaaacctgatttatttggttactattttatcaccctatcatattgcagagattttttaccttgtgaccaaccaaaagtgtattttattcgaacttaaggcaaaacattttgacatcagagatgaagagacatcaaatctattttttaaagaggtcatgaaaagaacatccctttgtctttcccgacactccatttatattacatacattttcctttcggacacttgttctgttctgttctcttgggtaagtgtcatgtgtggtttaaactcagggctcttccttctttgtggaactttatcagatacgttgatggtgactaattagatgtttcaacttcaaacaagttaatgtttcaacttcaagttgaaaagattattgcattgaactgtactctttacctttgcttctctcaagaaaatgtttatggccctattttcttattctcatatgtttgcttcttaactgtttaatgatgtcactgcctctcaatcaactctctcctaggcctctactgtcctcattaattgcagaatataattccacagaagcccctttatgatgctggagaattttcacataatttgtatgatagagtctaagtaatacctatgtttctgtcccactctttactttgaaattttgcacctccctgccagtttgcttgcatctttttctctgactttgcatgcttgaaatcgattatttggtaaaatgcctcaccttccaggtacagaagtgtccccaaccacacaacattatttgacttttagtagtagttccttaagacatgtccccagtatttccttacagcaagtgctcacgtaaagcagacgaatatttgacaaaatctgcaggagacacaggtggagagtgaacgaggctcacaagtggctgccatcagcccttccttcccggcagcagtgtggaggggccgtcagctgccagacacttcacactccactgtttgctcccgtttctcttgtaaagggctgggtgggacagcaggggtgtgatgacatgattcccagtgacagaaatcttggctcctgttggctctaagctggacagacaagaaactggataaaaattcttttaataatttgtttccgtttacagtaccacgtcagtgaccacaaatttattaggctgctcttggacatctgttagtaaatcgggcacattcatcaaatgtgaggccccagatgggagctggaaagcattaataaaatgcagccaatgttcacgaaaaggcaaggcagtggaaatttacctattgtagagggaggaggtgctctctgtgcttaatagctcttcgtcgtatacccgactgagcagaaatatctcagtggagcaattctgggatttatgtgatgcaaccacctaccatctttgtcttatctcttacttttcacaggcatgaacctgtcattctagaaacactaacctactcattctccctaaactatataaaaaaaaagtctggatatgctatttttctaagctggaagtaaatgatccgaccttgaattgtgattaaaaaaagattatttgcaggatgtcatgacactttacaatggcttaaatttttgaaaaacttaggaaaaaaaaatcaaagtataaccgaaagcagttgtttcagttaatatgacattattttaggtttagagataaatttccagcagaagaatttgtctctttatgatttgtatgaattcttgctatggccttgctgttcctctgcttgggttttctctttatgatttgtacgaattcttgttatggccttgctgttcctttgcttgagttttccagaacgccacaccatttcagtccacaaataatggtttgtttctaagaggagctactatttgctcataaaactcattttctatggaataaaagcagcctgtttaggctgattcagaacctgtagaacattttcctgtagttgggcaaccgctctccttgcttttacttagagaaaaaattgattaatcgaaacctatggataatagctttgggaagtttcattttctatttgtaactaaacattttctatgtcatgaagggtcaagggaacctagggtttttcactttaaggtaaacctccagttacagcttaaactatgaacgtggaaatgtctcctatattgttaagtaaaatatgcaagataaaacaatctatttttttaatgttaatattctctgttaagtgcattcaattcaacaatgtttactggttacccaacatgtgtgaaacactatgtaggggttagggacaacacaaagaacaaagtccttctacttataaagctcatattctagtgaatatgtggctcagacttcgggaaatgtcctaagtcagaccatgatgtgtcagtgtgggacagcccatgcccctgtcaacaggggtggtgtttgtcatgtcaagatatccttggaagtggtcaatcttaaattgttcttgaggtcaatctgacagtcggatatgagactttagaaagcgtggctaagagtaaaatgaagaaactgtttactctttttcttccactaggagtcacttgagcccagactctgggcctaaatatacctacaagattttagtgatattggccactgtcctgagacatgagaagagcctcagagaagtagcttctaaaagacacaaggatagatctgggctgggaaagggtcgtagttaccctgtgtgctgtgtttttcttcttctatccctggagctcaacaaaaccttgtgaaaagttagagtctgagagatcacggaggaagtctgtgaagtggtacaggctgcgtaataccccgggcacaagcagtgcccttggctagggtcaaagtgattgtgccaagaagtgggggggggggggaaaaggctgtagcaagagtatgggcttcacaggccgctgagggcaaagagacatgagatactggttcacgagaggcccgagaaaatgaccacatatggggagtaggaaagacactgagtggggctcgttccaatgataaagccagagtgggctcaggccttcaaagaagactggacagacagatgtgctagaattttagctatggctatctcagggagcttttcgtgagtgctttttattttcttctttttatttttttcatgtttcccaaattcgaaattacaaaaagcaaattagagttattgcttttaaagaatccaaaatgttttaagaaaaatgtatacattataagtaactacatgtgacatttgactcctgtccctaggcaggggctgctgaaacatctaccaaccaatatccatatccaaacatccaatatccaaacaaccaatatccaatatcccaggaagacttggcagatcagttcgtgagggccaagggttcactgatggtgctgccaaaagtaagaataaagatggggtgcacccatcacttctcacacaggaagcccatgactatccacacatacccgtgttcatggatgaaccccagcagaggaagaggtgaatgtcatgtttgctaaaacaaatgagtaagcctcaggcctttgaaaaccagacactccctcttcctacgggcattcagtagaagcaaaatgctactgatgcctggcagatcccttccaaaatttggtttaaatcaaaacagcagttattacccgaaaataacacaaatcacaatctgagcatgtgcctcctgtgaaatggagataatcagaattcaacatggtgcgtataatgtactgtaatgggcctcaaagcccaggtattagtgagcacggcaggaagcaggaattctggataattcaagaggccccaatcacttgaatttaatataactgcaaaattaaaaaaaaaaagcattttagtctcattagacttgcagcctccctcacttaaaggggaattttcaaaatttgaaaatcgtatcagatgttacaattgaggtttttagactcattatttttaaaagggtgaccttttactgtacagcaggaacctgtcttgtgtggtttgagacaaatgacaatgaagagatggatatgttcctaggatcatatttaggctataaaacatctatcagtgcccttatcacactttttgtactgctgtagttagcatctcctatcattattagctgtgataaaagaaaatgtttcatgaaatatgacatagaaatagaataagcagcattgttctcaactgaaatacaggagggggaaaacctaactcattcctcatctgggaaataagaaataccgcattatctttaataaaagataaagggacctgacttttcagacagctcttacacaactatctatggccgcttctgggtaacagatataatcgtacatttctctgtcattttctgagtggctaccctgatgaataggcacatccttagatgatatcttctgctctaggccttattagctttatccagtgctttttacttttcttttcttttcttttcgtctattcttcttcccttcttcctttttaaggaaagttgcttatgtcttatttctttgccaaaggaaattcaagtcggcttataaaaggaacacatatatgcagaaaggaaagtgaggctctaaaaagaagaagaaagcaaagaggccagccagctactggaagaatcagacaatgccacaggacaattgtgcatcgtccatttggtctgtgtagccatgttcatttttgttttttctagtggacagtgtagaaatatcaagctctgctgtaataggagatgttcctgtgtgtaattaaacacatctccaaatgtccattgaaccctggcctcattatgtttgttcaagttctacaagataaaagacagaaattctaattagatttccagctgccttttgtattttccttaatagctgacaactctaataaacaatatatatttaaaaaaccaatcagataaaaatgagagaggtcacaaaactctgggactggcatttatagatgcatgtgctgtccagcaaaaaccaaaaatggaattaggacagacagatcacctgctggtctctaacaaacgtactgtgttggcatgatgccgacacaccaggtatgaatcccagctctgctcctcggttctgctgggagtctcaggggcttcatctgtgaagtgaaggtgacatccctcgcctggagcagtgttcatgcttttaaatcaaatgtatctgggtttgaatactggttatctctcctattcgcttcatgatctgagacttacatttttaaatatttcttcaaattttctttcttttctcttggagttcagaataatatatatcaagttctcaacatgatgttcagcacatagttgatgctcagtaaatgtgagctttcttgcccccttcctacttacaagaactaaatgaaaggacaacatccagcatggtacctggggagacccaattgattaatgctcatgtgtgatagttcttttttgctggaactgcaatatagtgatagaggtgggaagtgaaggcagccagaaactcaaacctgaaaaagcctttatcaacgggaaagatggtctgaaataatggcagacatcctgggggaaataccccctactttggcaatgaaaacttcaacgtatggccttcatgaagacctttcagtacattctaggtttggggactttgttgtgcagagcaattggataattatacaagtcaatggaaacaacagtcactcgttgcattacagaatgcagtatttaaatgcaaacgcaacaccaaaaacaaataaggtggggagtaaaagaaaagagtgtggctagcttctaggttaaataagacagttggtcccaacaggttggatgtgacgggactgcactggatggcactgatcactttgaatggcagacatcacagagcaacatgtgcagacttctcactttctgtacactagagcattcccaagaggcaagaggccaccaaaagagagattcttggtgttgttaaatgtgtaaaatatgccaggcagagtggcttacacctgtaatcccagcactttgggaggccatggcaggtggattactcgagatcaggagttcaagaccagcctggccaacatggtgaaaccccatctctactaaaatacaaaaattagcgtggtggtgtgcccttgtaatcccagctacacagggagctgagacaggagaattccttgaacccggggggcagaggttgcagtgagctgatattgcaccgctgcactccagcctgcatgatacagggagattccgtctcaaaacaaaataaaataaataaataaaataaaaataaatgtacaagataccataattttggtggctctgctgtagactgaatgtctgtatcacccccaaattcatacgggaggtgattaggtaatgagggcacagcccttatgaatggaattagtgcttttataaaagaggctccagagagctcgctctccccttctaccatgtgaggccacagcgagaagacagccatccatgaaccagaacgcagaccctcagcagacacaaaggccaccagcaccttgaccttggacttcccagtttcccaaactgtgagaaataaatctttctgttgtttgagccactcagtctattgcattctgttatagcaccctgaatgaacatagatagggtaccaacagaatataggcaaaaataaattcctcccttctaaagaaaagctcctaatacgctgaaatgaatacacaaagaaaactatagttcttgctcatctcacatgaaataagtagaactacatataagattccctgtgtacacaactaggaagctccagctgcagtagccagggtgtgggatgagagcaggtacccaaagatatgaggactttgtttgttccttaagcattatttataatataaaatgcacgtttgcaagatgaatgtttgggtaatatctattatcttgaaactaggtcaaatcaatcaatcttgttagatttatacttaatggctccaaactatgacttcttgcatattatcatcagagtgttaaatatatctcagaaacctagaatgtttttatatagtggtctactagcactggaacgataataaagcggtcatttttattgatctcctatggacatgacagcttgctcagtggacaataaaatatatattttgtaggtttataggtttgtaagggtcttaatggttatttgcaagggatattttaaatgcttctaccgcttccctctactgaagcaagattgttgtttgaaacaatttgaagagcatacagaaaagatctgtttttattgacctgtaatatacgagttgaaatacataggaaattgctctaacaaaatggagtatccagaatgcaacaggtaaatataacatcaaatccaaggaaatacattactttattccaaaagacattatgtaatgtacctttgggtcagttgggtccatgcctctcttatggttgcccgccatttatgcaaaagcagaatccaggtctgaaatagttgttcaaaaaggtgcaggacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcattagtgggtgcagcgcaccagcatggcacatgtatacatatgtaactaacctgcacaatgtgcacatgtaccctaaaacttaaagtataataaaaaaaaaaaaaacaaaaaaaaaaacccaaaaaggtgcaggagtctggtgcagtggcttatacctgtaatcccagcaccttgagaggccaaggcagggagatcccttgagaccagagtttgaggccagcctgggcaacaaccccgcctctcaaaaaaaaaaaaaaaaaaaaaattaaaatcaactaactaaatgaataaatatcagctgagtgtggtgatacatgcctgtggtcccagctattcaggaagcttaagcgggaggatcacctgggcctgggaggtcaagggtgcagcgggccgtgattgtgccactgcactccagcctggacaacaggagaaagactccaattaaaaaaaaaaaaaggagcaggcacacagggtacaggttgtacctactgtgcttttatttcaaggtttttgtgtgactttagatattcacaagtttctctcctgttaattttctggttgtaaattgatgagatatctgcctggctacttcatgatattgatatgataatcaagtaaaataatttaattaaggctgggggccatggctcacgcctgtattccagcgctttgggaggctgaggagggcagatcacctgaggtcaggagtttgagaccaacttggccaacatggtgaaaccctgtctctactaaaaatacaaaaattagcggggcgtggtggctaatcccagctactcaggaggctgaggcaggagaatcacttgaacccgggaggctgaggttacagtgagccgagatcacgccactgcactctagcctgggtgacagagcaagactgactctcaaagaaaaaaaaaaatctaattaaatgatttggaaaagcataaaacactttataagtccaaaacattatcaaagataacagagacattcttttttttggagatggagtctcgctctgttgcccaggctggagtgcagtggtgccatctcagctcactgcaagctccgccttctgggttcacgccattctcctgcctcagcctcctgagtagctgggactacaggggcccaccaccgcgcccggctaatttttttttctattttcagtagagacggggtttcaccgtggtctcgatctcctgaccttgtgatccatccgcctcggcctcccaaagtgctgggattacaggcgtgagccactgcgcccggccagagacattctttactttctcagttctgatgcaccctcatgttcctagggctgtaatttcattggcagtttaactaaattcgtggaatacaaaggccatttgtaatggagttttattaaattaattaacaagatttagagcactttcttcttcagaagacttgtggcaggcttgggaggcagatgacagactctataatggtgtgcacaatggattgatttaattcattcggtgataattaagttacttgatccagttgtttgatggtgtgtaagcaaaacatctggttgatttgcctgaatcttgattttcactggtatttttacaacagatattgcttctagaggaagaaactttgcaggtatttgtcattaagtttttatcctagataaattatatttatccttaatcttattcttctatctgcattttaagccattttgtttacactgggttttgtttagataaaaaacaattcatttaaaatttctttctgttcacgttctcacatccatttaagagagcacaaactgaatcatcagttaccataaatccgatgccacttcagtgaattcccatcagtcaaaaaaacaagtgattattgagaattgattgaccgtggcacttcatttgatggctggagagggtatgtgtcctctgccattatgttgcttagattcaactgaagtgatgagaccaacatacataaaataaaaaatataagataattaaactaagcaacagataaagtagtatcaaatggaaatattctttcagctcatggcaaagaaaagccaatgggggctgaattatggaagaaaggctcatggaataggctgtatttgaagactagtataaaagttgtatgcatttctaaaaaattcaattcagttaaatgtgcttgcacatattcagagttttaaaaatttggcctacataaaaatacaattaagattctggcccacttgcatgttgattcttttaagtatcacaaaacatggtattaaaagcacttttcagaggaagggaaaaaaaaaaaaccagagaaattaatttgcccaatgcctgtaaccagtaagtgcttgaaacaggattgaagctcaagcatgtctgcaaagctcatgaccctcttcaatgccaggattcctctcaaggaatgctgaaaactcaagaagcatgggatgatggagagaaggaaaaaagatggagcaaatagctgccactcaaagaacacagaaatgcggccgggtgcggtggctcacacctgtaatcccagcattttgggaggccgaggcaggcggatcatgaagtcaagagatcgagaccatcctggccaacatggtgaaaccccatctctactaaaaatataaaaattagctgggcgtgctggtgtgcgcctgtagtctcagctactcaggaggctgaggcaggagaatagcttgaacctgggaggcagaggttgcagcaagccaagatcatgccacttcactccagcctgggcaacagagcaagacttcgtctaaacaaacaaacaaacaaacaaacaaaaaaacacagaaatgcataacgttccttgatacccaggagtgacagcaagactcatttcaaatcttagcctactcattagattgagggtcttaaagtactattctccctggtcagcatcactagatgagcttagtcaggatgactcttacagtgagaggcagcaaggggcacaaatgagcaaggtcatgtcaaggaattactgatatctgtcaataattttgtgaaggatccagactttcttgaagctttttattttgataaatttgctcaaaatattatccataattaatatgacatgatattagtcataaagcatgtttactaagaaaacaataaatctgttctggaagataaattttgcaaactcaacccgaaggatagtaggacttatcacagaagggcaggtttaaaaggcagaggaaacacgaacgtggaagaacgttgccagtaatggccccaatttgctcacacagtcctgcgtctgtgcattgtatagtccttccttacagtggctttggacttgtccaggggatttgtcttagtggatgaggcaatagcaaatgtgacacaaacagaaactcacgttgtgcttgtaaccctgagaataccattgtaagaagccagtgctagaggctgaagggcaagagaatgaaaaatatttagctgacagcttaccaagtgccagatatgccaaaaatctaagggagcaatggagttactttcatgtaactgagagtaaaatagcaaaatagcacagggctttcagaagcacagcacagtttcctactttgaggtctgattagttgctgtgcccccagagtgagcctggctaaagcaaagagtgtcaatagctaggaaggggctctgccaatgggaacatgtaacaacatggaagcaatggggtggactgtcaacagaagacattagtggtggatgctatgcttcttaatgggtgctgtgatgaataactttatacgtcaacctggctaggacactgtaccctgatatttggccaaacaccagtctagatgttgttgtgaaggtatttttggatgagattaatatttgaattagtagactttgagtaaagcagattactcttcgtaatgtgggtgggcttcatcccatcagctgaaggccttaagagaaaagaaacagattttctccaaggaagagggaattctgccaccagacctccttaaacatgaattcatgcctaggtctccagcctgctgtcctgctctatgaatttcagaagtaccagttctcaaaattgtgtgagcaaattcctcaaaatctctatctatctatctatctatctatctatctatctatctatctatcatcgatctatcatctattatccatctatctatcatctatctatattttctatcatctacctatcatttatctatcatctatctatctaccatccatcatctatctgtctatctctttatcatctatcatccatctattatctttctatcatccatctatcatctatctatctatatatctatatcttctatcatctatcatttatctatcatctatcatttatctatcatctatcatttatctctatcatttatctatctatcatctatcatttatctatttatatctatccatcatctatcatctatctatccatctgtacacacacacacacacacacacacacacacacacacacacacacacacattgctttgtcctgtttctctggagaaccttgatgagtactaaatttcaacaatgtagacgtatgttcaccaaggactaaattcttccttccaatccccctgcccttatccaatgattgctgcacattaattttcctccctatgaaatcaaagtagccattttatttaatctttccgccacagtccaattgtaagactaatgcaatttattctgtgttttgcatttgcatgtgaattatatatatatacacacatatgtgtgtgtgtgtatttatataacacaaacacacacacgtaaatacatatcttttagattcttactgatatgattgaaaggtacaaatcaaaatataaacttttgacatgatggcaacatgaagtttaactatcaatgccacaaacaaataattgacacaaataaaaatctgcattggcactataaattagggcagcacgtggtctgaaagtctaaccaatattccatatataagaccagattgcaacattctcctgagacagcaccacagtactaagtagagaagactctaggagattactcataaaaccctcaatgccggagtggaaacagcagaatatatgtgagaaggcggcacaacactttgaatcccattcactgtagtacatcaacagtaccaaaaacagctgcagtggggctgcactaatcaaaccactgcaaatatggacagcttctctccccgcagtggagggcaaacaccacagaagaaatcagccatggccatgtcttggaggcagcttggcaatggacaatgttgaatataggacagaaatgtgttccaacgaagtaagtccatcacactcagtgacaacatgatatcatggtgacatcctgaggcaaggattactcccaggtccagctcgctccccaccatacttagtctgtcaaaaagctaacttattaatgcaaatttacattaaccagaatgccaactccagctgcaaagtggagacgatcccactgacatatacatacattaagtaatctaaggagaatccatccaccctgtcaataactgaagatcagttccatgtagagtccttcatgccagagacaaagtaaatgagaaaaattcacaaaacaaattcacaaatatttctaagacatgcaatggcataaagattataatagtatctatatatacctaaaatactcaacttaaatggcatgatgtaataaagcaatcaatgaaacataacttacaagagaattttatgcttagagtctatgattagaagagaactttctaaaggaaggtagaaatagagaactagaaaaaaataagaaaatgatgaaaagttaaacatgcgataatagatatattctctattagcatctgtaaagggctgaatcggcagtgaagagaattagaattaatgttatgatgtagaaacttaaaaacttaatctggaagagagaagggagagagaaagctaaaaaatgaattttaaaacagagaaaataataatcgagatgtagaaaagagtgaagcatatcagtaaatgttgtttcaaaacaggaaatgagaacgaataagcaggcatatagttagttacaattattataaaaaatacaaaaatacctacaattgccaatcaacattttctgaactattatgtaagagatgtggtaataactgctttacactgtatgtaatacttattaaaccctcaggaaagcactaagtagtagatgttattattatatgcattttataaatgtagaaaatgagcttaaataacaaaacagaaaaaaattttcttcaactaggaaaaacctgaatcaacagacttaaatcagtcaccaaatttgtaaatacatcacagaacaagcaacgaaatggcaatggcccatttatattttgaatttcaaggaaagaaaaggcattacaggtatctaggcaggataaaaaatcagttttaaaaaacagcatatgcacaggcaacaaaacattctgccaaataattaaaggctttgaacaactacatataatcctaataaactgctgggaaaagtattgtagttttccaataagttagttaagatttcttttaaaaaaagatagtgtagcaaagagatgacacattaaattagcatatataaatcaatcattttcatatatgtaaacaataaaaagtatatataggaagaaaagacccacatataataataacacataataaaataaccgaaataagcttagtaagaaaagtgcaaagtctatattttaaaaactttaaagcactcctgaaagaccacatatcaaaattgaagacatgaaaagatagagtatattcttggttagaagacaactctgtaactgagcttgggattacaataaggagtaggtttgagaagtggaaaaatcggggttccattttggttgtgttgagtttgacgtttcggggagaggccttaggcactggagaagtgagtgtggagcactgtggagaggtcagcatgaaagttatgaattggagcattctcaacatatgtcacttagcaacagcgtgtagatgcagaaaggagaggaacctaggacagaaacctgaaccttccaacatttatggattagctgagagtgaaaagccaccacagaagactgagaccaaaccaaatggccagtgaaaaggatggaagagtatgagtgtgaaattctggaagcaaaggacaatcaatttgttcaaagagagaatattcattctgtattcccagtgcctggcccatggtaagaactcaataaatatttgttagatgaatgaaagtgtgaaagaagaaatggaattttcctagaaagatatattttataaaagtgtactcacaaagcagaagaaaaacattttagactaattccatatatgtgtattatacatatatgtaaactaaaaaaaatccaaaattttaacaaaaagttcaaatccatctgtattctaaaataataacaaaatatgactacatgtctaatggtaccaaaatctctgataaaatattcagccaaatgtgtcctggattgctgtaatagaaatgagttattaagtgctcattgataaaatactgaacactaagtctgcaaataatatagactcattggtcttaagtatggtcctgaagatcattcagccttctcctcctgtcttcaaatgggccatcagaacctgctcccatacccagaattagtctcttcttccatcttgccacaaaaccctctttcagcaaattattgacttctagaacatcaaaccatccctagagatcttcaaacgaccacttggctaccagagagcacacaagacagaaactaggcatgggtttctttcttattttaaaacatcttcagggagtttttgatagagttaaaactagacttggcattataaccacttagtctcccttcatgaccagtttcaaaaggcatgattggtttcatataggcagccaccaaagtaactttcataatatcagctacattattaaccacatcaaattgggatcagaatagccaccagattgattcattttccatgtgcacaatctgttacatattcagaacaatcattaatgtttcttaactcttcttgaaaccagtacagagccttggattttgtctagggtgaattacttcattcaaaaaaacaaaccaacaaatcagaaactaatttttcagcctgtcataaatatgactacagaacatgtatgttccttcctggatacatttgacttcatcttgtcataacagcttctaatgaatcttaaaaacttcctcaaagtgttcagcaagcaaataaaatcagttttccatgcacattatagctaaaacaagatcctacctgtaaattataaacaatgattgtttcttactagcttatgatatctgtgaagatttttcctgtttcttagatttttactgaactacaccttcaggttttttttgtttgtttgtttgtttgtttcgagacagagtcacgctctgtcacccaggctggagtgcagtggtgtgattttggctcactgcaacctccgcctcctgggttcaagtgattcttctgtctcagcctcccaagtaactgggactacatgtgtgtgccaccacacccagctaatttttgtatttttagtagaggcagggtttttcaccgtattggccaggctggtctcgaactcctgagctcgtgatccacccacctcagcctcccaaagtgctgggattataggcatgagtcaccgcgcctgacccagtctttaccttacagaaataatactcttttaaatctacttcacctctgatccttaatagtctttgccaatcagtagtttcctgattagccatgactgtgtcaatctattttttagcactgggattatttgtctggtcctatagttttaaaaaaacaggcatgccactgaagtgaggctgaaatgtgaacttggtaagactgtagcttcccttcctattaattatctcccctttcacctggtgataatatgatgctggcaatagctgctttgtctttacctaattgttttaataccacttaatcttcaacaatgagtattttaaaagctcatgtagcaaatgagctgggggtgtacacaggcctttatggacagaatttgagctgcatcttttgatggtattgctttataaagctagcttaaaatgagaaaaaattaaaaccttgcatcttcgtatactgttaattctaaaccattttaaggcaataattaccagaggcaggaaccacagctatgccgagttcctctctatcgatagaagggtgtgttacataggttggcatatcactgaccttttctgcagtcactgtaatgccagcttttcataactattgttttctgttttctcagaatcttctctgaacaatatgcatcttattttctttcagtgatgtgaattgtttgccacgtgtgaaaggttttacatattttaaaaaagccactaaatgtagctgggcatggtggctcacatctgtattcccagcactttgggaggccaagtgggtggatcacctgaggtcagaagttcgagaccagcctggccaacatggtgaaaccccgactctactaaaaatacaaaaaaattagcctgatgtggtggcacgcgcccataatcccagctactcgggaggctgaggcagaagaattgcttgaacctaggaggcagaggttgcagtgagccgagattgcaccactgcactccagcctgggcaacaagagtgaaactctgcctcaaaaaaaaaaaaaaaaaaaaaaaaaagtcattaaatgctttgcatatgtaggatcttgttccaggcaatgcaaagtgtgaactcataaaaattgttcccttactttggaaattagttttctgctacagaatagacacaatgtccaacatggtgaacaggtttatgacttaaatagagcgtttctctctctctcacacacacacaccatgtaggcacgagaaaaaaaatcagaattacaaataaaatactgatttcaaactgtatttaaagatgtagttaaggcaaaattataagttaatgagatgtatgtgtcttatagaaggaaagttcattaattcataatcacttgccataaattatatgtacaattattttatggacatgtatacagctgatccagtctaacgatcaccgatgacctgaatcaaataatatggcagaattaaggatgtgaaaaattgtacaaatatgctaactttcagtgaaatatgttttgactaccataaaatttatataaatgttaaaagcacagttcaaactgaattataatttttcaggaggtttgcttgcgtgccatattaaaatatccctgatgaaacatatttcttaaaaccactaagaaaaaagttcttgcaatgggaaaatgatttatttacctggatcttctatagttaagttctttatcaaccattgaacaatgtctgaacctagaaaaagaaaaaagaaaaacacaaacagatgtgaacattttgtttatacatattaactttaagaattctccacctttggtgctcatattagaaggaacttttctaattgttacaatgacagattaaggatctaccccagatggaatgctgaaaacacaaagtatggatacttagctgtccatcaataaaccaaggtgtaaactagtaaattattaaatatgaaatatgtaaatggaaataaaatttactgtactagtagaaagtgatttgtttactaaataagtgtttattaagcatctcctatatttcaggtacaagtcttagcacagcataaccagtattttataaggtagttcctgtctcatttttggttgtacccacctcatccttgtatcccctctcaagtcaaaccaaatttgtttttggttttcgaaccctcttacgtatttcaagtctctgtgtctccacagcagtactctccctgaccgaaatgtcttcccactatttttaagacactcaagattcactgatatgacagaacttgccttggcccttcccctcgtccactgagttcacagtactgtccatgaaacctcattggaacccatgcagtcttttattgtcgtgttgatcacacaccattgccccagctgtttatttgatgaatgccccaaagtaagaaccttgaagcagggtgtcatattcatctttgattatttggagcatagtaagtgcttaacaatgtgtgatgaatacaaagtatgagcaaatatgtttctacttcacacagaagagacaagagaggtctgcagaaaacaatgtttgagctagattttgaaggatgtatttttatctatgaataagagagaaatttagttgctgaaggggcctacgtaaaaactaaaaggtggaaaagcagtcaacagaaataatttactgcacactgtctatatgtaagtgctgggaataatagaaaattgaaagtaataatggagtgcacagtatattcagcaggtcttgaattctaggctaaagaattaaattttctttttcccataaggaaagcagagaaagagacatgcaatatttttgagcagaagaatgacattatcaaagtaagtttgaggagtatgactggcaatatatatgaaatgccttgtagtcaaaaagaaggcaaggcagtcgacatgtctactagttgcaatccaaggatgaagggaaaaggtcttagttcagtgtacaaaggaatttcttaaaaaattacagacttctttcaggactttacgactaattaggtataaaggttataagtaggagagattaaaaaagaagtcaaggtttctagcccggaagcatagatgaatagaatgatgaaaataagagcagaaatgggagatttagcaactgatttgcttgagacattcatttgtatttaaaattggttttctgcataactcttttctacacaaaataggaaaaatatgtatgtgaattgtttgcatacatagtaaactgtgttatgcctgcgtgaattgaatcaaacttcagtgtgaaccaagattccatttcagcctctcctggaggctggctagagttgctgtctacccacctcggagatttggcaaattaattacattaacattggcaaaataattctagctgcttgaattaaaccagttcaaaatcaatttaagaataaatttgattactaaacttgacaataaagtcccaaaagttatgagaacattcatactcaatgtcaatttcagcatgcatgcatttaaaaaaataactccaagtattgacttgaacttgtgttccttttacagctgccatggatttaaatcatttgggaagacagactcatccagatcctaaaggaagttttactaaaacagctctaagggtcaaatggaaaggagatcattctccagaaggcagttgaccgtgtcccggtgttgtgttcaaccttatagtcttaggttatctggaagcacgatcttcccattgaaaaagaaaaggagaactcagcttttcacatatacatgtagtgatccttgaccaatgtcgattcccagatacacaaatcttccgcacaagccccaagcaccctgctcatttttcagagttgagcatctatttgtggaacatatgtgagcagccactggaaattttccattcttttgaagacagccaaacattcattccaggactatacatattttttattgtgaaaaatgacttgaaaaatgctcttagagactaagtttttaaaaatattctgttctgttacgctttctttccttttctttttttttctgggcagaaagaaatacaaagaagcctaatttaaaagtatgtttaattcagagaataggaaactttctttcttagcctacttttgagtatttctgtcacaagtgtattctcagttcagctctgaaggagtcaatttaattggacttgaccaactgctagtgccacttagcagatgctgtagtagtttttttattgtgtgatcgccccagcatatttatggttttaggttatggatttttaaattgttaaattcttacccagactcaccatgttaacctatgctccatctgtaagagtaagacctcaactccttgaagagataggtagagagagaaagaggaaaaaaatccagtatcttattggaaccagaagactgaaagagaaacgtgctcctatagagtcatcttgagaagcatgactcaaatttaaaatggagcattacagtccagagaagtgtagtaggaatgccacctttacagcaattttccagctttatattaaataaataaataaataaataaataaataaataaataaataaatggctgggtctgctgaagtttttcacatataatgtatatgtagaaaattgtagcattctatttaccttgattttggagccctcaaagtaacctgtggaattttttgaaatcacactttcactgtagcctatggaaagtttatacaggcatatgtcacttttagagttgcagagctttgtgctccgtctgctcagcagaagcagtagaggttttattactgtcgaatcctagcagtatattatttaaaatgaaaacaagcaaaaacaaacaagcagaattcttcctcatcacactgctcatagttttctacctgctatactgtttcttccttccatgattttgctaatgctcttctatcttcatctctttttcctgtggtgaatcccaactgaggccataaagttcaattcaaacattatctactccaggaagcctgttgtgcccacccctcaacaaaagattgaatgaataaatagcaagactcccctccccaaattctattttcacagagtttaaaaagaatagtatccttcatgcaaagaatattctactggcatgtaatttaaacaccactattattttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctaaacaccactattattaaacatgatgttaaattgatcttaaacttcaacattattttttcacccatgccacggatctgaacggcaaacgagcttccttacctgtgccccctgcagagtgcaaaggcctggaccaggctctgtcctaagcctgtattacttccattacggtccacgtctgcacccctccccaggattagagcacatcctcagctacaagtgtcacctacagctatccacaaactaaatctgaattagaggtgcacaaaaatattaagcattcatgaaaaaaattgcaaaatatttgtaaatataagatatgaggactctgtaagcaagcaaaatagaacacatttgatttgcatcctttacaaaactcaagtattttcataattttcagctaaagacattagtgaaaacttgagctcttaatcaccatagaaggtgcgcaaattattcctgaggcaaagacgctgacctttgcaatgtttctctttcagggaaatggaaaagctctttgtactgcccaaatacctttgctgaagcctcagaaccacatagacacagtgctgacaatacaaatatttttatttagtgaatatcataaataatccttaatccatgatttttgatgttataactattcttctttttttttttttttcctttgaagacagggtctcactcaggctgcaagacagtgcaacaatcacctcatcgcagcctcaacttcctgggctcaagcaattccccctgtcccagcctcccaagtagctgggattacaggtgtgagccaccatgcccggcaattttttttaattattattttttggaggatggggtctcgctatgttgcccagacttgtcttgaaatcctggccttaagtgatcctcctgcttcagcctcccaaagcactgagattacatggcatgagccaccaggctcagccaactattcttagaacctctcactaaatagaagactttctatatactaaaaatcatttttccaacattattctttgttccttgaagtaggcacaataaatgtttattatcatcaaatagcatgtaataaacatctattgcgtttctgtagaagtttggctgaggatctgcactttaaggaacaagaaagaaagaatgtctagcgaagcaaattaactgatctgtcagtcccttgagagaagaaacgacatcatactcatcacgtttccaccattctcttcaaagtgcttcaacacagatcatcgttaaatgtttactgaaggcatgagtcactatttatggacatctactctatacagaaaagactccaaatgctgaaaaagtcagctctaatggtgactccatctagtatgttatgacaccacagtgtatctctcattatcataatttaaaaagttcttcatgcaattataattttaactcaatttaatttaaaacacggcagaatttctttaaattaaactcaattgaatttctttaatttttaaattaaactcagtttaaaacactgcagaatttctgtaatttaaaacactgcagaatttcagtttaagttaaaacactgcagactttctgtttgagaaatgaagtgatttgcttaaagctagcatattacccttttgtaaagctgaattaatgaactaaatttctccacaatctttccaataagtaattgctaatatctaagaataacattttgtttatttgagtacttgtgtcctgtccagagccttaaatatgattgcacagccattgtcacatctgagggttcaacaaagcaaccttcaaccaaaggagcaggagagatgaactccagcccagctacagactatgttctctaaccccttgatctaagaaatctcagcaatggcaaaaatctggatatcaccaattaatggccggtgtcctagttctgtctgcctttggccaaaagcgggtactgaaaaaagagaaaagcagccactggcttccaggaactggctgggcactcacagctatgtcttggtgcttccttggtaaatatgaacaatttcttagaagaacattaacaccggacaaggccactctagaaccctcataggtcaagataaaaacaagaccactctgtaatcagatctgaacacaaacaaaacatgaacatgggctgagccataaaatatcaaattccatcctggataacatgagcgactgctgcttctttatcaatgccatatttagtcttgtctaatctgtcctcctgtagaaaaaatgtattaagatacccaatcaggccggccacggtggctcacgcttgtaatcccagcatgttggggggccgaggcaggtggatcatgaggtcaggagatggagaccatcctggccaacatggtgacaccctgtctctactaaaaaaaaaaaaaaattagctgggcatgatgttgcgtgcctgtaatcccagctactcgggaggctgaggcaggagaatcaaaccagggagctcgaggttgcagtaaactgagatggcgccactgcactccagcctggcgacagagtgagacactgtctcaaaaaaaaaaaagataccagataatggaattgtccctacttcctgacagcacccaatctagagcaaaggcccacttcctcagatcctctccatgactaccaatgccaaaatcctgtaatagattcttcctaaaaccctattactgagacaccccatggttcccgatggcgtgcattctccctaccctcaagaaagaataaagttgacttgttcgactataggcgtgttcctggtggttttgggctagaggcatcgacatttttttaatttaaaaaaattgctaatatctattaagattaatataacaacaacaacaaaatttaagttacttcatcagggcgcttttggttgtaaagagtgatctttgagggaagtataaaaacataaacttatcaaagaaggaatttgcaaaaaggtacccagaactaaagggaaaggatgtatttaggcctcaaggactcatggaggcagagactgtcatccttgctcctttctggacatcttcatttctctctaggaaacaacctttgctattttccatccacaaagtgggtcatgaaggctcacagctcctgggttaaaatctctgccactgaagacggcaagacatttgaggctgaaatcttttagtcctaagtcttaattcctgatgaagggtctcagctgcagggaggtgcccattcctgtatcagccaactgtggcaagaaaagatggatcactgtgcataaaaatggtcatgctggcgagaggtatcgatggaggcattttccagaaagaatgagtgctttgcagacataacaatgggtgtaaactacagcttccttccagtttgtaaagcttttatgtttcatcataaaaaaaaatgcagaaaagagaggaaaagtggaattcaaaagcaaaatgtcaaattttgaatgaaacgaatatgttattctgccttgctatgaatataaatgtgttttgttctatgaacttattatagtcccgtaaagcagagtaggaatacattgtttttgtgtatgtgaatgaaaccacactttatgtgcactaaaacagctactcaaagaaacttcgtgatgtgtatatgattttgtgtttttatgagtgggcatatttttaagtaaataattcactttctaaaatgaataacatgtaattgagtattgttacttctggatttttatacatcaggtatatctagagaaaattattcagttttcatagaattaaaaagattaacttctgctcacagtttgaaactggatcaaacttatgatataaagcccttcttccaatattccatagctaataacacctatgaaatctcaaaggtcaatggaaacaaaataatcaaaacagatatgtttcctttcagtaaacctcagatacatttgaagcatttgcctacgagactttaaaaatgttgttcagcagtcatttaaatgcatttgcagatgtcatggcaaaaagcaaattatctggttgattacattttctttctaggttgttgctctttagagttctctgccccttgccctaagagcagagtcacagaaaatgttgggttttgttgatataacttgaatcttcaaatcaacaggatagaagcccgatattcactgtaattactactactgtgttctgaggataggaaaagtaaaaatatatttccctaccctctggcaaggtacaatgaaaacaaattagagttctgtggtagagctccttggctgttccttgagcagacattttctcaagatcatggggatttaactagatttttaatctttgttgtgtaagttccagaaatcataaaaatatctcttcagacgcaaagcaggcattttgtctctcttcaaagcccaagaagctttaaacctaggcagcaaaaacagcaaggcagcaaagatgacaataatgaggagataaaaggtaatggagaccaccctcaggattatttcctgccctctactggagctcaggaggattccttatcaaccagagaagcttttcccaagtcgcattcagagaaacatcacgtctgcctcttgtgtgggatggtgacagtaagtgtgggaaatgcggagttaagagaaggaaggaaaatagggttccttgatgtgcagcctttattttgataaagcaagttgtagaaaaatcaagagaagactaagtccgcagtgtttccttaggatggggatattggatccctttttaaagaccattttatatttttatgttttagttctatggttctttagactcaaagaaaataaaacaagtaataagtgtgtaaaatgttcagatataactatgaattttgggtcagctaccatattggaacacattagaataaattatttattaatcgattaatcaattccatatgctagctggtaggcataaagaaaatcctagtggatcattcttgccctcaacacatatatttttttccagctacacacaggccatgtctaactgtctaactgcctctatgaaggacataggagataaagaaaatgtttattgatcgataaattaaaaacttgctcttgactggataggcacagacctcatcaatctagtccagacacagttgctgtatctgttgacaggtagagataatactttttattctttattagcagagagtaccagcattggtcaagaggtggatgaggcagaaggtacaagtagatcaaagaggattccaattccggaaatttcccagttcattaaagattgacaaaatgaatgcacttatgcatagtcaaaactacagctcaggccgggcgcgttggctcatgcctgtaatcccagcactttggaaggctgagatgggtggatcatgaggccaggagttcaagaccagtgtggccaagatgctgaacctcgtctctactataaatatgaaaaaaattagccaggcgtggtggcgtgcgcctgtagtcccagctactcaggaagctgaggcaggagaatcacttgaacctgggaggcagaggttgcagtgagccaagatcacgccactgcactccagcctgggcgacagagcaagactccgtctcacaaaataaacaaaaacaaaaacaaaaacagaactacagctaaggccaagtgcttttgtgccaatcctaattattttggcactgaacgtgctctatatagtgctatgtatagaccaaggcccagattgaaaagagtgaatctttttaaaaataaccctgaatatttcctgctgtgacaaaatattgaaaataccaattaatgatgccatttttggggttctatttaaaatgttttctattattgaagatgtaatttcaataccatgaggtattgaatgatcacgaggtcaggagttcaagaccaacctggccaaggtgctgaaaccttgtctctactaaaaatacaaaaaaaaaaaaaaatattagccgggcatggtggcgtgcacctgtaggcccagctactcaggaacctgaggcaggagaatcacttgaacccaggaggcagaggttgtagcgagtcgagattgcatgactgcattccagcctgggtgaaagagtgaaactccatctcaaaaattaaaatgaaatttaaaaagaaagaaagagggagagcgagaggaggaaggaaagaaacagaaggaaggaaggaaggagggagggagggagggagggaaggaaggaaggaaggaaggaggaaaggaaaggaaaggaggaaggaagggagggaaagaaagaaggaaagaaagaaagaggaaagaaggagagaaaagaaaggaaggaaggaaagaaggagaaagaaagagaggaaagaaagaaagaaagaaaaagaaagaaagagagagagagagaaagaaagagccaaactattttccagagggcctgagccattttacattcctaccagcgatgtaggagtgattcagtttcttcccatccttgctaacattagtgttcctattttttagttcaacctttctgatagtatgtgttgattttcatttgtgtctgcctggtggctaatggtattgaacatgttttcatatgcttttttggtgtaggtacatccttttctgtgaaacgtctcttcatgtcttttgaccattttctaattaattttttttgctattgttttttcagttctttttatattctacatactagtcctctcttggatatgtggtttacagataatttcttttactctgtaccttgttgttccaccctcttcacaaggtctttttcagaaaaaaaaaaagtttttaatttggatgaggtccaatttatcaactttttatagattatagtattaaatctaagaactctttgcctagaccaagatatccaataatttctcctactattttcctaaattttttttgttttaattttccattttgtattagtgtttgtataagttgtgagacttaggtggaacttcctttttgcccgtgaatgtccaatagctctagcaccatttcttgacaaagctatctttcctcagttgaattgcttttccatgtttgtcaaaaatccattgtgtctatttgtgtggatctatttctggattctctattctgttttattgatctacatgtctatccttctaccaacaccacacagttctgtttaccacagttatataatgtcttgaatatataatataaacataaaataaattcctcccacattatttttctttcaaaattgttttacctgttctacttcatttgctttacctataaatcttagaattatctctatatctacaaaaaaatcttgctggggttttgaaaggaatttcattaaacttgtgtatcaatttggggagaactggcttttatacaaggttattcttcatggatttgaagtatgtctctccatttatttacatcttcttttatttctttcaccagcattttgcagttttcagcatacaagtcctgaacaaactttatttgattaacacctatttaatttttgggcaattttaaacagtattgtgtttttgatttcagcatccacatgttcactgttagtatataaaaatgtaatttacttttgtatatttattgcatatcctgtaatctttctggactcgattcttagttctagaaggtttttttgcagatattttgggatttaacaggtaaatataataccatctgcaaagaggggaagctttaatttcttcctttctgatctgtgtatctcttatttccttttcttgctttattgccctgactagaaatttcaacattatgttaaataaatcctcaccttgttctcaattttagaggaaaacattcactcttttacaactacatataaagtaaacttattattattactattattatttgagactgtgtctccctctattgtccatgcttggctaattttttaaatttttgtagaaatagtgtctcactatgttgtccagccaatgatctcaaactcctggtctccaagtgatccttgcacctcagcctcccaaagtgctgagattaaaggcatgaaccacagcacctggcctaaagtttttgtagatgttctttatcaagttgaggaatttctcttccattcctgttttttgaaagtttttattatgaataagttttgaattttgtctactagcttttctatattggctaatatgatcatgtgatttttctattttatccagttaatttgctggattacagggttaatttttgaatatttaaccagcctgcatctctgaaataaacccacttggttatggtgtataattatttttatatattgctaaattctatttgttatattttgctaaggagttttacatcttaatgaaggatactggtttgttgtgttcttttctctacgttatttttctagttttgacatcagggtaataatagcttcataaaatgaattgagagatattctctcctcttctgttttctggaagagactgtgtataattgaatttttttaaagtctggtagacttttccagtgaaaccatgaacctggagattttgtttttagagatttctaaattatgaatttaattttcttaatagtcattgattgcgctattcaaattatccatttcatacagggtgagttgtaatagtctgtggtttttgagacactgatcagttttgtataagatgtcaaattatgtgtttaagtttatggtattcttttatcctttagatgtctgcaggttttgtagtcatttcccctgcttcattcccgaaaatggcaatttgtgtcttttctttttttttttttgtcttgttacagaactgtcaatttatcaatttttataaagaaccagctctttgtttcattggtttttaaattatttgaatgttttcaattccattgatttatgctctttattattttcttacgcttgcttgctttgggtttattttgctcttcttctatgttctagagtttggagtttagatgattgatttggaaattttcatcttttctaatgtatacatttatgttataaatatttctctcagccctgctttagcagtgttccacaaattgacatgttacattttatttttattgttttttttttattttccagaagatccttcaatgatattatttaaagtgtgttgtttaatttccaaatgtttggagattttccttttagttttttctcattgatttctaatttgattccattatgatcagagaacatacttggtataatgtctgttttttaaaacttattatgatgtgtttaatggcccaaaatatggtcttagggaatgtttcatgggaacttgagaccatgaaaagcaaaacaccatgctttttgctgttagttggaatatcctgtaatcaggtcaagctgattgatcatgttgttcaggtcatctacatccttactgatttttctgcctgcttgatctatggatctatcagttactgataaaggagtgttaaagtctcagctctaataatggaatagtctagttcttctttcagttctatccatttgcctcatgtattctgaatctctcttgttagatacatacacatttaagtttgctacgtcttcttggaaaaatgagctcctcattattatctaatgaccccctttattgcttccacttttccttgtggtgacgtctgcttcatatgaaattaatatacctattccaggtttcctttaatcaattttgcacaacacatcttttttctattcttttacttacaacctgactatgttgttatatttgaagcaagtttcttggggatagcatgtagttgagccatgattttatccactctgctggcctctgtcttttaaatagtatatttaagtaattacttgtattaaatgtaattaccgatatgtgatggtatatttaatgtaattactgatagggcttaagtatgccattttattttttgtgggttttttttcttgttcctgccttccagtggattgcattaatattttttaaaatccatttcaattttctaagtttgtttgtttgtttgcttgtttttacagtcttgctttgtcacccagtctggaatgcagtggcatgaaaatggttcactgcagcctcagcctcctgggcttaagtgatcctcccagctcagcctcctgaagagggaacacagatacatgctactatgcccgactatgtttttattattattatcattattattattattgctgttattatttagagacagggtcttgttatgttgcccaggctggtctcaaactcctgggctcaagtaattttcctatttcagcctcccaaactgctaagtatgattacaggtgtcagccaccgcacctagctctaaatatttttgaatgcattattgtgcagctctttttagttgatgataaaattatattcacacaacttattatagccttccggtgtaatcactttaccaatttgagtaaagtgaagtatggaaccctatgtctcttcatgttcctttactctccccaatttttaatgttttttagctaattcctctatgtacatttagaatcatatcagacgttgttacatttttttcttcaacaatcaaaacaatcaaaaaaattcagaaggatgggtgcagtggctcacacctgtaatctcagcactttgggggaccgaggtgggcagatcatttgaggtcaggagttcgagaccagcctgaccaacatggggaaaccccatctctactaaaaatacaaaaattagtcgagaagggggcacatgcctgtaatcccagctactcaggaggctgaggcaggagaatcacgtgaatccaggagacagaggttgcagtgagcggagatcgtgccactgcactccagcctgggcaacagagcaagactttgtctcaggaaaaaacaaaattttcagaaaatcagagaagataagtctattgtatttcttacatgtttgcttaccacgttttgttcttatctgatattccaaggttccttttcttatcgtttcccttttatttagaaaattccttttaatcattctgttagagttcgtcagctggtgacaaattctctcagttttccttcatctgagaatgttttcatttccccgttatgcctcaggaaaaatgtttgctgggcagaggattacggattgacagttctttcttttcagcaggaaaggaaaaattttgtggcactttcttctggcatccacggtttttctcatgagaacgctgctgtggtttgaatcatttttctcttctagttaatgtgtcatttttccctgactgctttcaagatgtttgttttgtggttgtctgcagttttcaaatgtttattaagtggcttggtatgcatttcgttgggcttatttatcctatttgggcttctctcagcttcttcaactgaaggtttatatctttgctatgcttgtgatgtttttaagccattatttcttcaagtactttttttttttaagttcagctttttattgaacacattataaaagaggtttcgtcaaaaagaccaaagcccatgtcaccatcagacttctcggattcttctttctttgcttccactttcttctcctcagctggagcagcagcagcagaggcgggcagaagctcctgctggtacagatagagccagctgctggaccaggtccaccagcccctacattgcagaggaggctccccatgttgactttggccaggcctttgcaaacaagccaggccaaaagggttcaacatttacaccggctgctttaatgagggcattgatcttattctccgtgacggtcacctcatcatcgtgcggaatgagggccaggtagatgcaggcgagctgggagacgaaggccatggcacgggtgagtgtggggctggcgctgccggacgcggatggaccgagcaccttggtggcagctgaggaaaggttcttcaagcacttttttagtccccttatctttttcctatcctttcataactccaatggcaccaatgttagatcttttgttataaacccacaaaagatctccatcccagaggccgtgctcctttttgtcagtctgttttctctccgctgttcagattaggtaatttctgttgttctgtcttctatttcactgacttagtggtttcttccatcttatcgattttgccattgagcccatccactgagttttcctttttgatgttgtccttttcagtcctaaagtttccatttttttataacttctatttctttgctgagaatttcagtttatttcctgaggccttctagtttgtaatatgcttaaagcatattattattattattattaaataatttttatcatagatcaggggtgtccaatcttttttggcttccctggccacactggaagaagaattacacataaaatacactaacactaatgatagctgatgagatttttaagaatcacaaaaaaaacaaccaacctcataatgtcttaagaaagtttacgaattgcttttgggccatattcaaagatgtcctgggccacaagttggacaagtttgtcatggatacttcaaaatctttgtaagctaatctattaactctgtcatctcaatcttgaccactattgatatatatattttttccatttagttagaggtcttcctggttcttggtacgatgagtattttgttgttgttgttgttaatacagcgtctcactctgtcacccaggctggagtgcagtggtgtgatcttgtctcagtgcaacatctacctcccaggctcaaatgattctcgtgtctcagcctaccaagtagctgggactacaagcatgtgccaccacgctcggctaattttttttttttcccagtagagacggggtttcgccatgtcggccaggctgttcccaaactcttggcctcaaacaatccacccacctcggcctatcaaagtgctgcgactacaggcgtgagccactgagcctggcctgatgaatgttttttaaaattgaaagctggacatctttgtattttgttatgcgattctgggttgtcgttggcttttgatgacaccactcctccggaagagggaaatgctgtttcatgaccacctgctgagggtagaaatttgacactgcagtgagggtggcctggtcaccactgtttgatggcagaagtctcgatgctcccttaggcttcttctgacaccactccagggtggagaagtggggtgttattactaccaggttggtgtgggatatccagtctcctctcgtgatcttcactgaaatgtggatgggggaaaggaggtctcattcctgacaagaagcagaccagtggtgactagggatggggcggggtgagggaaaatgaagaaaaatgggtttcaaaaaggcacaaggaaacttttggggagaataaaaatttctactattttgattatggctgtggttttagggatatattcatgtgtccaaatgcatcaaaattttatactttacagctatccaggttgtgtattaattatcccttaataggtataaaactcaaaacatctgaaaacaaagaaggaaatattttaagtctccttactcatgtcttcaatgtgaattaggttgtaagatggtaagactttctttttttcagcactgaatggtccagaactgtactgttcaatatgttagccactagccatatgtagctaattaattcctcatttatttcttttcttttcttttcttttcttttttttatacagagtctccctctgtcacctaggctggagtttaatggcgcaatctcagctcactgcaaacctctgcctcctgggtttaagtgattctcatgcctcagcctcccgagtagctgggattacaggtgcgtgccaccacacccagctaattttttttttttttttttttttagtagaaacagtgtttcaccatgttggccaggctggtctcgaactcctgacctcaggtgatccacctgcctcagccttccaaagtgttggggttacaggtgtgagccaccgtgcctgactagttcctcattttcactagctacacttcaagtgctcattacccacatgcagctagtgaccaccttactggacactgcagatatagaacccttacatcattaagaaactcttggacagcattggttcaggtattacaatattatgggaataattatctggatatgtgtgtgtgttcatgtgtgtgtgtgttttcataggctaatttttactttttcaaaatgaaattatgaatgtgaaagtgaatagtacaggacctaacacaatatagctatacaacaacaataaaaatgttagcatctcttccatccagtttggaaaatcttttatttgaaataagagtaagaagtcaattgagagaattccaaaaggtgccccaaagcaaaaacaaaagattgaggtttaaatgaactgtacggtataaaaaaggcaacaattttaaaagtaagatagtaaggataaatagtaaaatagtaaggctttctaattaagatacaaaacctagcagccataaaacaaatggctgataaatatgaattcacataaatttaaaaatttctatacagaaaagaagaaaaggcactataaacaaaataaaaataaataaataaatgactggtatacccagacaacaaaacatcattgagttctaaaaagaaatgaactaccaagccatgaggagtcatggcagaaccttaagtgcatattactaagtgaaagaagtcaatctgaaaaggccacacactgtatgactccaacaatgcgactttgtggaaaaggcaaaactatggagagagtaaaaagatcactggttgtcaggggtggaagagatgaacaggtagagcatagaggattgttagggcactgaaatgactctatatgatattccagtagtggattcttgtcattataacccatagaatgcacaacaccaatgataaaccctaatgtatactatggcccctgtgtgataatgatgaaccctgtgtgataatgacgcgtcagtgcgataatgatggcccctgtgcgataatgatgcatcagtggaggttcactgaaccgtaacaaatgtactactctggttgggacttgttggtagtggaaaagactgaggtatatgagagtaagaggtatacaggaaatctctttacctttctttcattttcctctgaacctaaaactcctctgaaaagcatagtcttaaaaaaataggcccggcgggatggctcatgctggtaatcccagcactttgggaggccgaggcgggtggatcacctgaggtcaggagtttcagaccagcctgaccaagatggtgaaaccccatctctactaaaaatgcaaaaaaaaaaattagccgagcttggtggctcatgcctataatcccagctacttgggaggctgaggcatgggaatggcttgaacccgggaggcgtaggttgcactgagccaagatcgagcctttgcactccagcctgggcagcaagagtgaaactctgtctcaaaaaaaaaaaaaaaatggtaccacactgtgaagacatttttgcaatcaactgaaaatggaaagtgtattcttccatgttgtctccccagcactcatcattttgctgtcacattttatatttactgatattagattttatgtatctttgttttaattgcccacttagacacagttcatgagagcagtgattttatttgtcttgcttatgcctgtatcttcagtgtccaaagtagtgcttggcatatgataagtggttggtgaatgaatggaaaaactttgagaaattgacaaagagaccagaaaaccaatagcaaagcaggcagaaatgtaaacaggatgttcacgtaaaagtcaaatacaaatgattcatattaaatgatgaataatctcattcatacttcaataaattctaattaaaacatatgaatacaagttttcactcaatacattcgtaacatgaaaacaaaaaatttataatacaccactttgaagaagagataggcagcaagagttttcatacacttgttagtttctttgtaggatacttttacaatacttataaatttatagttattacttttataactcagcacatgcactattttaaaaatttacactattggtatactcgcaaataaatgtgcacaaagatatatactcacacacatacacaaagatacttattttatcattgcttataatgacaacaaaaaaagtgctgtgccagccgggcgcagtggctcacgcctgtaatcccagcactttgggaggccaaggcaggcggatcatgagttcaggagatcaagaccatcctggctagcacagcgaaaccctgtctctactaaaaatacaaaaaattagccgggcgtcgtggcaggtgcctgtagtcccagctactcgggaggctgaggcaggagaatggcgtgaacccaggaggcagagcttgcagtgaaccgagatcgcgccactgcactccagcctgggtgacagagcgagactccgtctcaaaaaaaaaaaaaaaaaaaaaagtactgtgccaatacaatggatatcatgctattctgatgatgtgagcacttccctaagtgccaaccttactatcagaagaggacttggttgggaaggataatggaattccatcaagtgttttatcttcactaaggattttgagtttgcatcaaaacctaattactgcaaaaaagcatcaggacccatttccaaaccctcatgaaggggctctcccactcctgtatctgcctccagcaaagcactactgggatccactcaccagattatttatttatttattttttgagatggagtctcgctctgtcaccaggctggagtgcagtagcacaatctcggctcactgcaacctccgcctcctgggttcaagtgattctcctgcctcagcctcccaagtagctgggattacaggcatgtgccaccatgcccagccaattttgcatttttagtagaaacagggtttcaccatgttggtcaggctggtctcggcctcccaaagtgctaggattacaggcctgagccaccgtgcccggccactcacctgattattaaaccagattcatttaggactctgctgggcactgcgagggaataacataacagaagcatcatttctacccagaaggacttcaccgcctactaaggcaagctgtgtatagaggagaaagttaaatcattctgactactgcctttaatccaagactaaggcctgaaatcctgaagaatttacaaaatgcttagacctccattataaacttgcagttgccatccccagcctttcttactgctgcttggtaattcattttccaccaatttgttctctccttttgttcattccacaataatgagtatacatcgtgtaataatggggatactggcactgtggagagacatggtaaaaagaatggaggggtcactcttaagaaacctatttgaacagtatctgaagtgaggaaacagataaatagatcatataggcatgaaggaaaagcctctcctttgccctctgaaggttcattgaaaatcattgacaagaggcagattaataggagaaaaagcacacgaacttaatgtgtatatggaagccttctggatgaagacccaaagatatagaggaaattgtccatttttatgcttcgagtcaacaaagtctggaatatgactggacagaaagggaatgatctaatgctactagactgagtggggaagcccagcaacgcctgtccctctagattcttctggcctctctgagcagcattccttccttctgggtatggggcagagctctctctggactgggggtcttaggacctacagtccaacaaggcaggtcagataacttctttatgactacttttacggctggctttgaggagaaggggttctgatttccatgacccgcctcgggccagagggattctagtctctggggagaatggaacaggtcaggagaaggtcagagaaaaagtttgcttctgaggctgcttcagggtattgcattcttagtcccaacaattccaacgtggtaagtgctaggacagacttaagaacagccgcctacaggctcacatacatgaggtgcccaacacagactgagagagaaggaaagggaggaaacactcaggaacttgagtttatggtcagcttcctcccccattctttatggtgactgttccaatctttcaccatggttcaatttctcaatcacttctatgaagttgctcaaaacaaaagcaatatacagaagtttaactaaaaggtatagccctatttgacagagggataatttatacatacagttttgcacagattatatgcacagaattttagtccaaaacttgcaaagttctgacaaatgtatgcaccacgtcgattaaggtataaaacatttccattgtggtaaaaatttaaatgccctcctgatctttcacaccaagatcaccccatgccctgacaaaaaaaaactaggattctcatttctgtcaccacgttttagttttgcttttatgaaatgaaatctcacactatgcacttgctagcgtctggcttctttttatttactttttattttttgaaatggagtctcacactgtcgcccaggctggattgcagtggtgtgatctcggctcgctgcaactctgcctcccaggttcaagcaattctcctgcctcagcctcccgagtagctgggattacaggcatccatcaccacacccacctaattttttgtatttttagtagagatggggtttcacttacgttggccaggctggtctcaaactcctgacctcgtgatccacccgccttggcctcccaaagtgctgagattacaggcgtgagccaccgcgcccggccacgtctggcatcttttgctcaacatactgcttttgattgtcatccatgtcattacctgtattcgtgttccaagttgctgagtcacttccactgtatgaatctactacaatttgtatatagaccttcaaattttttccagtttatggctcttataaaaaatgctatgaacattcttgcacagagcttattgtagacatatattttcgtttattttggtaaatcccttccctctgcctttggtagacatataacgtagtattctgagtcttaaaagttagaaggttaggataaaaaaaaacccagtggtaaaactgtatcaataattctcaatctgatttttaagtggcctcagttataatcttcccttgtctctcacttcaattagaaaatgaaggttagcaaatattaatgccatcaatatacagcctccatacacatttatctgtctttatagctcctttctcctgttttctgttggactttgaggaaaaggtttctgttttcctgtccaaggcaaatccctcttcatcttattttctaccatctcctcaggagctttactgtactttgccctcaagtctttttcatattaaaaaaatgtctatatcaagctcgctagacaagaacatggcacacacagtctggcaaacaagaaatatatataaataatcctacaaacagttacataaagtgaaaagttctgtaaaggaaaactagagggaacaatgaaagattaaaacaacagatcctgatttagtttggaagctcaagagacttctctgaacacttggatagaaaacgttgaaactacagatgagagagaattataaataaggaaagtacttcaggagataggacagaattagaatcaaagtacagttgatgcttgaacaacacaggtttgaactacacgggttcccttataggtggactttcttccacctctgccacgaaagatagcaagaccaacccctcctcttcatcctcctcctcagcctactcaacctgaaaataataatgaagccctttatgatgatcagctcctacttaatgcataggaaatgcactttctctttcttcttcttcttcttattatttttgagatggagtcttgctctgttgttcaggctggagtgcagtggtgtgatcttggctcactgcaacccacgtttcctgggatcaagcgattctcctgtctcagcctcctgagtagttgggattatagacacatgccaccatgcccagctattttttgtatttttagtagagacagggtttcaccatgttggccaggccagtcttgaactcctgacctcaagtgatccacccatctcagcatcccaaagtgctgggattacaggtgtgagccactgcgcccagccttctttctttagattttcttaacactattttcttttctctagcttactttattataagaacacattatcgtaagaacacagtggtactttactaccacttcaagtatgttgaatgctcttttattcttggatatataataatagggcataatatatataatgtacaaatatatgttcatcaactatttatgttattagtaaagcttttggtcaacaataggtcattagtagttaagtttttggggaagtcaaaagttacagatgggtttttgactgcatgggagttggtgcccctaaactctacgttgctcaagactcaacggtgtaaggaatttgatttaggtagaaacagagtcaaaaccctttttctgagatagaaagaaagaatttgactagaaagtgaaatcagtttaaaagcgtggtatgagtatgtgtattccttatttttcctatgaaccagaaggcctgacaatcttttgagggagctgaggatgatacttgaaatttgaaggaagtggtgagaagttagaagtgctactataagaaatgagagaggctgctggcaaggaattagtaaaaggtttgctgagaggtcctgagggcccaggtgagggtggaaagcacctgtgattaaggcgctgcatcttgtacctgcaacacccaactgtgcgggcacatgcgcacagggacaacaggtggttttaaggtgtgtctggcaaaggccctggaggctattcaatgggaggaggaagtaagaaaattgttaaaagaatgaggacatttaaaagtcttgaagcgaaaataaagttaggcaaattctgccttttctgcctccacacctcaaatatacagatatgggacctgtatgcaaagatccgtccctactttatatggcaacaaaagacaaacaaacaaacaaacaaaacaaacaaaaaaacaataacaaaaactgtccttcaaaaaagaccaagtttcttttaaggccaaaaatctaaaaaaaaattctaaagagactgagcctgtaaaagagtttctatatatagcaaagattcagcaactgagataaaactctattttttctcctcttaaaaaaatggagatgccagaacattacctagacatgaacttctcacatttcaatgtgcgtataaatcacgttgttaaaatcttgttcagatgcagattctgattcagtaaacctgggttgggagcctgagattctgctttttaacaagctcccgggtaatgttgctgctgctggtcctcattgagtagcaaggatttagatcacctgaggagtgtaaatcaactctgagtgactcaatggggcttctgtgtttgaaaattgtaaaaataaataattcaaaaccaaagctgttgaaactgtaaatttttttcagccttaatggaatgtggccgtgtgcagaggctcacatctgtaaacccagcactttgggaggctgaggtgggcccatcacttgaggccaggaggtcgagaccagcatggtcaacatggtgaaacccatctctactaaaaatacaaaaattagctgggcatggtcgcacatgtttgtaatcccacctacttagtacgttgaggcaggagaattgcttgaacctgggaggcagaggttacagtgagccgagattgtaccattgcactccagcctgggcaacagagcaagactctgtctccaaaaaaaaaaaaaaaaaaaaaaaagaaatgtgattatgacattcagtcataagacagacagctataacctaggcagctgtaacctttgtttctctgattatagattggcctttactttacttacattgtttcgtaaaatgtaataaaggattaaagggcaccagagaagaccccttgcctcttcattgttggatcttcattatagattaacttcccttttacttcttttatacaaagacctcatgactatcacacagtctgaaacattaaatatacccttctaaactggaaaagggaaataaaacaagctgtaactaatcaaattgctgtaactcataaaccagccttgtatggaaaatattataatccggttaaatttctttgttttctgcctgtataagcaagaccttaacttttcagcttgggagcactgaccccattcctttggaatctgggttacttacatgaccattctcagctttgcacatgaataaacacttttaacctggattctgactctttcatttatttcaggttgacagaatgtaggaagagaatctggcagatctcagataaacagcaaaaggaagagagaaggtcctttgggtccctgtggtgaaggagtctatagtgacctgaattatgaaactgccccatagccttggaggttagagttcaaataggaggtaccattcagatttcccagccattactgagttgaaaactggtggcatcaactggcaccctgtagataaactgacacacgactgtaaacccagaaattggaagtgaacacttctctcactgttatacttgaatgggcatgttagaaggcatactgcaaattgttggaaggagagtcaacaatgagggacaaactagaaagtggaagaaataggtcagatgaaagttcaataacaaagcattaagttgagatggtatttggggtagtacctagtaagacgacttaagaaacatggatgaagctggaaaccatcattctcagtaaactatcacaaggacagaaaaccaaacaccgcatgttctcactcataggtgggagttgaacaatgagaacacatggacacagggaggggaacatcatacaccggggcctgtcagcgggtgtggggctgggggagggatggcattaggagaaacacctaatgtaaatgactagttgacgggtgcagaaaaccaacatggcatatgtatacctatgtaacaaacctgcacgttgtgcacatgtaccctacaacttaaagtataattaaaaaaaagaaaagaaacatggtatgactttctgggcttgtgtatctgaaggaaatggctctgaagtgatggctgtgctggtgctgtgaatgaacacctgatcatggtaccagtccacagtctggatgcttgtggtagagccaaagaattagaatttctctatggattgacgtttccaacataatacacatggatttaaacagttaaggcaaaagtgtttagcaacatatgctttcatgtcactaacctaaatccaccaggaaaaaaccccaagtggatcaagaactctgctctgtgatgatctctccctgacacattcagcacacagaaaggaatcattgctgatcgtttgtaacatgccaagaatgaaactgcattttgggatactttattttgctctcctccttagaggccaagagagaaattaaattaaagtccatagatcaaaagcataacttctcagctaaaaatgcagctacacattagttaacattcagaagaccaggccctttgcggttttgtgactttcaagttaatgtcttctcagccaatgcactaatttcctgctgatcctatcaatgggtcgcgtctgggaatcacagcacctacaatgtcaacagggagaatatgcagatgtctctggtggaagaggtgataagctccatcaaagtcttgatcctctcatcagaaaggctatcaccatttttcgtcccacatgggttttcccctctgtcaatatggccccgtgcctggtaaatctgcataatgagatggttttcataaatcacgtgcaatcaacacacagatttttttggacctctaaccaagactatatgtgttttaactagactgaatacataactctagtgaaataaaaagaaagtttgtctcaagcagagaaaagtcttcaaaagatggctgcaggagtatgcttccccagggagctaatctgtctgggttaggataagaaataaaatgattttgtttttcacatttttaaaaaagttcttgtggttgcaatatccaacaaaatgtactgttgactgcctcaaatggacagtgcatattcttccaggatgggcttggggactgaaaggcagaaggacatacgtgccccttccttcctggcagcaggggaggaaacggcctcatagaatggcagagagcaaagtagagcagcctcatgaaagaggccatggatgctgacatgcttgctggagaagatgaaagagatccagaaagttcctgtggccccttgagtgttagaaatgaaaaccaagtaaaaagtaagaattaagttgtctgctgggggctctccacagtgtggattgagggacctttagatgatggtgtcaaaggcattcgaaccagagtgactccatcttgagtaagggctagggaaaaaatgaggctgggacttgttgggctgtgttctcacaaagttaggtattcctagcctctaggtgcttactgttaagaaaacagattgataacatttactaaacagacccagacttaggagtgtcctgatatccccataccttgagaacagaagcattcttaattttgctttaaaggtaataatatcgattcttacaaaacatagtaattaagaaaattaatcctatatcacaaacccatgtagcacaacacatgatcttttgatatatatatatatctatctataaactagtattgtacctaaggtggatgcattcctccccttacttttggcaacgccctactctgtctatggagtagctgttctttattaataaagctgttctttcttaataaacttgcttttgctttgcgctgtggtcttgccctgaattctttcttatgtgagatccaagaaccctttcttggggtctggactgggacccctttctggtaacatcactagccagttatagacaacagtagtaatggggtggtgtggaggaagggagaccttacattgactatacccagagaacagaccgtgagctatatcaatgcaggaatattgaagagtgaatgcaaatagggcagagggcaacacgcagatacacaataggacatgacatctcaatgaagataggtgagaccggaggaccaaatgaggaccagaagccagggaaaagtccaaggtccctcatgcaaaggcacgagggcacacaacctacttgccttacaccagagtgctgtgcaagaaaaggaaggcagagggaaagtagatctgggaagaaactttccccagatgacagtaagtcaccagacagtggcaggataaccaggaagtgttcagttatacataataggcaagattaaaccacatttccaaaatctctcattatcccccttcctgacccttcatcagtcaataaaatagggctcatgaggacattcgggtcagttatacagtgaaggggaccaaaatatgtcacccaaatatacttctttggcatatttcaagatggctattccgaaaggctgcagacagaaatagtcttgcaaagctgccttttgtgctgcgagatttgcatctgtagagaaaatctacattggtgaaataaacacccaggctctctctgagtcccccttaaccagctctaggaaagattaactcacagtaaaaggagactaaaagtctgggacttttaaaggtctagcagagaaacttttaccactggctactaactgttctttctaatggctgggctgctacccgtgaggtttcatctgcataacaagatagcctttgcttgcaatgcattcctctctcactcttacataacctgtgatgctacctcctcccagaagccctaagcccctactcttctgtaacttcaggctggtataaaaatgtcagccatctgacccctcctttttttttttttttttttttttttgtgaaacggagtcccactctgttgcccaggctggaatgcagtggtgtgatctcggctcaccgcaacctccacctcccgggttcaagcgattctcgtgcctcagccttcccagtagctaggattacaggtgtgcaccaccatgctcaactaatatttgtattttttctagagatggggtttcaccctgttggccaggctggtcttgaactcctgaccccaagtgatctgcccaccttagcctcccaaagtgctgggattacaggcatgagccaccgcacctggccctgatccctgcttcgagtctcacactttgtgtatggctcctgtgtccacatgaatgttcacacatttgaatacctttttcttcctgtgactatgtcttttcttccaaaggtgtcccagctaagaacttgcgagggttaagaaaataaattatgtattttttctccccttcaacagaaataaaaagatgtaccctctgctagtgtcgtggtgttgttgtggtcaattttaaacaagctgcactagggatctgaaagggcccctcctccatttcatagctcagaaagcttgactgttgccttcactctgctggtgagaaaattagctcagcaaatatgtctcttcccactcaggcaaagcaaaaagaaatgacccctgtcaaggaatttaaaaagctgttacctaaaaggggcacaatgaggacattacctatctccattgtcttagtgttaggctacataattaaaatgactccaccatatcatgttcgtaaaagacataatgacaggaggggacagagcaaggtaatgtcgctcccaagagtcagcatattaatggggcctttcagtttgataatgtaattaaccttcttaaatcctactctcagtaaaattccaaggagcagaagctacaagaataatgtccttttcaagtaaccttactagcatcagggcattcacttgagaaatggtggtgatggtcaattcctgataaaagactttaaaacactgtttctaaaaaggtctgagctgccaaatatcagattcacatgaccaagcctatgttttcatcttcttctcttgatgaaaataatttctcctttctttcacaacctttcattttctacattttattgaatttgaagtcttgaaatgcaaagactagagagtcccatggtcgattctataaaatccaaatcatctccttcattggatgctttatgtctacaaccagccttcaatacataaaacatgagactgtccaacaaccaggtggcattggttagatagtatctctatgtatttacaatattattcttttatgcaatgttacttaaaggccaaattttaaacattaatagttcagacagcacttcaccagttttaaatccactggactgaggcactcaatgttacttgtctacaggtatctacagaactaaacttttgcaagctctctccagtcatttcgactgtggcccaatgatgtcacaggactgttgagacaacagaaatcactggatcagtcatgtaactaaccagtcattccctaaacatggaaactgctcaactcatttattatcatcctttgaatatgtattatgttccaggaagcaccatgatccttaccaagagggaagtaaaatatttccataaatatctacagttaaaagtttccatataagtggtagaaacaactatgaaaatcttgaggacgaatacatcattcctggatctggtgatcggaaaaggcatttcagctggccatgaagaataggttggtttccgtcagactgagagacgagactcttacatagagaaaaggattctccatcacttacatcaaaggaaaaatttttcatgggattgacaagtcatccagttcagcctagatacagggaaatagcgtgaggtaacactaaaaaagttgccaggtttcagaaaaccccttcagtctccagtgtgtttatgggcattgaatcacaaattgaaaaattctcccatttcatattcacaattaaggtacttctaaatctaaagttgcacagtttcaaaaagctttagttttcatctccaggctgtcaaagaaagtccaagatcttctaagataatcctttggaagctgagaaatagctataacttccaatgacagatttttattgtacccgaaatttcaagtttcattatgttcatctgtcgtgtactttctgggctaattgttctgctgtagcttagaacaaaaaatataatgcagaaactattcaataaaacctctcattttcacagttagggttcttaccattttttcttggttgctaatgttttcaatttggccatttgtttaaatttgcaatttgttagtaatttgcgtaacttaaacatctaatatataaacctttaacctattgaccattatagcttcatttcatagaagcatttataaacaaagtacatactagaagctgaatttgctcccccaaaagtttacagtcttgtgcattttagagtaaatgattggtcttgtactgattgatggtaacaaataaatgtcaacctcaattttgtattccaattttaacaaaattttggtacattgcttttaccattactatcaagtgaatttatgtaagttaatctaagaaatggcaatgatattttaggataatttcatttagatattttattcttttaaaaactaagtatattctctttccagtgatcaatataagataatatctattataagaatcaagtcagatcaaagtaaggcattgacttttttctgatctcccacattttagttgcctaaattgaatatttaccaagttctgtggcttgcactgcagaactgcactacattaagataactcccattaaacaaattcactttagtgtgtaatttaatcaagctatttgttcagtttgcaaccaggtcttaatttattgtttaattcagaggttactagaaaaatgctcacctaaaaataattaacctagaatctggcaaacttaccttataagaatattggcagaaatcctgtgtggggtgtgaggtacgatgggataacatggatgtgaaaaattatgaagatttggagcctgcctcacaccaaaccaggtttaaattccttagaaaaaattttacataaaaactcatgtctgggtgcggtggctcacgcctgtaatcctagcactttgggaggccaaggtggtctgattatgaggtcaagagaacaagaccatcctggccaacatcgtgagaccctgtctctactaaaaatacaaaaattagctgggtgtggcggcatgcacctgtagtctcagctatttgggaggctgaggcagaagaatcacttgaacccaggaggcggaggttgcagtgagccaagattgtgccactgcactctaacctggtgaaagagtgagactcaatctcaaaaaaacacaaaaaacaaaaatcaacaacaacaaaaaccaaccaaacaaacaaaaaaaaaaccccataacaacgtgagaacaaaagaaaacaagtaccagaaaagtgaccgtgtaatctatatcaatttagggagagacctgggactagagtactaatgtctctactgtaatacttctgtcatgtagcatttatcagagtctaaatttgaagtgggtttttttggagacagcatattgtggtctaattttttagtgcaatctgccaatctctacctttatgtggcatgcttatactattcacatttaaattgattattgctatattcagataaaaatctatcatctgtccacttgttttctactcattgcatttgttgtgcattttcctcttcttttactgccttccattgatttacctgagcattttatatgattctattttatctcctcttttggtgtataatttatgctgatttttataactttttaaggagttgccatagatcaacaatagatatttttaaatgatctaaatctatcctcaaataactctgtactcgtttattacaagtgcaggtacctaataacaaagacttcctaattcctcccttcccttgcagcattgctgtcattcagttcacccgatacattgctactactattgctttaaatgaagttatattttagattaattaagtggattgcttgaggttaggagtctgagaccagcctggtcaacacggtgaaaccccgtctctactaaaatacaaaaattagctgggcgtggtggcgcacgcctgtaattccagctaccagggaggctgaggcaggagaattgcttgaactcaggaggtggagttgcagtgagacaagatcacaccactgcactctagcctgggtgacagagcaacactctgtctcaaaaaaaaaaaaaaaaaaagtgagaaaaagaaaatatttaactttaccttcaattatgccttttttttatgttgcttctttgtgtatatacgagtttagtctttatttctctgtcacctttgaaacatgttagccagacatagaattataggttggcagatttttctttgaatacttcaaagatttttctccattctcttcttgattgcatagtttctggtgaaaagtcttctgtaattcttatggatgttcttctatagtttaagtgatttctatccccctctggttttctgcaagattttatccttttcttgatatgttatactgtagcttgaataggataagcctaaggtttttggttttgttttgctgttaatcctatttacccttttggtattttatgttgtctatttttttcatcagaggctttaacatggtaatcatagttattttaagtttcctgtctgttaattccaacatctgtttcatatgttagtcgggttctgatgactgctttgtctctctatttctttctttatttttttgaggtggagtctcactctgttgcccaggctggggtgcagtggcatgatctcagctcactgcaacttccatctctcaggttcaagtgattctcctaccttagcctctggagtagctgggattacaggcatgcaccaccatgcccagctaatttttttttttttttttttttttgtatttttagtagacacggtgttttatcacgtggccaggctggtctcaaactcctgactcaagtgatctgcccgcctcggcctaccaaagtgctggcattacaggcatgagccaccataccctgcctcgccttgtctctttagactgtgttttttcctcatgttttcgcatgccttgtaattttttgttgaaagccaggtatatcatatcaggtaaaagggactcaggtaaatatacctttagtatgagattacctttatttatctggctagcagttgggtcatgtctaatgtttgttgcagctatagataccagaggctttaaattcctctagtgtttgttttgtttttgtttttgtttctatttttttgtcttttttcttgatttgggggatattcttggtacaagtcttcaagaatgtgtcttgcaggtctttcagctgtaatacattgttactatactggaggcttattggtgtgacggtaaggtggagcggaggtggggggcattctataaacttctgcataagtctcatttagtgagactttttcttggggctgtggccttcacaggtgtttctgtccctccctcctcaaggggtagaggtttttcctctactttccctacttccattcatcgcttcagtgttctcaatccatttcctggatgtcatataccctgataattaggatttttcctttttctttaggtgagatatgctcaagtggggcagaattccacttcacaagctgggataaggtttcaaaattgccctcaggaaaatttattcccctggggactaggcctttgttaggcacaaagtataggacacattctctttcctttcccctgcgaaggccatgaggggatttttctcagagcctaaccatgaaaatctggtgctgtttttaaagggaaagcctacaatatgtgaggctatcccatgaccagggcccccaggagtgactcactctaatgctggtctgccctcagtttccagaaattcatcacatttactatttaaatgttcctgctaacttacggtgtctagcatcttcatttaaatgttcttactaacttatggtgtctagcatcttctgctccaagtaaacaattctttctgtactgtatctctctgaaggagtctgttgctgcagacttttttctttttttagaagaattataactttattttatttatttatttttttaaattatactttaagttctagggtacatgtgcgcaacatgcaggtttgttgcataggtatacatgtgccatgttggtttgctgcatccatcaacctgtcacctacattaggtatttctcctaatgctatccctcccccagctccccaccccgcaacaggccccagtgtgtgatggtcccctccctgtgtccatgtgttctcattgttcaactcccacttatgagtgaaaacatgcggtgtttggttttctgtccttgtgatagtttgctgagaatgatggtttccagcttcatccatgtccctgaaaaggacatgaactcatccttgttttatggctgcatactattctatggtatatatgtgccacattttctttatccagtctattattgatggacatttgggtcggttccaagtctttgctattgtgaatagtgccacaataaacatgcatgtgcatgtgtctatagtgttgctacagatttgaaaatgatatgttgacctatgacttcagttctctgatgggtagaagaaaagtcattgaattttggtttgtccagatttttcttgctgtaacaaagatttccaagtgatgacttaaaaagagtgatgacttcaaaagagtgatgacttctaagttctttgcatattggaaataaaagtggaagtctcagctcttctaatctgtgagaatgttagcaagttactaaatctctatgtgcattagtttttatcatctgaaaaaatgggtataagatgccttacctaatgaagttgctacaggggataacttctaaaaaacatctactgcaaagtctggtatgaagtaggggctcagtcagtgctatttgtctaataaaacacgcatgtattcatttcctagggctgtcataaaaattattgcaaacttggtggattaataaacaggagtttattctctcagaattctggagtctagtagtccaaaatcaagatgttgacagggtcatactcccttcaaaagctcttgggaataccctccttgccttttccagcttctagtggctgcagacattccctatggctacataactcccatctctgcctcagtcttcacatggctttctctgtcttctccttctaagatttatggcccacccagataatctaggaagatctcatcttgagatccttaacttaattccatctgcaaagatagaattttccaaataggtcacattcacaggttctcaaaattaggacatgaacatatttttttcttttttgagggaaagaccattcaatcttctataatgtattagttaagtcagctgttgactgaaccaaactatcagtttggccaaacaattaatcttaaagttccatataaacttctatattgccctagaagaatagagagtagtgttttaatttctttgtccaatagaatagattccacaatacaaccatcagtgccagacagtcaagaaaacatgatctactgtatcaacttactgtttttccttcaaggggatcacaatattttatccacaaaagcaatttgggatcattcctttgaatagagaggaagcaaataatatggttcttatgttgtaaatgggaaattaagacagaagggtaatccagttaatgtttatggtttaattaaaaatgctgacagaaagactcacgacattggtagaacttcttattagtgttgtcaacatagctgtactgcctcatcttcttattttctttctcaaatttcaatctccagaaccaaagaagctctattttgcatgcatcagtaacaatgagcaatttacacttagcgatcctcctctgtcacacaacagcagctgtctgtgagtcctcattctactgtgagaagcaggtttgctgttttattcctctcttattcagtgcatatgcaaggggtggggtggagggctgggtacagaggacagcaaggagacaataatttatcatttccaaacaaacaacaaaggttgtttcaaaaatccagcttactgtttttattttcagtctgtaattcattttcaaaatgtttggacataaccctttggctttgcttctgagcatttacatgacatttagacagtgaacacatctccgattggtgcacagctatgggcatatggcacagcttactggaaacacggattcacaagaatacgtatccagtttcagaataagaaccaagtatttgctgactgagtgtcatgtggactgttttaaactccctatccataactttcaaacctactctggggggcggtcaaggggaggaggtggaagggtagactgttggctggaatctaatgcctttcctttactattaaaaatctatgtgaaaacattcctaatgggtatggtaatataccactttcgtaccttataaaaacctatttacttagtttactcagtttacaagctgagatttgaagcactaaccactcggggtcctatcttgatagccctggcttacttaccaatataggagaatgtgttctgttcaacctgagaaaaatggtgggagaggaccagcagttgaacacctggcccatctaaagtgaggatggtaagaatgataaaggaaggtgaccagttgcctcctgggttctctgatcactgcatgtttagctgtgcggttaagacagcagatttaaacgcaatacagggtcctacgatgacaatattatctgccattgattgaaaactgattatatacaagggggttactattcaaaacctcattattccttataatagccctattaggtaggccttttcaatctcacatcatgtattaaaaccacctttgcaaaaattataactgataaaattattacagtgaaagaggtctgacctaaccaacttggtcttgcttttaacctccaagctgtccttgttcattcctgggtgtagagtgaactaactttgggagcaacgcagtttagagtttaactttgaaacataaaataacagtcctttcccgcaaccaaccctcttcttgcctttgttagactgcctttgcagtactaacaaattagccagaagactagaaattatagtttaggagtcactgttgtaaaacctgagattagtgtttgagatactttgcagagtctacattctaatgcaccagctgatgccacccagatctataaactgcctcatctggtcttatggcccccatccaggaactgactcagcgcaagaagacagctttgactccctatgatctcatctttgacctgtccaatcagcactcccgactttctgacaccctacccaccaaattatccttaaaaaccctgatccctgagttttcaggaaaattgattagaatattaactccatctccaacatggcgtggccagcatcgtgacacttaagctcttcctttactgtaatgccatggtcttagtgagctgattttgtttgtgcagtgggcaggaagaacccattgggtagttgcaatatgatcaaagtgaggcttaaaaggttaggtaacttgctggtggcctcactaaacctcactaactccatgctccctaccatggagataccactactaataattaataataactaataacaactattgttgttaaaatgatactgggtaaaatcatgtaaaataacaactatgagatatagttgttataatgattaaataggtaaaattgtgtagaataacaactacagatatagttgttatagttaaatgaataaaatcatgtaaaatttacaatcgtgtaaaataacaactatgagatatagttgtcataatgattaaatgggtaaaatcgtgtaaaatgctgaccaaaacagccttaacattttcctcagtttgactaaactttagttcagcttcttctggactcaggcccctgaactcccttgttttagagcgcttactttagaaaactcgtagatgtacattttctctctgctcctttaggtgtaaatctttttaaaagcctcttgccagttttgtaacccagcactgtccttctcaaggacctgagaaccattcctttgaaaagtcatcatcaatgaagacagtgcttcccagtctcccagggagggcacaggcttaaattgtcctagttgtaaaactacctcctgtcacaaagatatgagaaaattaactttgttttgggatcacgccaattggcaaacatggatgccctgtgatacgccccactccagttcttgaaactctaaaaactctaccatcctttattccttgagctctgtcttaattctgatttatcttccctaatgcaatagccttaaataacatcttccttgcctgtttacattgtcgagtgccatttttgtttttacaatgcttttcatattgattgattgattgattgattgatcaagatgtagtttcactcttgttgcccaggctgcagtgcaatggcgcgatcttggctcactgcaacctcagcctcctgggttcaagagattctcctgcctccacctcccgagtagttgggattacaggcatgcgccaccatgcccggctaattttgtatttttagtagagaggggtttctccatgttggtcaggttggtctcgaactcctgactcaggtgtggtcgacctcctgcctgccttggcctcccaaaattgttgggattacaggcatgagccaacacatccggctgacaatgctttttaataactgtttcaaagatgagaaaacagaagaacaaagaaataagctaatttatccaggactgtaacccaggccacctagctttggcggtcatgtctgaatcatcatacttcaaagggaaataatatattcacacagtgataaggaggcatgtgaagcctagcaccttcacttaacaggtgctcaaaagctggaagctgtgataatggagaggaaggaggaaaacaggactcaggacaagcagatctattttggatccaggcaatacctcttagtaatcctgtatccttgggagatcacagtaatagtacctgagatttgtgcttatgctatttccctgcagctgaatggaagtacaagtgttctcattgcctaggtgggttttgcacccactcttgattatccagcaggaagcacaaacatctttgaaggatgatgagctagtataccagtgacattctggaataatatctcattatattattattaagggcaagaaagaaatgtgaattgactcttttaaagacaatcaaatcaaatataaatgtcattaaatagacttaaggacgccgaatggaagaataaattatggagcagaaagtcaaggttagtcacagaaactaacaaacatagggagaacaaaggaaattgtggagagagatgtatattgatgctcaaaaagacactgcagatcattgatttgaaatgcttatgtattaatattaactggggataattcaggcctgttttgtattgtacccagattagaaaagcagatgtgattctcccacccctttatcaagaacgagagtaagtcaaagagattgctgattgcaaattaaaatgttaatttctatccattttaatttttgataaattcttattgagagctactaattttagaaactttcaagtaccgtaatagctttcagtctattgagtccctgggaatttgcctttggggccaattgctttctgcctccattatgaagaaatattaaatgctatcaggaagcgcaaaagccacccttggtagagagacaaatttcaatttatgaaaggcaaagtattttaggttatgtaatatgctctccagtgcaaacaaggagttgaggatactagctttcaaggaaagtacaaaatacacaatggtgttgaacaggacaggtcagtggttagcagaagtagtggcagcaacatcagtagaggggtagtgtggtaattagatagtgctatctaagctttactgaatgcttattaagttcttatcacagatccatgggctttatatgtattaggcattttaatccttacaaaaattattttagatattatcattatctctggtctacagccagggaatataaaacaaagagaagttcagtcatttgtccaaggtcacagagctgagaagctgagatctgaagccacattgtgaccaccacctccagattcaagctctaactacttggcatgcctactgcctaggggctgtgcagggagcttttcatattccacattgctgagaactgatgaaactaaatatgggggagggaagattgtctttttgctttatctatgcctcaagaaccacagagatgaaacatgtacaaaaatgggaaattctagaagctttttttttttaatgaaggatattacagttcataagaacaaagctatcacaggaatcattttcaatggattcagttacctgatgaaggtactgaagggaaatgcagaatccaaattatctaacagataattcacaaaatatgattgacagtggactcactttctggaagttagagcaggctggtgctaaactgaatcataatggaatgatatattccctcaggtgaaatacagtctaaatcttcatgctgttcgtgcagcacatagcattaatagaacatagtaatgtggacatactttctaaagcagcaatacaaatgtatattggcaaattgtctctttaatatattgtttaacttctccatagcactcaacacaatgtgtataattaactgagcaattatttatttagtgcctgcttccagcactggaatacaagctctgcatggtcagcaactacacatttttcttattatattttgccttcccagtgtctagtggtgtgcctcacacacagagggaactcggtaacatttgttgactgaataaatgtaaggtattttctacataatgcagacttgttaatttattctgctattaataatttattgccgggtgcggtgactcctgcctgtatttccagaactttgggaagccgaggcgggtggatcacctgaggtcaggggttagagaccagcctggtccaacatggtgaaaccctgtctctactaaaaatacaaaaattagccagacatggttgcacatgcctgtaattccagctactcgggaggctgaggcacaagaatcgcttgaacctgggaggcggacgttgcagtgagccgagatcgcgccactgcactccagtctgtgtgacagagtgagactctgtctcaaaaaaaaaaaaattattgagtgctgtttatctgccaggcactacactgggcactggacagctaacagtgagccaggcaggaagggccatgctctgggggtacttacattacagtaagagagagacacaaccttgagcaatgcataaataaaatcattctagatattgttaagtactgtgtgaaaatcaaagagtctggtgagtgagagggactacttggtgagcggggtttggggcatccaatgttaaactaagtgggcttagaggatctctctgagtgatcataagacatccatgatgtcttcaaaggaatcaaaggaaagggttttgtacgcgtaagaaatggtaagaggagaggtactgaggctagaatgagcttggcatgttttaagaaaaaacaaggttccagcctcagcaacataaaaagaccccatctctaccagaaattaaaaaaaaaaaaaaaaattagccaggcggggtggtacgtgcctgtagttccagatgctcaggaggctgaggcaggaagatcacttgagcccagaagttccagtctgcagttagctatgattatgtcattgtactccagcctgggtggcagaatgagaccctgtctcaaacaaatacaaaagaaaagaagaaaaaaaaaaagaaggttcatgtggagtgtggtggcagggagtggggagggaaactggaggagaaacttgggaagtgagcagagattctgtaataagatcctgtaataagatcctataataagaaagattcataataagaaattcgttttaattctaactgcagtaggaagttggtgagtgatcttaagtaggggaataatgtgatgtgatttgcatttttaaaagatgactttggctgctgtgtggagaatggcttgaggaagaagaatgaaagccaggagacccactgctgcccagggtgcgtggtatatgtactccaggggaaagatgctggtggcttagcctagcgtgatgaaaagggagatgagaatgagcctggttttgagattcttctagtgacagaaccaataggacttgatgatgggtgaagcgagggaaagagagacagatggaggagagcctaggtttgtatttttacaactgcatgagaggaggagccggcagttgagaaggagaagtatggaggaaaaacaggtggagagaatgggaatcaagaattgggttttgtggaacttaaatttgaaacacatattagataaccaagtagaaatgtctagtgtgtaggagaatatagaaatactgaagtaactagcatctagatggcatttgaagctacaggattatactacctgtgacaggaaatatgtgatttattaatttagtgcaagtgtaggctagctggctcgttttgaattaagatgagaggaaatagctttaccttgtggaaccactggagagaaacgtgtatcagctctatgagcatgattactgggcatcagccatgttgagtgctggacttcagaaaatgaagatcgggacagcagaggaccaagaagccagtgatgttcactaagcaggcaccagccttccctccctttcaacgtttggatgttgtagttacataaattcctggccacatagactcaaccatagagttctcaagaggatgccgatggatagagttttgaattggattgggaatccaaatcaaaagtacaagaaatctgcttgtgaattgaatttacctgacagtgtcaacattaagttgtctgctaggaaagagtttggaactcatattcagtttgtagaaatacatacaattatagcttgtgcctatccaaagctttactgttgcaatggtattatgcagtgagggaggacacagaggtagagacaagacgcacagtacacagccccaggccactgggttcacttcatcattagtttttgttggagaaagagactgagatgccggtgaaacagggaggaggagagccaggagagcacgggatgaaagaagcccatcaaagaacgtgtttcagctgaaagatgctgctgaagaggcaggcaagatgcaggcagagcaatggagatcagcgagggcccagggaggcgcagggactggagctgagggcacagacacccttaggataagttgaaaagcaaaggacaagtcgagacacaaaataatcagcaacaatattcttatgcttgagaggatcaccatctgggtagtgaggcaggatgagctacatcataatgacataaatcataaaaccgatgcgacgatgactaccaaggccacctgttgacacagaagacccaaagggaatgcgaactggggcagccagaaagggcttcaaaagatactgtgttcctatttcgaagaaactaagaataagatgaatggtgagaggaagaaaggatgttccagccaagagattggaccaacgtgggcaggcgggagaaatcaatacgattgaagaggcgaaaatcaaagggacaaagagatttctggaggctggctcggtagggttgtaggttgaggctgttgatgtaaaaaagaaaaacaaaacaaaaacagaaactagaggaagtcactctataaagcagaacaaatccaagaatttcctgacacaaaattaccatggggggagggggagggaagtagccatctagcaaaatacattacacccactttcttttagcttcaggcacagccaccaatacttattttcagcacccttttataaaaatttaaaaccccatgtaattatattcattcattttaaacataacccctcgaaatctagctttgtatttaaaaagaaaatctgacgtggggtttggaatcatggttatagatgaatttggtgacaagtcaaacattttggaaatgagtttccacacatctgctaaagaaccttttgttgccctttgagcagaatattctgggtgtagtgacatgtgcaaaataagaaatttaatatttttaagccttcaagatgaatgttacaacatctgaacaagaataaatgccatgcttattcaattaccttgcatcccagggtcttatttaccatcagctttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtggtattgattaggcattatcctatcttcaagaagttcactagttaatggacctttgggtgtggcatataaaggtatgataagtataagggccaaaaagacaccacaaagaacaaaattaggaacaaattatgtattactggccaggcgcagtggctcacacctgtaatcccagcactttgggaggctgaggcgggtggatcacctgagatcggtagttcgagaccagcctgaccaacatggagaaaccctctactaaaaatacaaaattagtcaagcgtggtggtgcatgcctgtaatctcagctactcgggaggctaaggcaggagaatcactagaacctgggagatggagattgcggtgagctgagattgcgccatcgcactccagcctggacaacaagagcgaaactccgtctcaaaaaaaaaaaaaaaaaatatatatatatatatataattaaaataccaatctaacagcaacaacaatatgttttgatgctcaagaacatgtccaggacaaagcctgcaggacacaaggtccctgtgccacctgcatctgtcactgcatcattggttctcatgacatgttccagcctcaactgatgccactatacttaattggcacagtttaaaattataaaatattagtagtaaaagggaccttagtgaccatctaggcttatttcttcatttcagaatctagcctagagattaaaatgttggtttttatccccataattaatttgttgaatcgtcaagaccagaatgaatgaaagtcatttaccttccagtcctatattctttagctacaccacactgtctgccatccatatggaatttgtcctatacccacccaaattcttactgcttcgtctcagaaagtcttgccttcaccatggaactcttctaaccactgtctctattgatctcactcttctttgagctcctacaacactcacaggctaagccacaattgtcctatcaattactttattgcttctcgtagggaactctcccaagtacacagtaggtcacttgaagatagagactgatcctcaatagtattcttgtgatcctagcttctgtcgggcacagtcaaggcagccctaaatacctgctcagtggctgaatcatcatttaatgtaacctcacctccatttactatattgggtatatcaaatacttgctattacatgaaaaagccatacctgtcttcaaactggcacacctgctttacacagggcagccaatttgtgctttaaaattctaaataaatttagctcaggtgaagataaggaaaaagagtaaggtgtgattcagttgctttttttcacatatttgtttctcagtttttgtgtgtagaccttggataaggcatttaccttcactgaatcttgaactcacctttactataagggtaatattatctactttacaagtacacatgcttattgtgaagattaaagaaaattgtgaatggcaagagcatatcacactaatgcccatgttttccatcctactgctctagcctctaaaacccaaatccatcctttgtctcattctgctaaatcctgggaaggtgctagcagatatctaaggagttggttaaaacagacttaaggtgagactcctccctaagacagttttttcatggacacaggaagaggaacatcacactctggggactgttgtggggtggggggagggggaagggatagcattgggagatatacctaatgctagatgacgagttagtgggtgcagcacaccagcatggcacatgtatacgtatgtaactaacctgcacaatgtgcacatgtaccctaaaacttaaagtataataattaaaaaaaaattaaaacaaaacaaaacaaacaaaaaaaaacaaacaaaaggcagtgtttttaacaaaaggcttcttcgaacctcaaaggattgctgttctcacagattaggacaggcactggggaagagggccctgctggtgcctcaagtcatccccagaagcagtagcctcggagtgtcttggtaagtggatgcggctgggaacagaagtgcatgcagctgggactagaagccctgtgctctagtttcagctcttgctacattttaagttgctcttcttaaaaatgagggcaatgacactttgggaggccgaggcaggtagatcacaaggtcaggagactgagaccatcctggccaacatgggagaaacccagtctctactaaaaaataaaaaaaaaagaaaattagcccggtgtggtggcacgtgcctgtagtctcagctactcgggaggctgaggcaggggaatcacttgaactcgggaggtggaggttgcagtgagccgagatcgtgccattgcactccagcctgggcgacagggtgagactctgtctcaaaaaaaaaaaaaaaaaaaaatgagggcaatgatttagatagtcaccccaatcattccagccctactatcatattctaccccttcataccaagaagacagatgctaaataaggatcaggagccataatgttaattttaaccaaaaaacccatatatattcatctggtgatactagagctgaagaaaaccatgatgattagtaaagcaagaaataaaaaatgtatttccccggattttttatggttggttgtagatagaaaaatgggggaaatttgctgattgagattaaaataataataaatatgtattacatatatactttgtgagtggcccaggaaaaacagattttttgtttgttcattttttaagaacaggtagaaaaaaggatttttttaagtgaaatgaaatttttatcaacaggaagacacaactcatatgtatgtcctcaaagtctcaatttcagaccctcacatgaaaggctgggactgttccaccctaccccattccccattcccccttgcaaggtcttggcgattcacagtgtgccaggcaaggaagagaagaaggcctctctgtatgggtcccaaatactgcagaggctacagaagagatccatgtctctacagctaatacgccattgttgcagttcttaaaataggtagggtcccatttcagctggtggggaccaaggcattctgtgacatttggatgagaattgcaaagtatctcactgtcaatcaagtaaaggaatatttcatcttcatagcatcatatccaaggcagcaacagctttcaagaaaaaagatgccagaagttcatgggcactatcaacaatctcaataagcctcatgagaaagttgtttcacctgtccttaatgcacagttatgtgggaagagagatttgtttgtgagctttgaagcaaaatggaaaattagcttaacctctgcatcaatagttcagaattgtggccacatctcacattgttactattgttcgtagcaacataattataaaatcgcagagtttaaaattttgtgaagactccctaagtgtttatttcccaatttctaaacagagatactgcacttcttcaaaagagtcatggttacgggtagtctctgcttttggtgtttctacctgcatttcactaagaaaatatcacaatacctcatctatttaaaatattatcagccaggcgtggtgattcatgcctgtaattccagcactttgggaggccgaggcgggtggatcacgaggtcaggagttcgagagcagcctggccaacatggtgaaacgccgtctctactaaaaatacaaaaattagccaggcatggtggcggacacctgtaatcccagctactctggaggctagggcaagagaatcccttcaaaccagaaggctgaggttgcagtgagccgagatcacaccactgcactccagcctgggcgaaagagcaaaactctgtctcaaaacaaaacaaacaaacaaaaacaaaaattagccgggcatggtggcatgtacctgtaatcccagctactcaggaggctgaggcaggagaattgcttgaaaccggaaggtagaggttgcagtgacccgagatctcgccactgcaccccagcctgggtgacagagccagactccatctcaaaagaaaaatatatatatatataaaataaaatattatcaatagcttataatgggcacacttcctacaactccatcaatctgctttcagccaacagccctgtctctggggaacatgtagtgcccggttaggaacttatattttgaactgcagtcgctccaaagggtacaactatagcatggtggataaaaccaacagggctcgtctctggagcttctctggcttattttggcaacaggtggacctgtgtggaaaccagtacttattgcattcattattcagcaggcatttatttacagggtgcctggcatatgcaaagtactaaggttatagcagataataaatgataaatgtatgaggtgacagacatgctaagtaccctgacttgatcattatacacaatttatatgcatgaaaacatcaaattggatcccataaatatgtacaattacaatgtgtcaactttaaaaataatcaaatttttaaaaaagagtccaaaatgccggcctcatgaaccttacatttaccaaattgttgcatatcctgacattgcaaactctggggaccagaaagagggaaccaggcctgggtgctcttatatccctggaaacacagcaggaactactcagaagtcacagaacttcatgccagtgattattcaaataaatggcgcctctgtggttttaaatagaaggtagggaaatcactgtcatttccaaattataagaaataattgataatccagaagttgttcatgttgcttaatagtaaccaccgtgcaccaccctgacttactagagctcttaaaacctcatccagtatatagcactattcactgagcaattaatattctaacttatgtttgagtattttttaaatttccaaataatttgaacaaatttctcacaagaacatatctccttttaaaaatatgacattaggccaggcgcagtgactcatgcctgtaattccagcactttgggaggccaaggtgggcagataatttgaggtcaggagttcaagaccagcctggccaacatggtgaaagcccatctctactaaagatacaaaaattagctggctgtggtggcgtgcacctgcaatcccagctacttggaggctgaaacaggaggatcacttgaacctgggaggcggaggttgcagtgagctgagacagtgcctctgcactccagcctgggcaacagagtgagaccctgtctcaaagaaaaaaaaaagacattaattctatgtattgataaaaaaccctgaacgtcatgttttcaagaacactctttctgctcataactagctatgtgactgggctcagggcattcaataacctcagcttcctcagctatgaaatgaatgtattcaggtgaataattatgaagtctccagtaagctacatgatcttttaatgctaaatagatcagtgcagttggtgtggattgactctgccccatgatgcagtaagagatagaaggctaaatgcagtggttggagcagaaaaggaagagacagacataaacacaccaacaggtcaggagatagagggaggacctgtggtatgaaggcctaaaatgaagcctcaatatgatatgtgccttgacatcttggaaaaaacaggagatcctccagcggcctaactgcaagtttccccctccatggggctcccatagatcctggagccaaacaaccctccttattaagaagtgcaggcccagtttctgcttttctctgagtggcggccttcagttcccttccagcccatggagttattcaaataagccagtcacattctcccatggaaccagggttcaacctcttgttactacaaagcctacctcccacatcccctgattgttcaccgtgttcccaagtgcagcctttgtgtggctgttcctgcagtggcctcctcctgtaggctgtgaatgtatgtgattaataaactgctgtcaatgttatctgtccagcggcaggtgccatttactcggccatctccataatccctccctccttcaaccaatgggatgcagagaaggcaatcaaaacaaacttgttcatgggtcaacttgacacacgcagttgattctgagtatatagaaaataataaggtaaatggcctccaagtgagtgcaaggcaacagagagaccaagaagatacagaggaaggtttttctgtaggcaggtggaggacagccacaggaggtgtaggtagccagaggcagtcttatgagatccacatctaaccacaggatgcagcctccaggcaagacggctggggctggggacagggctccaaagtttacataggtcagacaagcaaactaaaggaaggagttggaccaattatccagacaaagactgagccacagagggcagatacaaatgagtcaatagatgctcaatctaaggaaaaaaacagaactttgattactcagattgaatcatgggataaaatattagcagccaagtcaccctgatctcaagttactgcccttttcctcgtccttttttttttttttttttttttttttagacagagttttgctcttgttgcccaggctggaatgcaacggcgcaatctcggctcaacgcaacctccgcctcccgggttcaagcaattctcctgcctcagcctcccgagtagctgggattacaggcatataccaccatgcccagctaattttgtatttttagtagagatggggtttctccatgttggtcaggctggtctcgaactcccgacctcaggtgatccacctacctcggcctcccaaagtgctgggattacaggcataagccaccgcgcctggcctccctgctttttagcattcaagacagacttgtttccagaggctgaatagagctgatctgtccaggaagttttagaagagctcaaggggaattgtgagtcacaaaaaaatcagaacgagggccacttgccattttcatctcattttaatcatgttatttttccaaggattaacaccaaattttcaagactgttattcacctatttttaaaactattttgcagcttctatgtgtagctctggcatcatgccaggtttttgtgattttcaaaataattgggtgcctcattaaatctgttagctaacccccctaagatcatggagttcggtattgccaagatcacacacttattccattctttaatttttgaaagtggcttttatcaggattatcttggttccataattggctaaatctctccattctatttcctttaatttaaaatctctatccagttcttagtctctatagaacacattcactgcttgagcttttccatttggggccaggcctattccacttgtattacctttcctcaatgtattttataaagatttctgggaggtcttccgtagtcttccacactttgtaggactaagatccatatttgaaatattcattcattcaactaacatttacttgtggcacacctaaaacttgctaagcattggatagaaacttcaggaacctagtgaagaatgcagttttattttacagagtgtaaattttccttttggatacaaaaatgtgacaaaaaaatcaaggcaaattctttttcttcctttccctaaaacctcctcggattctggatctaggattgtacttacaagaccaatcctataattcagacatttggcctctgtatgtaccgtgattaagcaagtaaagtctgggtctgcccgagttaaaaccagtgctttactagtcctacaaatccggaaatcattcagattcatttttctttcctggagacctctgccttctaaccacaggtggtctgtacctgtcctcagatgtgccgtgagattgggtgtcttacttcaggatcctagctccgtctctctcagtttctcccacttcccagcgtcttcctcaaaaaaggatgcatacaaggtagatttaggtgctcctggctgcctgagatgtctttgttccttcctcaccttgcatggaggggtctgagtaagtgtagaatcctactttagatgactgcacctgattactcctttgctcttcaggactccgaagggactactccgttgccttctagggtaccaggatgctgcagagaagctggagcccattcctatttccagtgctttgtttggacttattttttctcttcgatgttctaaaaattcacaataatttgcctttttttctctctctttcaatttttggggctggctacttggcagacctttccctctggaagtgcatattctttggtttgaggaattattcttgcattgtttccactgatttctcccccttattatctctctctatacgtagaacttccagtgatcacatgctagagccccccattttcacatcttttctctactctcatcaatttctttgccttttattttactctccaggcaatttcaactttattgttaaattcttctatgtatttttttagcacacatatttttaatttcacatagcactatcctgtcctctgatttctctctttagcatagaatcaatggaatcttccgttatctctccaaggatattaactacgaggtttttgaagcattctttttttctatactttttaatttccctgtttacacttctgaaaatttaacttcagttggtttattttagaatatgcctttccttttagaggttgttctaaaatgtctgattctagaatgtttctaaaacatttgtatttcttgtcattcgtgtttaaaacaaagccattaaaaagctgaccggaccgttgagcacactaggggtcttgctagctggtggaccttaaggttggatgactgggcagtgagagcttttttattgggacacacccaaagtcactgtctagaggacttttctgctttctggtggaaaagaactgcccaagcccacctgccattcagcattctgggagcagagccaggaagagagctgaggcttccataattcagtgcgtagacttcagcttcctctcctgcattcagccctgtctgtctcttcaccctagaacagggtttctcaacctcggcactattggcatcctgggctctagccctgtgggagactgttcggtgcatcgtaggacgtttagcagatctctggcctctacccactacacgccaggagcaccccccaagttgtgccaatgaaaaatgtctctagatatgggccaatgttccctggggtgggctactgccctgcagggtgcttgggctccctgaggtctgagttcttccaactgtttctccagttacaaagttctaaactcttctagaagcaaagggtaggtgtggtttcctgaagctaggagatacgagagggaaagtggggatgtaaatgccacatgtgaagattttcttgcaattttgcctcgtgttatccttgctctctgtggtatctagagcccccagtcatgtgtcattatgggactctaacagttgctgctcaatgatacctgcagacactgagttcagctttgtccctccgctggatcagtctccactcctccaacccctacatattccaaaaatgtgtggacacctctagcccactcctgactcctcacctcttcactattgaccttgtcttttctgtcttttactggcatttacatggacttgtggaagggggcagagagaagccacatgcccaatgccccatgtttaactagaaacctgtactgttactttacaaatgtgattcctcatttattggtttagtacgtgcataatgaatttcttcagtagttattctagagattctgattaattatacagagtgatattgatcacttatatcattttttcttttcccaactcagatcaactatctcatgctcccagattagttttaacagtttaagaagtatggaagagttgacagactcgtgggtctctttttaaaaaaatctcttttgtaaccagcctagacgccttggctgaacacgataggagggctgtggaggtggcataagctctagtccaaggctcccttttgtggaaacgtgggtagacgcctcctggcggatgcctacagcaatacctggagcatgccagcaagtaaaaataaacctggaagagcactgggttcaagcccacgttccgtccatcccagagggccctcgagcaaggcctcctgcccaatcacatgtttttatcataatagattcttccaggtggtaagagcagtaatacaatcatcacacagtttgccaaagcattttccaagaataactgccagaagtgtgcattcagcttgtgtgtccatatgctcctggtaagatttagaaagcagggaaaagggatgagaaaagattaagtcaggaaaattgaaaaagaaggagacaaattgaaaagggaagaaatcgaaaaagaaagaaaggtgattccactgatgagtgggcgatctgctactctttgaaccataaatacatttcctctaactaaatgcatcataggtattctcaattcgatgtattggttttccacaacctaatctatgaattttcaagtgtaattgtacactgctgtctgaacaacacaagagcaagtccttcagcattgtacatagtgtagccatttaggactgtgcactcaaaattggttggcaaacatagggcattatgaggctgaaataactgtagctcactcttcctgaacctcattacttttggcagtgcctctactggtaagtgaaatgagttggatagcacaggagcagatatatgtttttaagaataaactcagggaccttgagtatcacaaaatcttagttaatccacctcttttcctttagaactctgcttcagcctcacccctctgaaagacctggtgccagctctgcccgcctccactggctccatttatcaatgctggcccctgcatccctgatcctctcactaatcctaagcttagagtggcttttcctctcccatggggccaattcctattgaacttcagttagtccaggtggagtggggctctcggtctaggatacaagcaagctcatgcccttggtctgactaacactatattttaaaattggacccaagaaccaatagaaatacattccttccatttaccttgggatgcagaaatactctcttttaatgatcttgaggtcattttgttccttgcattgcaaatcctacaaggataaaacttttatcttaaatctacttacttaaacttctttttttaacaagacaaaatttaagccatattcccatggctgacacaaaaactgaagcggttttctccatcctgatgtccttggaaattgtacttgtaattcagagatcaagtatctgtcttcgtttaaagaaaataagcaccaactggagctctagtaagttttcttttctctctccaggggaggttgttgccctatgtcatgagaaacacagaggacctgacatgtagaatgactatgaagcagtgttcatagaaataaacccccccccctttttttttttcttgagacggagtctcgctctgtcgcccaggctggagtccagttggcgccatcttggttcactgcaagttccgcctcccgggttcacaccattctcctgcctcagcctccccagtagctggggctacaggagcccaccaccacgcccgctaattttttgtatttttagtagagatggggtttcaccgtgttagccaggatggtctcaatctcctgacctcgtgatccgcccgtctcagcctcccaaagtgctgggattccaggtcccatcccttttaatttctgcacgggccctactttaagtatcgctgcagtggcgaaagcattcatcattgccgacctgtgtggaatgtgaacctgagtattttctattggcgggaacttacgtggctaaaacgtctcctttataatgtggagctaaacagttcaaaatcttgaacagatcttatcacccttaaagtattatgtaatatgatcctcacccaagaatgacctccaagtttcctgacatacttgacgggggagactggtgtcacatgaggaccagtaaaaaatctgtactgaactgaaatttttatgcctcaacatttttttacaaaaggaaatcaaatgtgaaaatttatctggatgctccatacttcaaacaattcccattaaatgcattaaggctttccagtggcctcccatagcaggattcctccaacacttctgtgacggttcattttacatgtcaacttgactgtttcacaggagtgcccaggtatctggttaaacattatttttgggtgtgtctgtgagaggctttctggaagaaattagcatttgaatggtggactgagtaaagcagactgcccatcccactgtgggtgtggcttatccaacctgttgagggcctgaacagaacagaaaggtggaagaagtaaggattctctctctgctggagtgcttgagctaggacattggccttggagtgggatttacaccagcatcatttctggttctcaggactctggaatcagactaattacaccaccaacttccctggcctccagcttgcagatagcagattatgggacttaacctccacaatcacacaagccaaatctttataacgtgtgtgtgtgtgtgtgtgtgtgtgtgtgtgtgtgtgtgtgtgtgtgtagacacactattggttctgtttctctggagaaccctgactactagaatttctttttttttttttttatttttattttttgagatggagtctcactctgtcgcacaggctggagtgcagtggcgcaatctcagctcactgcaacctccgcctcccgggttcacgccattctcctgcctcagccttccaagtagctgggactacaggcacccgccaccacgcctggctaattttttgtatttttagtagagatggggtttcaccgtgttagccagggtggtcttgatctcctgacctcgtgatccacccacctcggcctcccaaagtgctgggattacaggcgtgagccactgtgcccggcctgactactagaatttcttataatggcctacccaaggtcacatatgatctcactcctgcagacctccccaaattatttcctacagcttccccctccccagcttcctgctgtcctcaaacatgccaggattactaccaatttagggcttttacacttgtttcttaagcctagagtgccttcaactatattttgtcatggcttttgatttctgctcaaattatggcatctcatatgtgctttccttgaacagccaatctgaaaagaagttcctagccccatctgtatccaggctccctctagctgtttttccagtggttgaggtctttaagtttaatatctctccaaatatttctttcttctcaactcccattttcctctcttctagactccagttacctgtgattagataatttgatattatccacaggtctcaagtagcctttttcattttttcactcttttcctctctattttgcaaattggataatttctattcacttgttcaaatttactaatcccttcctctgctatgccatgtttgctattaaacccatcaaaaaaattctccatttctgatattgtacttttttttccagcacagctgtttgattctctatcatttctatctctctaagatttcctttactttttcactttttcattgtccatttttctgctgatctttaacatatatacatatgtatgtgtgtgtgtctgtgtgtgtgtaatctgtccaataattccatctggtccattccttggtctgcttctgttgactattttctctcttgactttatgtttcttcacataattcatcaatttttattgtggttcagatattataggtaaagtattattacagactaaagtaaataataatgaacccccccccccaaaggatacactccttcttctctcaaggctgagttagctaatctgcagctgagatgtgtctgaacttagtctagctttagttagattcagttgaccactaactataagtttgaagacatgataggactttctctttagcaagattgggtatctgcacattgtcaagactctgaaaatattgttctccttaacagcccagccaccaaacttctaagctctggaaatctctatctacttgtcagtccatctgttagcttttttttttgagggagatggagttctcagggaattgttttttgttcatttgtttgttttgtttgtttgcttggttttggtctagtaccacttctagctttgtgtgcctccaagtagtgctctctcttagcattactgtctgactgccagcctttagggtctctatggtgtgttctgtgaagaccaatattactttggtggaattattctcagctttcctgcccaactctagccctcataggacttctgcagtgtacttggtgaggcctaaagtgcctcaaagggatttctttcctctctcctgctctacccctagacttcagcagccctctgccttgtccttaaaaaaagtccctcatatctcagggtaaattagttcagcaaagctgctctgattccatcatttggcactgtaccctgtgcatttagtgaaggtccctggaaaagagtgggcagacagatgcagacttttgtgtctggagctccttgagattctaatccttcctgccagctcatatgcagccaccaaaagttgggctggtttctcttctcctattagtccaccaagaataaaagcaactgtggatctcttctctcatggaaatgtcttgccactttctggaaattagttaattgtctctttttgcatactcagctctgatgggtttgagatgttacaatgctgtagagtgtctggcttgatattaaggttagagtggaagtgatagtctcttgtacttcctacatctatccagatagaaaagttcccaccacatctttgtcatctttatattttcagcatttgtactggtactagtacttggtagtcactcaataaattttttgttggatatgtaaaaagagaacagtgatattaactagacacctaattggtagtattaaccagacacctaactggtaaaagattagttaaacctaaatatgcccagaattttttgaagaggcaaagattatacaaataaaagaatttttaaagtaatttatagtaatgctgccactctaacacaactatgtacatggaactaatattatttattacgatcttataacactgatgcctatctgaattgtgcagatgaagaaaaataatataatctatgcagatataattatgacattagctgaggcaggaaaagtaaactctaatgtatttaagtggaaaacacacaaattaagttaaaacaaatttttaatggaagagtagaactggttcactattcacgacttttccaggtttaaaatgaatacaattatattactagtaaaacctcattacggcccatggaaatgccctgtggttacactcagtgtttcctcccaatctcatgattgactatggaaaactgcaaatctaggttttccctggttcatatcagcctgagaaattagactgaattatctgtaacatctcccttttaaacatgtgctttcagataacatcacgaccagagtactgacgagatatttccttatccaggacggactgattattcaaattaactttggtagagtaaacatgattctatattatctgaatagctacttggtttaactgacagaaatgaggaacagggtcagaacagtcagtgtactataagtgcacttatggcatcaaataccacaagcaagccaaggctggttcagcaaagcaattttggagacatccctccccataaagcctgaatatagctggcccctgttcagctctggttgggggaaaagtggattattaagaaaacacttcagatgtggccacagccacatattaatagccacagtccagcaataatgctttgacctgaggctgataaaacatggtggagtacctactaatttagattatgagctaagaaagttgtctattttttcactccgaggaaaggtaatatttagtaggaacagtttgtgcaatgagtcattttcatccataaaaatatacactatagcacacccctaacaggatacttgtttagacgttcttagacttggtcgccttggcttccttttggcatcctatggtaggatcctatgacttgattctttagaatcctctatggtaggaaacgttggtgacccttgaggccgtccttctctctctcatagcaattaagatcaactggtagatctttactagtggactcagatgggaaaacaggagttaagggcaggcaggatatttattcatataagcatgtcaaggaacttctttttctaatgattccacagagccctattttgaacaacagctgggagagaatcaagcaagctcttttaacaaggcaggctgcaagcattgccattccaggagacagtttagatgcaactattcactcatctctaaccatcacttgcgtgaacattactcaaagagatacagcaaccaaagaaatcaaaccagtaaaagaaaggtttatttgtttaatagaggtctggcagctgaggcaaaacctaacaataattctgatgaagactcagtcatttatttggagcttctaatgaatctaactaggtaccttatacaggcttgcgtgggttaaatcacagctgtaaagtgccatgctaacagatgagagagtatgtgattgtatcagagatactagggcatccaattatatttatcacctgcctcctattaaagcttttttctgttcttaacgtttgtgttggtagtggcaacatagaggttacagtgagctttgtcctaaagaacctggaaataactgaagtatgagtcagactttaggagatcagctcagaatggatcagagctcagaggaaccttgggacctcattcgtccaatgtcctaatacagatcaacgatcaaaacagtctatcaagggttcagcctaaacacaattaacatggagcaactcttgccattagtatatttagctctcgataaagcctgagaggttaatatgattctagacaaccattcataggcagagatatatcttcctagccaaaaagaaaaaatatagttcttaaagaagagtaggaaatggcttagaagtgatagttttatttccaattctcaattccctgtctcattttgctaaatgggtttaaggagcaacgatgacaatctgctacgatttgcatactcaagcaacactatgaatcactgcaagcatcctcttttgttgcttcattttagcttagtcaacgtccagacaatcagggtgtattgagcatcttctctgataaaagtattttgaagaaaaacaaaagaatggaatgttccttctctcccaagggacttaaaatgtactacctggcatacaagtatttacatcttaaaatgaaaagcagtgaataaaatcatagaccaaaactaatggtgaatttccagcctccagtaaagaatttttcttgaataaacaagtctattttatttcttttcgttctttttaattttaatagtacaggcgacagttaaaaataaaagagagagagaaaggaagagagaaaaaaatggattgattgattcaggtatccttcgtacctctgcccagagacaatgtccatcgtcagcttttaaaatgcatcctaagatgtgcatacaaaatagcatcctactgttttttacttaaaatatatctttacttaaaatacattccagatcactcctgttagcgttgctacatttttaaaatagctatgtactctcctattgtatgcattgctccaatttcttctatttctgctctacataattctcttgaaagaccaaaggctgggctcatctttttcgtcttgttatgcccaatgaattattttttcaatttttgaagtcaaataagtttaccgcaatatatatctgtattttgatctttatgtaaacattagtttggcactcacaatcaagcatgcaggccaggcgtggtggctcacgcctgtaatcccagcactttgggaggccgaggcgggcggatcacgtggtcaggagatcgagaccatcctggctaacatggtgaaaccctgtctctactaaaaatacaaaaaattagccgggcgtagtgatgggcgcctgtagtcccagctactcaggaggctgtggcaggagaatggtgtgaacccaggaggtggagcttgcagtcagccgagatcacgccactgcactccagcctgggcgataaaacgagactccatctcaaaaaaaaaaaaaaatcaagcatgcactttgaacaagccagggtgtaagcattgccatcccaggggatattttagctgtgacttttcactcgtctctaaccatcacttgtgcgtacattactcaaagagatacagcaacagaagaaatcaaaccagtagaagaaagatgcatttgtttagtagaggtctagtagctgaggcaaaacctaccaataattctgaaagagacttagtcatttatttgaaaccttttatgaatcttctggttctgtaaagttttactgagttgcatctttagtttttctccattttgttatttgattctcttcttcaggaatagcaaatatctgtttgtcgattcactttgtcttccatatttaccattgaaaaactcattttaactctttgctcatgttgtctttgttttgcccgctgttctcagtgccgtcacagcgatgcttcctgccatattttcaataatctttaatttcccttgggttatttccaaacaggactttatatttgatgttcgtatttttttcttctacttattgcctgagcttgatcagctcatgtttaatcttcttccattgcttcaccacatttttcatgacctcttatattcatggcttaagtttttgttttctggaaattattgctttctttaaaaaatgaacataagccagtattttaaacacagatattttgcattgggaagattttttagatgcacgttttctatctgccatttatttttgttttttctaatctattctacattacttccctgcaggacctgttctttgttctcctcaccctaccccaccactcaatttatcacttgtctttgcacgaagtgagttgtttcaggcgcagccattgttgttgttagtgaggttctttgcggtgcagagttgggtgaaggcagctacaggaggctcaagggcagatcctccttcaccacagagctcacaactatggcaatggctgtgtcctttctcattcacccaaacccactgagtatcccttttccaccagcccacacacctcaccactgctcccaacaatgggtggttgttttgcccctcctgttgcgccgctagcattgaagatctacgttctgttggctttgtctacgaactgccacgtggcgcatcctgactcggcatctctgcacacctccttttgacttctttcactgcacttgtccactcctgttcagacactgacatttaggatggcacacaccttctagttccactgaaaataaatcttatgtttcctgtttctaatctccttattttctggagaaaagaatggaagcaggatccctttactccaccataaaaggaacacatacccacaactattcatttggggacttccaaccatatacacaccttccccatagttaagtgccactttaagtggttccttcgccattgaagacaatgtgaaaggcagtgtgaaaggcagcaagatctcataaattcttcataacatatataatatatataatataacatataactttataatgtaacataatataattacatagtaatacactggagaacacggaaaagaattaggaaaaaagattttactcctttcagtatccaagagagctcacagagcatcattcaggactcagaaagaggggcagagctcagttacagtgaagaatgggttccccttgattttcctactgtttctatgttctttgagggaaagtaaagaacaaacgtattttgtgtaaacatgctcagtgttgaaattgtatgacaaaaatagtcttctaacaaagataataataacatctgctgagcacttagctatgtatcatgtacctatgtcctatatattttttgtattaaaactttattgtgacataaccatagattggcatgcagctataagatatgatacagagggagcatttgtactctagccaacctcttccaatgctaacatcttgcaaaagtatagtaaaatatcacaaccaggatgctgaaattggcatagtgaagagaatttttccattactacaaagatcccatttattgccttttttatcaccttactcaccttcctctacttcatcccctacatcagtcctaaaaaccactaatctgctttctgtttctataattttgaaatttcaggaattttacacaaatatagaattatatgatatgtaaacttctgagattagttttttcactcagcccaactttctagagattcacccaggctgctgtgtgtatcaacagtttatccctttttatagctagtggtattctatgggaaggaggtaccacagtgtatttaaccaatcccctgtggaagaacatcttaattctttccagtttggggttttttgtgggttgagttgtgcaccaagaatttacacggtgaagttctgattcccagtttctctgagagatcacctcagaacaagatcttacttggaaatagagttgttgcttgtatcattagttgagataatgtcatactgtagttgggtgggcctctaatccaatgtgactggtgtccatataaaaaggggaaatttggacacaggtgggcacacagggaaaatgtcatatgaaaatgaaggcagagatcatggtgatgcacctacaagccaaggaatgcccgtgattgccggatccctccagaggccagaagaggggaatggaacacattcttcctcatggcctgctgatacctcaatctcaggtttctagtctccaaaactatgaggcaatacatttctgttaattaagccacccagtctgctgtactttgtttaagtagttctagcaaatgaacacagaactactgccagtaaagctgccacacatttgtgtacaagtttttggtctttgttttttgagacagggtcttgctctgtcacgtagactgcagtgcagtggtgcaatcacagctcactgcagcctggacctcccatgctaaagcaatcctcctgcctcagcctcctgagtagctgggactacaggtgtacatcaccatgctcggctatttttgtttgtttgtttgatagagacaggatttcactgtgttgcccaggctggtctggaactcctgggctcaaggaatcttcctgcctcagcttcccaaagtgctgggagggattacaagcataagccactgcacctggcatgtgtgcaagactttttgtggatatatgtcttcagttctctgggctaaatgcctaaaggacaaaatgatagttgcaagtttacttttgtaagaaactgccaaactacagctgactcttgaaacacaaggtttttaactattcaggtccatttatatgcagattttttcaataaatatactacaaagtttgttagagatctgtgacaatttcaaagctcacagatgaaccacatagtctagaaatataaaaaaaaataagaaaaagttaggtatgccataaatgcataaaatatatgtagatactagtctactttaacacttactaccataaaatatacacaagtctattaaaaagttgaaatttatcaaaatttgcccacacaaacacttacagatggtacgtggcaccattttcagtcaaaagaaatgtaaacaaacttaaagatgcagtattaaattataattgcataaaatcaactgtactccatactgtactgctgtgataattttgtagccaccttctgttgctattgtggtgagctcaagtgttgtgagtatccacttaaaacgctctttgtccccacacagccagttcgtctctccagtaaattgcctatcacagcaaaaagtgatagtttctggttcttgggtatttttcatcatgtttagtgcaaaccgtaaacgctgaataacaccatgggacccacatgaaatatcactagtgatgccagaagtgctcccaagaagcagagaaaagtcatgtgagttgcttgatatgtaccatagattgaggcctgcagctgcagttgccaaccatttcaaacagacaattcatcttgtaaacagacaacataaacttaaggcattgatatatacagcatggcactgtaaatgtactttttcttaagattttcttagtaacatttccttttctctagcttactttatcataagaatataatatgtattatatatacaaaatatgctttaatcaactatttatgttatgaattgcattcaacttacatgtcagcttggcaagaattgacatcgttactatgttctcaaccaatccacgaacatggcatgtctctccatatatttagttaaacgttcaactacttatgttatcagtaaaacttctggtctattagtagttaagttttgtgagagtcaatagctgtactcatattttcttttgttttccctcaaggagtacatgtgcaagtctgttacatcgataaattatgtgtgctgaggtttggtgtacaaatgatcctgtcacccgagtagtgagcacagtaccctgtaagtaggttttcagtccttgtctctctcccatcctcctcccctaggagtccccagtgcccagtgtctatcattcccatctttatgcccatgcatacaccatgtttagctcccacttataaaggagaatatgcagtattttcttttctgttcctgtattaatttgcttaggataatggcctccagctgcatccatgttgctaaaaaagacaattgtaagtggtatgtatctttaattttggtgtcctcacattcattactataatatagaaataaaattgatttttggatgtgtatcttgggtttcttctttgggttccgtgaccttgctggactcattcgttagttctaagagtttttatgtatatttcttggaattttctacatagacaatcacgtcatctgcaaataaggatctcttcctttctgatcgaaatgtcctttctttttcttatcttattgcactggctaaaacctcaagcactctgttgaataaaagtggtaaggatagacatagttgccttgttcccaacattaggggaaaagcattcagtctttcaccattaataataatgctagctgtagggtttctgtaaatgtcctttattaagttgaagaagttcacttctattcctagtttcttgagagttttttatcataaatgggtgttaaattttgtcacatgcttcttttgtatagattgatagaatcacgagctttttcctctttagctttctaaacaactcctttgtttcctttaactaatatgtgtataaaatttcattttccatccttcacctcctatctgcttatcattatatttgaagtcggttctttatagaagtaatactgttgctttagtttttacattatatgtacataatttatgacaatctactagtgtcatcattttaccagtttgagtgaagtacagaaatcttacctcccttcatgtccttttatcctgtcctttttataaaaagctgtcttaaatatgtcctttatatatatttagagccacatcagacagtgctgtagtttttgcttcaactgtcaaacatatgtagaaaactcaagaggagaaggaaaggttattgtatttaacaatactttcacttactatagtctttgctcctttttcatgttccaaggttctgtcttctatcacttcctttctgtttagagaatttcattcagccattctcttacagcaggtctgctggcagtatattctattagttttcctccatttgagaatgtcttgattcctccttcattcctgaataatatttttgctggatatagtgttctgagttgtcaattcttttcttttagcacttaaaaaatgtgtcatttccttctggcttccaatgtttctgatgaaaaatctaatttttcccccagtaggtaagatgtcactttttaatgaaaatttttaagattttttctttaatattcataagtttaattatggtttgtttgacatcaatttctttgggtttcttctgtgtgaagttcactcagcttcttgaatctgtaggtttaagtcttttgccaaattcgtgaatttttcagtcattatttctttgagtgtttttctatccaacctctttattttcctccttacaggactctaatgacataaatgttagatctttaattgtagtcccacagatctctaagtcttcctatttaatttcagtctatttcctatttttcagattgggtaacttctattgttctatcttccagttcaccaattctttcctgtgccttcttcattccactgatgagccaatccactgagcttttctttggttattgtattttttagtccttagacttacatttggttcttttttgtaccttatatttctttgataagactttgtatttatttactgaggctttctattttctcatttgtttcaagtgtgtttgcattgcttattgaatcatttttttcatggctcctttaaaatctttgtcagataattttagcatctttgttaccttggtgttggcatctattgatggtcttttctcattctttttgagatctttcttgtcctccatataagtgattttcagttgaaacccagaatttttctggtcatatgttatgaaactttgaaacttatttgaaccttatgtattagttggcttttctaatacttctttggcagggaagagaagaggaaccaccccatgactaccagttggaggtagaagtctagttttgcaacatggcctccaatgccacctaggggtggggggagtgtttggcagggggggttgttctggttccctacctggtgttcaatgataccagagtggtgatgtcctccttaacctggcaataaagtcctgactctccactaagtaacaccccaggaacaatggtgaaagtcctgacttttctctgacaaggagagagaatggggcaccttgctactgtcaggtggagattcaagtccagctatccacatggtctctactgacattgtggtggaaagtgaaggaagtctcaatgccagtgacaggaacaaaagtcccagctccctacttggcctctctgacatcaccctagtgagagtgctggggaaccccattatagcttgtgaaggtagaagtctagcctccccactcagcctttgctgatatgggtgggagtgatgctacagttttttctgtagtgtttggctggagtaaagtggttattatccaaaagtttctgtctttctttgtttttttttgtttgtttgtttttgtttttgagatggagtctccctctgtcgcccaggctggagtgcagtggcacgatctcagctcagtgcaagctccgcctcccgggttcacatcattctcctgcctcagcctcccaagtagctgagactacaggcacccaccacaatgcccagctaattttttatatttttagtagagacggggtttcaccatatttgccaggatggtctcgatctcctgacttcgtgatccacccgcctcagcctcccaaagtgctgggattacaggtgtgagccaccgcgcccggccaagtatctgtctttctatgctgccctttttccagggctttgactagagagaccaggcttttgttggggacttgtcttgtctgtgcccattggcattgctgggttgtgggtttcttctactccaaatatgggatatgagtggaaaaaaacacagggaactcattagcatgttattcctcatgtcctgagtccccagctaatctgccttgttctcttcttctttcatggcctccctacatttgttttatgcaatatatacagttttttattgtaattagaggatctaatagaggacgctattcctactccatcttcttggaaacaagagtctgtcttagatattttacacttactcatttaattctcacaataaccttttaaagtagtattattaaggtctcaattttacatttgaggaaactgagttacagagaagttaagtagcttgtctatggtgacatgctaacagcagcaaagccaggtttcaaacccaagaagtcagcctccagagtcagtgctttcaaacagtatactagaactgttttcaagtaataaatgttcacaacgaagctcctcatttgtcttggttggtctctccctgcagggctggactcccgattattgtacaatagttgagagtgccctctgtggaacatagtcctcaggttacacgccccatcttttccccacttcttacccacaagtatatacctagttttaaaggtgcagggttataagcataaaaatgatcagtcatgatcaatcacatcccttatttttgaaaatccatcatgagtgcgcataataacctcaaaatgagagccatgaatgtaatcatcgtccctgtgtttattaatcacatccttttgaattcaacactttttattttctgccaacttcttgctgcattatctacaaggtaatcattctttcaagggatcttctttaagtctcttccattctctcagcctttagcccaagtcacctccatcactttcaataagacttcaccaattctgtaatgttctactacatcaaaagccacagaagcattgagatggaaagagcctttagggaccattttgctggtgataagagaactaagtgacttggacaatgttacactgcttcttcgtgacaaacctgagactagaaaactactacatatgacatcctacacactgactcccttcttcagctctgtctgataaagggatgagagatcgtttcttattattacacatacacgccacttccgttccttccatctaaacctagttcagaaacaccgctaagaattcccacccccaaaaaaatggggatgggggaagagaaggaagtgaacagtggtgtcatcccaccaacaagcctgactgcacaaactatctgcctgttccataacaaagagattatatcaaacctacctccccaggaatcagtctgattcaacctcggaactcctccttctcctttccatttggcccaaactagggtttttctctcaggtcttttgggctttctgaacaagtgccagcaccctgtggcttgctgctgccagcccaactatagtaattttccagaagtctctggttatgccacactgctcaaggaagaggaatatcattaaagtgacttcacagccccataaacatgccacttgcagccctcttattctgtctggtggcctacaccacacactacaatcaacaagggacatctagatttcagggccaaatccctgcaaagactctgtctgaacatacttttgtgaaagcctgcagaatatagatttctgtgtgtcataaggaaataatcggtccttaaatctcaaagtacaactagctgcagtatttaaaaagcccatggacaatgacaaatatagacatcacaaaattattctaaactgatcaatgctgagaaaagtcatgatgtgtcaggagtctcagctccaaaggcagtctgccctttaacataatgaacttcagtaaaagtagaaaccatttctgagggtgtaattgacaagtggcaatgaggtcatcagtagagtttatgacatttaaatccctgtgatatggtttggctgtgtccccacccaaatctcatcttgaattgtagctcccataattcccatgtgttgtgggagggacccagtgggaggtgattgaatcatggaggcgggtctttcctgtgctgttcttgtgatagtgaataagtctcacgagatctgatggttttataaagcggagttcccctacacaagctctctcttgcctgctgtcacttaagacgtgactttgctcctcctttgtcttctgccatgattatgaggcttccccagccatgtggaactgtgagtcaattaaacctctttcctttataaattacccagcctcaggtatgtctttattagcagtgtgaaaacagactaacacgccctggatctacttttcccggttttatttttttgtaacccacaagctgtcctgcctcgtgtaatggtcttaggcaaaggaagacctctctggttatccttaattctatagatacctacttcacacacacacattcaaacacacacatacacacacacacacacgacagagggacttctaagtaaatatcatatacattatgaggaatcaagatcttgcccttttctaaagcaaataactgtcaggcttgggcaaatgcaggggccatattttctaatgaaaaaataaaaatatatgacactggacaaattattgaaaatggaggtatacattataacttcccttactttagcttgctgacaggtaaccttgggctctgccacaaagtaattttcccatctggactaactggggatcagacagaagattctttttctttcaaggtgtcctagaaaattggggacaccttgtagcaaatcaattaacattttatttgatgtagaaccttacgacaaatagtgagaatttccacaacacaaaaattgtgaagtttttggcaatgcataagaaatgaacattggcagatatgtttcacgtggccaagaacttgatgtttcatcagccatgaggctggtagtgtctctattttacacacgtgaaacatgggctaagtgaggtaaagcaagttgcctgagatcacgtggcttgtgatgagaagattcaggattcgactccagctctgtgctactccagagcttccgttctttctcacatatctagttcaggctccttcatctccgagtgggtatggagaccaagtatgcctgttattgttcctcagagaaggatttctggaggacatgagtagtctgaagagttcagcaagtcctccaagttccacccaaatctgataaatgtgctgaagtacggggcgctgttactatacaacatggtgagtaaagggaaccttctctctgatccccagacaccccagatggaaaaaggtgctttgctgcagagcccacggttatctgtctggaagcaaaagtaagggaggccacaaggtctacttccattttcaaactgagggcgcctaacaattgcaatcctgtaaagaaataaattcatttctggaaagttggaaattgtcttcatcgtgccctgcccaaagcctctggtcaagaaattgaggacttgcagaataggactcctcctcaaactcaagcttttgtgttccatgttcaatgagagattctggccacagaaatgttccctacctgctccagcaggaactaagccttcctggaacatgattatcacaaggatccctcccagtgaccacattttctgacatcagcctaaaccaaaacgactcgcctgctcagtgattatataaatccattcagtctctgcaaatgcccaggcttttgttaccactactgctgttttggctgtacaaggcttaaaatgcaaagtaagtcacgatactaacctttgcctccagtaaggaatgctcttcttggagcagcccccatacctgggacaatgcaagtcagcctttcaatgagatgcttagcacacaagccttctgtgatccagctcctgcctctccatcatgcctcagtgtccaacactctctcttcttcagtcaattcaaactatttgtaggtccctaagcacagtttcccctctttctgccctgcagacctgctttatctagcaaatgcccactcattattcaaatttagtgcaattatccagtcatctgggaaactccccttgatccacaaccttgatttagtggtctcccctttgtgctccctgaatagcatgtccatgcttctccgatagtgctcaccacattttatagtaacagctgatgtatctacttgtgtgccccaaccaaaaatcaggttctacatatcttgaggaagttttctcattcaattttgtatgagaatttacggaacttccaattctataacatagttgttaaataaatgcttaacgaaaaggtacacttggttcactcaccaaacaaatatttacaaaggaactacaaggtatatttagaaagcacatgagttcctgagcactgatcctaagttgaagaaaccctcctcacctcaatctcttgggcacatgagaggtctcctcacagactctcaaacaattggtgcttgaagagaggtgggaagtggtacgagggaagatggagggagagcatgactgcctgctgctacctgagtgagaagaggaaagatggagatgagggcaagcagaagcatgtggtccacagcatcacctagtgcctagtgcggaagaggaaagtcttggttccatcactcattctagcttagagtgaatcttctgttgcaaactttcttattgctctaagacagagatcatcagaattgaggcaaaggctaaagcagtactacactttctatgtcagtatttttatatactggttagtggtatacatgcatgcaaatctccctttaaattcaaatgtcatgttagaaagtagggtttatatgtacaggtgtttgtaaatgagaagtttgtaatttagggagtacatatttaatagtgcctcacccagaactgctataggcaagatgatcaggaggaaaaacagcagcagctgatgccaaaatgtgtgattcagatgatttggaaattaagagacattccaaagaacgtgtgcatatttccttcagacatagtctactagctaacagattgaatttttaaaatatatgaataacttttctgacaaaagcttaccaaaatacagcaatgacttagaaatttagcatggttatatgtgatccgtttatctctcccatcatcccactatctcagagtacaaaataaaaatcattcgtttcatttttctttatgctaagtagaaaggaaattgtgtcctgttctcatttcaagttaggttgcttcttgattaaataagagaatgaactcgcctagaataataaatgatcctctcaactgcacgttaactgaacactctagcataaattaacaaagcagagagatcaggtggaagtatagctaaaagactaaaattagtttggcatgggtttggatattagttttgtcactctgtagctatgtaagtttggacaaattaccataaactctccaaatctcaattttctcaactgtcaacagagttgacagcaaatatctcatgaaatggcgagacagatttcaaacttgtcatttacaaacacctgtaaatacgaactctactttttaatatggcattacaacttacaagatttgtatgtatgtatgcaattaaccatgatacaatggcagcataaaatggcaccggtaaagtgtcaggcacacagcctattgcagagtgaacactcacattttgtttccacgtgccccacctcttttcttgatttaaaggatttctactgggcaaatgataagagaaacaagacacttttctgtccttaaggaacttagactggtaaagaggataaaataaacacagacaaagccaggcaggatatacattttgagagcagaatgaatccaggtgatataagaacacaaaggaggaagaccatgtgccaagttccctgaggacatcaggatcaacttcatgaagagaccattttaaatgggtctcagagaattggtagggaccttgtcaatgtgtggtttttatttcctaagtaagactcacagttacaatacacatgtaaacacaggagaagacagaagttaaggcagatgatactctggtttaaaaatccttagaggaattttcactggtcaccaacttttagagctacattgaggatgacaactagggtggaaaacagtatattgtccagatatactattaatataaaatggggcaatgttgcctactgaagggaaggtaggggcaagccttatctttccctttctggctcagagaattcccagctttttttttttttttttgcttttttgagatggagttttgctcttgttgcccaggctggagtgcagtggcatgatctcggctcactgaaacctctgtgtcccaggttcaagtgattctcctgcctcagcctcccgagtagctgagactacaggtgcctgccaccacgcccggctttttgtattttttgtagagacagggttttgccatgttgggcaggctggtctcgaactcctgacctcaggtgatccacccgcctcagcctcaaagtgctgggattacaggcgtgagccaccatgcccagccagaattcccaacattttaaccaaagcactaggagctttccatctgtagtacaatcaccgaacaagccagaaactgtgtcatggcctctttaatccatactattccttctacagagactaattcccttaaaaactaagagacagatgcagccttagcctcggcctacacagggtccagatcatccatatcactgtttccacctccatgtcttgtcctactggaaggtcttcagaggcggtaatatgcatggagctgtcgtctcctgtgacaacaataccttcttctggaatacctcctgaaggaccttcctgacgctgttttataactaacttattacatacttctacttacataagtaaaaatacactctaaataatgataaaaactatagtatagtaaatacataaaccagtaacatagtcattatcattattaagtattatgtactgtatgtaattgtatgtgctacacttttattcaactagcagcttagtgcaaaataaaaagagaggactcaaaggggatcatttaggaaataaactactcccgggaaagggacacaatctcaacaagcaatagggcggcttgtgtagtgtagtgggctttggagaagatccctggtagcagtggagattgggagttgtggttttcacgtacttagtcatttagtcaaccagagagacaaatagttgggataaaagaggatctcataaatccaacagaagagtacagaacacagagcttaggctgttcacagcaccacctcctaggaaaacactgtgagcactcaggttaacagtaggtagatctgtgcacaagccatttactctactatggccaagcagcctaatctgtcgtgaacattcctcttccccccaaaaataaagaggaaataaagagaagggagaaagggagggaagaaggaaaccatgagtcttaaaaagatagcacagaaacaattattctgaaaatgtagaggaaaagtatagctctttaaaattatttacgacacaaatcagaagagttcaaataaattacaatgcattcatatattttgcagatgttcactcatgttctcaaataccattaaacgcatcagaaaatttgtagaatgtaatatgaagtgaaaagagctgggtgcaaaagctgtatatatcaactttacaaaactttgcacatgcggtacatataaagtcatcaattgcttaacaacatttcagtcaacggtggactgcagatatgacaatggtttcatgagattataatggagctgaaaatttcctatcgcctagcaacactgtagcagtcataaagttgtagcacaatgcattactcattgttgtaaacaaacacactaagctgctagttgaaaaagtgtagcacatacaattacatacagtacataatacttactaatgataatgactatgttactggtttatgtatttactatactatactttttatcattatttagagtgtatttttacttacgtaagtagaagtatataataagttaattataaaacagcttcgggaagttccttcaggaggtattccagaaggcattgttgtcataggagatgacagctccatgcctattactgcctctgaagacctttgtggaggtggaaacagtgatatggatgatcctgaccctgtgtacgctgaggctaaggctgcatttgtgtcttagtttttaataaaaaaagtttttaaagtaaaaaaaattaaagcacaaaaaggcttatagaataagaatataaaaaagaaaatatttttgtaaagaagagtcaaaaagttaagaaatttaaaaatgctcatcatcactggtcattagagaaatgcacatcaaaaccacaatgagacaccgtctcacaccagttagaatggccatcattaaaaagtctggtaacaacagatgctggcaaggctgtggagaaataggaacacgtttacagtgttggtgggagtgtaaattagttcaaccattgtggaagacagtgtggcgattcctcaaggatctagaaccagaaataccatttgacccagcaatcccattgctggatatatacctaaaggatataaatcattctactataaagacacatgcacttgtatgtttattgcagcactatttaccatagcaaacacttggaagcaacccaaatccccatcggtgatagactggataaagaaaatgtggcacatacacaccatggaatactatgcagacataaaaaagaatgagttcatgtcctttgctgggacacggatgaagctggaagccatcattctcagcaaactaccacaggaacagaaaaccaaacaccacatgttctcactcataagtaggagttgaacaatgagaacacatggacacagggaggggaacatcacacactgggacctgtcgggggtggggggcaagaacaaatacctaatgcatgggggcttaaaacctagacgatgggttgacaggtgcagcaaaccaccatggcacatgtatacttatgtaacaaacctgcacattctgcacatgtatcccagaacttaaagtaaaataaaacatacaataaaataattttaaaaaatgtaaaagtcaaaagctacagtaagctaaggttaatttattattgaagaaaaggaaattttaaaaataaatttagtatcgcctaagtgcagggtttataaagtctaccctagggtacagtaatgtcctagaccttcacattcactcactactcactcactgactcacccagagcaactcccaggcctgcaagctccattcatggcaagtgccctatatgggtgtaccatttttttcctcttctataccatatttttactgtaccttttctatgtttggatacacaaatacttaccatggtgttacaactgcctatagtattcaagagagcaatacgcttccaggtttgtagcctaggagcaggctataccataaagtccaggtgtgtaggaggctacaccatctaggtttgtgtaagtacacgctatggtgttagtcaactaaagaaacaaatagtggtgagagaagagaaatcacctataggtgcacttctcagaacatactctggttttcagcaatgtatgactataaatcagcaaaaataaacggaggtgaaataatagttcctctaactgagtgatgtgattatgtaagaattttagttccttcctactatttttctattttcttccaacctttctgtgaagttactttcataatttaaaacttgtaatgttttattaaaaatagatatgtttgcggccgggtgcggtggctcacgcctgtaatcccagcactttgggaggccaaggcgggcggatcacaaggtcaggagttcaagaccagcctgacgaacatgatgaaaccccgtctctactaaaaaaaaaaatacaaaaattagccaggcatggtggtgcatgcctgaaatcccagctacttgggaggatgaggcaggagaatcatttgaacctgagaggtggaggttgcagtgagccgagatcgggcctctgcactccagcctgggtgacagagcaagactctgtctcaaaaaaagaagaaaaaaaaaagatatgtttacaaatatacagacattaataatggagtctgaggataagagccttcaaagcaaaggtgaaatgtcccaaaagacaagtcggtaagaaaacacaggccacgtcctaaaggcgttggagaactgggatgtgtgagagcaaagaaagggccttgaatgccatgtttaggggcagagattttcttctgtctgtagcacatattttgaattagaaagggctgttgttggagctgtctttctagagattccggagtcggcaaatggcatctaaaattaaatggattagaggtgagtggctattgtgatagtccaagtgtcaagcagtgtcagcctgactatgtggtctcagtgacaaaagagaggacatggtagatgtgagtgttgagtacaagactcagccaatggttgggtataaaccgcctgggagaagacaggactgaagaaggctttgaaggctagattctgggtgatgaatcagagatcaatattagtcacaaaagttggaggaagaatatgtgcagcttatttcgaacatgttgagcttaaagtgtccatggagtatcttgagaagattctgagaagttgcaacttaagagagaagcctgggctggtggtgtggatttgggaattatctgtatagacaggagaggtggtcagataataaaggaggagaccaggaaaggaagagcaggagagggaggaggaggaagaaggggaagaagggatgcacataagacagaaagagaagataggagaagataccagaggaccacactacagaaaagaagtagccgctgacacagccagaagcagcaaacagaaagaggagtgcatatttcaacactgcagagtaggaaacaaacaccaacaagagagtcacccttgatgtgaaatgttatgcaaagttcaaagaggctgcacactgacaagtcgctactggaaatagtgattaggcgctcaagtgacataaaaaaattttaagtaaaaaataagaaataaaatcaacatgtccaatgtcattgcaatagacactttcctgtgggaactaccattttaaaaacacatctggagtccaatatcctaagtgtcaagtcattcctcctttgtccacatggacggaagacgttcatctcttgagtgctaatggtttgaggccaccaccacagcaaccaacagagcaactgttgtactttaactctgcccagcactaactacattctagtctgtggcctgcatggaaatgaagttgttctttcagacactgctgtgtgggactcagtctggctgcaggtgcctgcaagcactgtctgatttgagatattttctataattactggaatgatgaaatctgtcatgcagtaaggtagcaggcaggagacacaaattcattcctagcttcctgaattaaaaataaatggttatcaagtccaattgaatttgttttaattagctgggttttttttttttaagtcacaattttcgcagctcctttatcaaactgactcttccttaatactaaagaggaaacttttcacacctaaaatattcctgtaaagacaaacttgctgggtcttgttcatgtccctgttggcccctaagtatattttacttatttgtctcatccattgcctcatgtctttccaatgtgaactccataaagaaagtgatttttgtgcatgtaatgaactgctgtatccccagaacttaaatcagggtctggcccatagaatgagctcaatggatgctggtggaatgaatttatggaagaatggatggaaagaaaacatacattataagaataaatcctcagaaggatagcagcaccattacagaatcaggtgaaggtgagtagactgaatatgaagaagatatgatgagtgtcccacctatgtggggagaagatgtgaattgctgtaatgagatataggaatataattaattggctttctttatatccagattggatgcagctttgattcttcagcattactgtaaggggatggggcggggaaaatccataataagctctgtgatcctacaaatttcatttcagaaagttagaaatttattaagcaaataagacaggccatgtcaccagcggatcggcatcaggcaaaaacccaacagtgtaattggccaatgctcggaagaatgacataacgaagcttggggttgccatgagatctacatgaaaacaatttctgtgctgaaccataggtagctcttgagtttataaaccctcaagtctcccattaatccagtcttcaataactggatgatttaagtagttacagtattttttaaaatcttaatcctgagagctaagtattcaatcgttttctaaagaaacgcagcaaagaaagtaaaatcaaacaacctgcctcaaaatggcagcatgtccacacactggcttcggtctgaaggcaccaaatgacctgggcatcctctagtatgttgcaaagtttaatcaccactagatcgaaactaaataccagaacacaggtgtgcatcattcaaattggcaaatcaatatattaatactttttttaaaagtcagtgagaaaaccaccaaaatcatttattaaagggaactcaagtggcacaggaagatcttcaagccaagtcccattcatttcccattaaatctgctacaagaaccttaaactgctcccctcaaagaaaaagttagttggacagtgaccagtgagatacaaaagaagaatcacaacgcccaactactaaaacccaggatggttttttaaaaaatgaatcccttgattgagggtcaccagagaagacagatattaactaatcacagaaagaattaattagaagctaggaggagaccagtattccaagccaaagtagtaatctgtgtgaagactttgctggaacttgtattatgtctgaaagattgaaataaagtgccttaatccaaactgggattttcctgactgacatctactagttcttcaggtccccagcctacacataaccacttcaggaagcccttctctactttatcttttcaactaaatcacgccttctgacactacattccctgacgacaccttctaccattgcttcattgaactaaaagaattatctgtaccctcgggtatgattatagagatgcttagtctaaatgcaaaccaagatacaactttagagaaaattctggagcctacagagtagaccagagaagcatctcacaatgaatcctccccaaataagtcttattctttctatatatgtcaagcattaagtaaacacttgagcagcacaagtcacaggcgatccatgctggccattaatcggcagtggcaatatcagtaaagtcaacgctcttccagcatctcctggactaagatcagtgtccagtgtttttattttatttttttccacagtattttgactatctcaagataagcttctagagaaaaaaaatacaaaaacaaatgtaacaaggtcaattgagctgcgcgtgctatgtctggaaacacatgtgccgtcacataatttagcacctaaagaacaagaggctgcaaaactgcatccccagggaagcccagagctggcaaagtaatctctgcagacatgaggaactctgctcacccactttaattttaacgctactatgtacaagcttaaatatagaatcaatcacaaagaaataatacatatttaagcagacacagggctaacgaatctgagccagtacaattctgaaaactttcaagtttccctttctcactctgacatttctaggcttgctaatagtcctcacaatgtccaggaagatccgtgtttccattattccctcctgttatcatacactgaccatatcttgtgtgcctcctagatgattcatacattttcttagctctaaaaatactacagttttagtgctagaataaatgtagagaacttagaagtaaaaaaatgttttgaaggtgagataggaaaaagccaactatcttgaacaattcaaaagactttcttagcaaatctcatttctgagagctttgtatagaaatttcatcatcagctttggctgctatggcaactagatatttcagaaatgatttgaaatgagtatcactacatatccagcatcttttgcaagaaacagaaaagactatgaaatctaatccactgtaaatttcaaaatatagtgttaattttcatttttgaaatctatttatgcttctatttgcaaatcaatagataacaacctggtacgattacatatgagcacgatggagaagtctttcattttagtccttaactgtcacattaaagcatcatttaggtactctcgtcccagttttattaggcctttaaaaaaaaaaaaaggctgggcacagttgctcatgtctgtaatcctttgggaggtcatggtgggaagactgcttgagtccaggagcctaggtaacacacagatacctcgtttctccaaaaaaaaaaaaaaaaaaaaaaagtaaaaattagccaggagtgatggtacacacttgtaataccagccactcgggaggctggggtgggaagatcgcctgaacccaggttttcaaagttgcagtgagccgtgatcacgccactgcactccaacctgggtgatagagcaagaccatgtctcaaaaaaaaaaagacaattttttgggcagttttaggttcacagcaaaattaagtggaaagtacagtttccatataatccttgtcccctccccaacctaccccactatcaacaccctgcatctaagtggtacatttattacaatcaacaaacctacatcgctacatcataatcacccgaagttcatagtttacgctagggttcactcttggtgttatatattctatgggtttggacaaatttataatgacatatatccaccattagggtatcaaatatcaaaaatcaaatcctgtgttccatctatttatccctcccactcttcttaagccttagcaaccactaatcttttcaccatctccatagttttgccttttccagaatgtcaaatagttggaatcacatagtatgtagacttttcagatagacttctttcacttagcatgcatttaaggttcttccacgtctttccatagcttgacagctcatttcattttagcattgaataatattccattgtctggaggtaccacagtttatctattcacccactaaaagacattttggttacttccaagttttagcaattatgaacaaagctgctataaacacttgtgcacaggtttttgtgtggacatgtttccagctcatgtgggttataccaaggattgtaatgtcttgactgtacagtaagagtatgtttacttttgtaagaaactgccaagttttcttccaaagtggctgtaccattttgcatttccaccaacaatgaatgagagttactgttactctacattcttgccaacattcagcgttgtcagtgttttggagtttggccattctaataggtgttaatggtatttcattgttagtttaatttgtaattccctagtgagatatatgtcaagcaccttttcatattcttatttgccaggcctttccttttagccatatctatgccaaagcccaagtcccactgaatcttgcacaacagaataaaaacaaggtcttcaatgatgagttagttgtgatttgatttaatcaatgaaccagccatggttttcacattctaccctgcagagctactattcctgggtcactgaaatagctcatagcaaatacatgctagagcaaagaaagctgtgtggaaatgtaaagtaatgcaatgactggataatttaatcagcatttacacccatgcaccttaactacatatatgtaaaagcatcaaacgagttctcaaattccctgcttaggtcatgacactgaggggttcaaatagaatcatcagtgtttgcttgaaagtccacaaagtaaggagatttattcttgattgaagttttcacagcatgttaccctgaatatttagggatgatggttaagggttatggaggtcaagatgaactggtagagagagcagcatgttaagttgtgtaagtgtttgctgaaggacaatggggaaatggagtgagagacattctgcaagtgtgccacaattcaaaagaaccagcatcctcattaaaaattgtgaatttattaaaataatggcaaagttattttggaagtaaactgatctaactataattctttttcctcttgaaacttatcaattttaagatacttacaatagtgtaatctcttaaaagttttctacctctgcacttaagtgtagaaacaagcttatgctgaccttttgaatagaatctaaagcaatgtgcattacctttatcaattctaaaaggcatttccaacagctcagtcttccaaaaatatactttaaatgtagtagttagtgcaaatgatatatcagaagtatcgagtaaagaagaaaaatactatgacattcatagatgtcaaatatgttagaaaatcatcagcactgtggatcaggagttctgggccagagctgtgggcagaatgggacattaaatggggcccttattaggaagttgacatctgagcaaagacttgaagaaagtgaggaagtaatattcatggtttatctgggggaaagtattctgagcagagacagcagccagcgtagaggccctgaggtgagagcaggcctagcacattgcaggaacagcaggagggtgagtggaacaaagtgaagggggaggatcagctgcaggcatcttaaaactttggcttcggccggccgggcgcggtggcttacgcctgtaatcccagcactttgggaggccgaggtgggtggatcatgaggtcaggagatcgagaccatcctgggtaacacagtgaaaccccgtttctactaaaaatacaaaaaattagccaggcatggttgcaggcgcctgtagtcccagctacttgggaggctgaggcaggagaatggcctgaacccgggaggcggagcttgcagtgagccaagatcacgccactgcactccagcctgggcaacagagcgagactctgtctcaaaacaaacaaacaaacaaacaaaaaactttggcttctactcagatagggagcaccttgggaattttcagtaaaacaaattactttgaaaaatttttcttatcatacaaaattttaaacatgagcaaagtagagaaaaatgatagtatactctagtgtacgtatgattcagtctcaaaattactgattcatggtcattactgtttcatttacactctctaccctaccctcaccccaaatcattttgaagaaatcttctgacgtcatgtcttttcaaccataagtatttcagtagggatctctaaaagacaggcattcttttctttctttctttctttcttttttaacaccactgtaatactattatcacgtccggtagcggttaaatcagctcatacctgctcagccaaagagaaactgtgtatgccactcttcccactcacggacccatgacttcatgaacgtggcttgaaattaaccatgaagggagtgtatacaccatgaaaatccacaaatactaacagcagggcttttatttctagtaataaaattgttaattctttactatctgatatggtttggatttgcgtccctgcccaaagttcatgtcaaattgtaatccccagtgttgtaaaaggagcctggtgggaggtgattggtccatgggggtggatttcccccttgctgttcttgtgataatgagtgagtccccatgaaatctggtagtttaaaaatgtgcagcacctcccactgctctctcttcctccttctccagccatgtaagatgtgcctgctcctccttccccttcggccatgattgtaagtttcctgaggcctccctagccatacttcctgtatagtctgcagaactgtgagtcaattaaacctctttttctaggtgaattacccagtctcaagtagttctttacagcactgcaagaatggactaatgcaccatcacacctctgactcacacgtagaagattaacaatgcttacttaataccattagatgtctactctacacaatggtcatatttctttggtaaacctttttttcagtttgtatgtctgaatagtgatcaaaataaaatctatactctgtgactgtttgatatcccttaaatctctttgaatccataggatccccaacatctctcttttttctggcatttgtttttattgttgttaagggaactgggttgtttgccctgtggagttcttcacagtctgcaattgctaattgtatgcctatggtttcatttaacatgttcctctgtttcctataaattggtcattagatttagtggcttgctaagatgcaggatttattttggggggcaagacttcttcataggtgcaggtggtgcacgtccatcagaaggaactgtcatgctggttgtgtttcatttttgtagtaataatagcctactgatgattctttcaaaatgataatattttgcattctatcacttattcttcatttactattttaaatacatctataagagaaatttatattaatcaatcatttggctaatttacactttattttattaattttttgagagatgagattttgctacgttgcccagcccgggctcaaacttctgagcttaagtcattctctattctccctggctcagactcccgagtaactaggactacaagcctgtgcctaatttatattttaacaggatcactctgattgctgtggtagaaaagactctagaggcaagttcgcaagtgtgaaaatagagaaataatctaggagggtgttatggctacctgggagagccatggtcacggctaaaaccagagtataactctggaagtagagagaagcaagtagggaagtccaaggactgagttgacgcacagccaacagcagttgtgagtgtactggagttatagatttttccacttgcaagtggctcagtaggttcctgatggttaataggttttatcatagctgagatgggaatttgggctctgggtgctacagctgggtataaaagcaaatcactcagcaggagggtgaggtaggggccgggagcgggtgttgtgaagagaactgatcatacaggtttcttgtcttaacaaagctctgagttatatacttaatgctaaataggcagttagtttaaaattccagttatgtacttttgaaagacagcagtggacattaatgatagttactgcgctggcttaaaaataaagaaaaagtaaagaagtctaagaaaaaatatatttgcacatatgtgatgtttgaggaagtcatgagattatcatgttaaagacctacttaacacattttcatcagcactctattattgcctatatttaggttgttcatgattaaatcacaattactaattgtagtaattataatctgttgtaaccctctcttgagctgtcaaaaaaagctgttgtattatttaacaacctaatttgacaagaaacttcagctactatattatttcaaggttttaaaattttcagaccatctgtttttaaatggtacatgcttcatttctttgaagacatctcatattttctcaggtagattcttttacgagtttttaactgctttcactggctaatttccgttcccaagtttttatgaaataatttacaaatgtattttcttttccagtgcttctaacgccactgattagttttctctaacttttgaatagaaaacaagtcgatggagaaacacattcagaaaaacacaaattctgaactccacatcatattgaatctccagtttctagatggagtttaatgtcgtcggtcacccatgccctcgtgggttcaggcatcagcgacgccactgttgctaataagcatgtcagcttcttagggaagggatgcagagaatcggaggacacgtttcccctgagacacttataaaaagaagagcataatcttacagctgggtgggccatgaaggttttccaacaaactactcttcccatcttttttttttttttttctgcaaaggttttcttatgcaagggggaaggggctcagtccctggcagctgctttcctcagggcggggccgggacattgcacaggctctctcactttctcttgggggggaagtgtgccccccacccttttcctgatgaacttgagggcctgtttgtcctgggagagcttgagcaactccacagcacaccgctctatgggacaaagccacacacctctcggggcatgtcttgcgcgattttggtgtttgctgaggcgcccgcttggctgtgccttggtttcctcacgttcttggtcaccttgtggcctttgttgaggcccacggccatggggtagtgcaggaccatggctgttgctctccgagggccgccgcagaggacccaccttctcttttgtagaaggaaaaaggtgtagaaaggggaagtgactttctctaaagtagagagtagccagtagacatgaatttggaaaggtttatgggggctgaagcatggaattcacatcagaataacgagaagagaggttaatggttaatatattttccaagaaaccatgagtagctatattctttctctcatctctttttcacacacacacacacacacactcacacacgtccacacacattcacacaccctcccatgcacaaatacacacacaggtccacacaacacaagcacacactactacacaccctcacacacataagcacacatgtccacacacatacacacacacccttacacacataccctcacatgtacatatatacccatgtccacacccttacacacatcctcacatgtacatatacacacatgtccacacacacgcacacacccttacacccttacacacaccctcacatgcacacacgtccatacaccctttacacacacccccacacaggcacatatgcacacgtccactcacacacacacgcacacattgttacacaaacaccctcacatggccatgtacacacgtccacacacatgcacacacccttacacacatacacatatgtccacacacgtacaaacccttacacacacaccttcacaggcatatatacgcacatgtccacacacatgcacgtaccctttcacacacaaatacatgtccacccaacacatgcacacactcttacacacacatacacccttatacacataccctcacacacttatgcacacgtccccacactcgcacacatacgcacacacctttacacacacatcctcacacatgaacacaccctcctgtgtgcacacacatacacacatctatccactcacatacacacaacaccctagatgcctagtttggaacagaagcggttaactggcaaaacatgttatgtgaatggcgtcccagtattttctttcaaatcacactaacaaccaggtaatgagatagtttgcaagggagaaagagtgtaaaaatgaaagaaaagtacttgcaggcaaatcagtatttgttcacctgttgaatgtgttttgtttgaatagatttttattgaaagattctattgtatttcccatggtttagatatttttccagcttttgtataaatatgaccatacaaaatgctcttgttcccgcccaatctctatttgcaatttactgaatgagtcatttacagagaggatcctgagaccatctaaaatactatgagtgggccctgaaaatgctctctttctactccctcctaatgaatttaagtgtttgaagaaaaacttactaaattcatgcgcctattaatagttccacaatgaagaagaatctaacaggagttcaatgtaaccactgtcatggcagagaaataacaaatgcatattatattttttaaaatcaggcttttttgagtgcatcaattatcctggtacttcccacttagtaaaagcagtgagtaggccctttaaatctatttattaattcactgagcgatctcaacaaactgttaaaaaagctttaggtattcattcaaaccaactaaaatacacaggtatcctttagaaaattaaaatctaggtaaagagaagataaaaagaggatactgattattgatcacccattctacgacgggccttttaataggccctatttataaatcaggtcaacacacgaacgtctccaccattaaatagaaatttgacaggagtaagagcattgtttctctgatgtatcgcccagcacctgcagtatctgacacacaacagatgctaagtcaatacttttgaatgaatgactgaatgaatgaatgaatgaatgagatgtcttcccagagaagtggttagtcccaagctccataacattgggtgggtgtcctcagccaaagtcacatcgcctcagggtacagaaatagaagacaataaggaaatgtgtttaatgaggatttcggtcatgtgttgatactcagctcttcacctcactccatcgactgacttcattcttatgattttatacttaaaatgtttgtgcatttggatgcaaacagccttaccaaggggaaattaggtataactctggagacaatgatctttattcttttttaagggcccgtttcaggcaatgatgccaggctttgctgttgctagggagatagagagaatgtggggggaatgagggggacattgagtgttttctttagcctgcaggccagggcacagtgaccagaatggagaaatagggccagcctgttctctcaatcaaatcccgtacagtccattgagaatagaagtagtcatgattacgttttggtatttagcctagaaccaccaaaaatatcagcctaaaacaattctattccaaatactgccatgttatttaagttgtcaattgttaggaagcatgggggcaattttgtgttttgacacggatatggattaagcacctgggagaagcatctgctctgcaaggtgacagcaacaagcctgacagagaaccagagcaaacagtcttttatcagctggtctattacctgagagacccagagaagactgtgcccagctgtgtgaatacttcagcaggcttgggctagacagctgctgagtgttcttcgcagtttctgtcatggcctggatacaagtgctcttaatctagtagattttaccatgagtctggctgctttttccagcacgctctccaggcctgttcattgattcatgctgcaagtacttacagtgagtctactgtgcggggggccctcttagcttaatatacacagaaaagacacttggttcagcaaagaaaagaaaggaggattcattaatagaaagccagctaatgcacagtttttccccccaaaatgtttgaattttttaaaaaattgcaggaactcacttcttagcacatcaggtctcccttgtctttttgccctctgtcatcttctctaaaccgaggacagcgatcagctacgtgagagtggtattcatgagtgaacacatggccaaaagaggaacacacaaactggtcatggtattttctttgcatctctcacaataacctctcctttaattttcaaggaatgcaagtcatctttagaaaatgacaagaataagtccaggcgcggtggctcacacctgtaatcccagcactttgggaggccgaggtgggtggatcacctgaggtcaggagttcgagaccaatctggtcaatgtggtgaaaccctgtctctactaaaaatacaaaattagccgggcgtggtggcaggcgcttgtaatcccagctacccgggaggctgaggcatgagaattgcttgaacccgggaggcagaggtagcagtgagcagagatcacaccattgcactccagcctgggcaacaagagcgaaactccaactcaaaaaaaaaaaaaaaaaaggaaaaagaaaaagaaaatgacaagaataaacaacataaggtgtctatgagaaacagaaatcacccaattgccctggccatattgtaggctgctgtaaagaaagttcactaccaaaagaaattcttcaagtgccgtggcatctggtgttaagattccaggcatctgacatttgccactcgacaggaaagatatagacaataaagtcatcctttaaggtgttactagaatgctctgtgtaaacttggtagaatgtaaaggtctgaggaacattgtgttataatgttatactttgcagtaccttttcctgtaaaggagtcctggtttactgaaaatttaggaaaggaatgcagattgtgacatttgcttctctggcataggaggcaaggcaaaatgcaaatgttagaattaatctcactttacagcattgcacttaacacacgcgttgaagtagcacagattcaagaatcaccatgattgccttcgttcaacagcttatgacacagtgcccagattccttttaatttcatgtaaaagaatcaatgtgtcaaactggcagagtatcctgaataaccctagtgagtggcattggaacactatggtcggtgctattcacaagacagcattccagagcaggataagaaatgtgtcagctcaaaaacgacattaatcctgtttcgtaagcaatattccattacaataaggtatactgcccaggaagacaacatgtttgctacttctagatgtctaaaaggtcattttctccagtcaaactttcattacaagaagacaataaaccaatatttgtggtcatctttctctttatgaaaaaaagtcaagaacttgagaaattgactgaagtagcaccctgtcttctaatgtagtcaagtctaccatgttctgttacgtacatttatctcaggaaacagtgtatatgaagacctagagacgaaggtgtgagagtgtgtgtgtgtgtatgagtgtgcgtgtgagtgtgtttgtgtgtctgtgtgtgtgagagtgtatgtgtgtctgtgtgtgtgagtgtgtgtgtgtgagagtgtgtgtgtctgtgtgtctgtgtgtgagtgagcgtgtgtggtgagacagaggaagaaaatatatgcaacacaagaagacaggactatgtctttttttttttttttaaacaatgtactgcccacgacagtcacggaagtgatgaaaatccagaacaatatgatgggtatcataaaattaccagggagtcaatgactgcccatgtaaaggagcttatagcagtgactgatgagtgaatcattctcagccttaaatgcttctcttacccaattcagaactgtcctacttcctgttaaatgtgttgttaaccagcaatttttaaattcttaatttaagatccttgccttgctttttaaaattcactattcaatcaaaggggttcacttggctatcaggaatatttttccccaaagaaggctacacaatgcacatttgcaagacagtggtcaaagaaattagccaggatcctttcatctcgatccctggagttggtggaatgcaatggaagacagaggactggatctgactatggttctgacacggactaatttttgaccaacaaggttttcatcttttgtcatcttttgattcctcgcttataaaatatcttcctcaaagcagttataaaaatttaaaatgagataaaactgaaactataggttgaaaagcataagacaattaaaagtattgctactgttagatattttgttagcaccttttgaaaacacaatttgtttttctataacaacttaggcattcctgaaaatcacacaccacagaaaattgagcaataaaaaccacagagcttaagagaaaagaaacagggtgcaacgctctaaaaattttatctgtgccacataaaaaacaaagataggaacctaataaaaacggcagcacagtgtttcactagttaattggctaagaaatacatacatactacaatagttttgtattttcaagacaatacattgtttctatcctgacaaagacctgaaagttggctcatggaagtgagcaccggaagagctaaagcttgtgagttattggaaagtggtagaaagaggattgtctgaagctggagagctgtcatgccagtaggaggtgttatgctcatatccaaggcctgaactgtgaggtagctggtagatgtttgagaaatgggcgttttatatatttctatagggctcaattcagctgggtgcagtttttttcattcactcacaaatgaaactatgcataaacaatcacgaaattcacattgcatgagaattgctccctaagatatcaattgtgttggaacaaatttgtgttttcaaatgagcattatagcagaactgactgtatcatgatatgtgtccccaaattggaaaacaaaaccccaaaataattacatgaaaatcaactggttctctttgttcctgctacttaaaaggagtatatacacggaagaaacacctcagcgcagctctgagcttctctccttttatcagcaaatagatgaacatttgatggtttgaaaaatcaatgacttcagacatgaatttcatcacacctctgtcttcctcagcatattatttgaacctcacaaaggacatttgattaggaaattaagatcaataaccagtagattaccaaatacagggagattttactttcattctccaatcattcatcagattttcatttccaatcttgattcactcagtaaatatttattgcacatttgtaatgtgtcaggccccattctaggcactggagatgcactggtgaacaaaacacaaaaaggtcactgtcttcacgcaacttacattctagtgagagaaacagactacaaacaatggcacattgatacatatacaggccttgtgcttgctttaatgcactttgtagatattgcattttttataaactgaaagtttgtgacaactccgcactgagcaaggccatcagtgccattttcccaacaacaggtgctcactctgtgtctctgtgtcaaattttggtaattcttcccacagtgtttcaaacttgtttgcattattatgatatctgtgatggtgatctgtgatcagtgatctttgatgttactattgtaattgttttagggtaccaaaacccacacccctttaaaatggtgaacttcatccatgaatgttgtatgtgttctgactgctccaccaaccagccgttgccctgtgtctctcccactcctcgggcccctctattccctgagacacaacaacattaaatttaggccaattaataatgctaccatggcctctaagtgttaagtaaaaggaagagtcacacatttctcacttggaatcaaaagccagaagcatgaagcttcatgagagaggcatgtagaaagctaagataagccaaacagtcagccaagttgcaaacgcaaaggaaaagttattgaagaaaattaaaagtgctactccagtgaacacacgaatgataagagagtgaaacggccttattgctgatatggagaaagtttttgtggtctggatagatgatcaaacccgccacaacattctcataagccaaaccctaatccagaacaaggccctaactctcttcaatcctatgaaggctgagaggtgaggaagtcacaggagaaaatttgatagctagcagaggttggttcatgaggtttaaggaaagaagccatctccgtaacataaaagtacaaagtgaagcagcaaatgctgatgaagaagctgcagtaagttttccaaaagatctagccaagagaattgatgaaggtagttacactaaataatagattttccttgtagatgaaacagccttctgttggaaaaagatgccatttaggactttcatagctagagaggagatgtcattgcctggcttcaaagcttcaaaggacaggctgactctcttggtagaggctaatgccgctggtgactttaagtttatgccaatgctcattgaccattccaaaaatcctaggactcttaagaattatgctaaatccactctgcctgtgctctatcaatggagcaacaaggcccaggcaatgctcacagtcacccaagagctctgatgaagatctatgaaaagattaacgttgttttcatgctaacacaacatctattctgcagcccatggatcgaggagtagtttctactttaagtcttacaagttaaaaacaaaatacattttgtaagtctatacctagacagatgtataataacatctatccatgtagatagtgatttctctgatggatctagcaaaaaaaattgaaaaccttctggaaaggattcaccattctagatgtcattaagaactttcataattcataggaagaggtcaaaataacaatattaacagaagtttgcatgaagttgattccaaccctcatgggtgacttaaaggagttcaagccttcagcggtggaagtcactgcagatgtggtagaaatagcaagagaacttggattttaagtggaggctgaagatgtgactaaattgttgtaatctcatgaaaaaacttgaacagatgaggacttgcttcttatgaatgtgcaaaaaaaagtggttttttgagatggaatctactcctagtgaagacgctatgaacatttttgaaatgacaagaaaggatttaaaatattacataagcatagttaataaagcgtagtagggcctgacagaattgacttcaatcttcgaagtccttctgtggataaaatgctctcaaacagcataacatgcaatggagaaatctttcgtgaaagaaagagtcaatcaatgcggctcacttcactgtcgtttatttgaagaaattgccacagccactccaaccttcagcaactaccaccctcatcagtcaacagccatcaacattgaggcaagatcctccccaaggaaaaagatttgctgaaggcacagacaattgtgaacaatttttagcaataaagaatttctaagttaaggtatgtaccttgtttttttagccataatgttctttgacacttattagactacagtgtggtataaacttaacttttatatgcactcagaaaccaaagaatttgtgtggctcgctttattgtcatattcatttatcaaggtgatctggaaccaaacctgcaatatatccaagctatgcctataatacataaattatatataatgttagaaagtaataaatgttatgaacaaaagtagagcgcagtgggaatcagaaatatataaattccctttcttgcaggggatttggtaaaagaagtagagctgtggtcgggcccagacaccatcggaatttgtaggccaaaggaaggggaattcactgataattttgtgtaggctgtagcatgagctaactcaaatgtttaaaagattattttcactgtactgtagggaatagatagaaggtaggaactatgagagccacttgggagccctttgcaatagtctgtgcaaaaactgatagtagtagcagtagaaatggtttaaagtgagtagagtcaagatatattttaaagttagagcccggggaacttattgatgttgaagacagagtaagaaaaaggatggcatcaagaatagcttcaaggtgttttattcaaacaatgaaacagtagaagctttttttttttcttcttcttctttttttttttttttttttttttttttgagatgcagaaaatggcaagaactgacttggggctgagggagagaggagtgccagaaatcaagacagtcttaataacagccaaagatcaacctaagaatgaaaagggaagcttcagcttgaattatttgaagttgaatagtggtcagtttttgttttttgtaattaaagtggacctcctacaccttgcatcttccccagccgtgctctcctgtcaacaactgtctgatatctgataatagctaatccctatagccttgcaatttcagaatagggggaaaatacatttaaaaaatttgatgattaaaaaaagatagtgataaccaagccactttcttgtggtactaaacatttgaatgtagtctctaatgttattactttttactaattttagctaaatacattccataaaaccaacaactcccacttactgattttcctgctccaagttctaacaatttttgtgaagtctctgggatcttctacatataaggtcatgtcatctgtgaaaagagagaattttactccttgttttctgatttggatgcatcgtatttccttttctagcctaactgccctggctaggacttctagtgctatgctgaatagaagtgtcaacagtaggcatcctcgtctttttttctgatcttagagaaaaagctttcagttttttaccattgagtgtgatgtcagctgtgcccttttcatatacagccttcattatgttgaagtaaattctttctacacatatattattaggcatttttatcaataaaggttgttacattttgtaaaatgctttctctgtatcttttgagatgactgtgtgatttttttccttcatttgttgatatactgaatcacattaattgatctgcacgtggtacagaagtagaaaaacaaacttagtttctcctactctactttcataacatgcttctgacactcattgcggggggttcttccccacacatcaagcaagcaatcaattcttgagcagacactagctgtcctccagtacagtcctgccactatctacctagagatagtgtttccatgccctctgcaggcatgccaccctccaggaacctccaagtgttcacctctctctgaacccaggttttgggggtttggggagagtgctgttacacagtcatgattgactaaatcaccggccactgaagaccagctcaacctttagcccttctcctctccctggaggtgggggagcaaggatggggctgaaagtccctaccttctaatcatgccttggtctttccagtgaccagtccccacatcctgaagctacatagggtagccagtaatcagtcaactcattagcataaagagatacttaatactttggagattcccggatttgaggagctgtattcaggagactgatggaagaccaaatgtaagtatttcacaataccaaacatgtggtgaggcattcttgcatcccaacgacaaatcccacttggtcctggtgtatgatccttttaatgacctggtgaagacggtttactagtattgttttgagaatttttgcatccatatttatcatagatattggcctgtagttttctttttttgttatatctttatctagtttttgtattgggttaatgctggcctcataaactgagtttagaagtgtccccttttcttcaatttttcagaagatgaatgtcaaaattccatttgtttatcaatgatgtgagccacttttttgttgctgaatcagatcatttaatagttttcagatacagaataatatatgtgtttactattatgtaaagtaatatgtaatagtgaaaggcattaatgcacttttaagtttatatttgcaatgttaacattttctccatcactttctgaagtcttgacagctaataaaataatcaatcaagcactgatttgtagtgtttgctgatttccctggggtaaatacaaacaaaagtatttgcacgtttggaagctgatttcaagcttccaatgtttgatatggagcccagagatgggaagaaatgagcagtttatttacaagatgtaaacaacctcaaaagcacagataattgtaaatggagtaaaaaactagaaagttacaagttttgagtattgcttccatttaatataatttaatgaactataagtttatataattgaatagttaatatatactgtttaacagccaacatgtgaattcctgagaatttagcaattggctcctgtgaaatactacaagccagctccagcacaccattgtagcttggtctccagaaaacaacttgttagaattatttggagccaaatatggggaaaggaccttacccttactttctgcattcctcttttcttacgtctccctatgtgcacaaaggaagctactgtcaactcttcagctgaatcaaaccccaaatcctgaggcaggcttctcaaggtctcactgagaacccatggcaatcaggactccactcccagccacccgggattccagtaatgaatttggggaggaaagatcatcagtggttatctgcacatcaaaagtatgcaccctttgaaaatatcatggaataaacatctctgttgctgacatcattagatgtatctttttggattatcaaggtttcagacttcagcttcttggccactcatcagttgctgctgttggatatatttttaggttctaaatatatcttacagggacaataatatcatcatctcctttgccaaagcagaagataacatttggcagtaaacactgaatcatacgccttcccagttcttccgagatttcctttcaaggccttggcttttccacataaacaatatcctgtcttgggttttccacaggaaaaccatctcctgccatcttggtgcccctcactcacttcaccttctcaactgagaggctgagcataatacttactccttgaataatacatttgtctacgtgttacagacatatcccctgtcactcaggaggtcctaaccagagagtaatcattctgatagaaatgggcaagtaaagacatatatagacaaaagattaaaattgtttggtcaatactggaatccagcaatcacacactaatggaagtatctcagtttttaagataatggtaaaattatagacatctataatatttcacattaaatataaaatgagacttggttggaatctatcacgtagatgacatcaaagagctctccactgtaaaaagtcatttcttatatttgacatcattttaaagtattctatgtgcatatatgcccttgccagcatctaaaaggcttctatcctgagaaatttctttcttttttctttttttttttcccagacagagtttcactcttgttgcccaggctggagtgcaatggtgcaatcttggctcaccacaacctctgcctcctgggttcaagcgattctcccgcctcagcctcccgagtagctgggattacaggcatgtgccaccatacctggctaatttcttatttttgttgttgttgttgtatttttagtagagacagggcttctccatgttggtcaggctggtctcgaactcccgacctcaggtgatccacctgcctcggcttcccaaagtactgggattacaggcataatccaccatgcccagactatcctgagaattttcaatgtagagctattgttttataagcaaaaatgatcaacatttatattttaatcattataaagcaatacatattcgatttgcttcatttacaaaaggcttcctggacttagccctttaaaaatgcacgacacttaatttttttttaacaaaaaagcagaaaaagatgatcaaacgaaggatactgatccatcaattactcctcaggaagacaggtggatcatgtgtgatttttcaaatgtttcaccagattgttaaaatgattaaatgaacaacctaagctcaacttgaaatccatacagatgtgatagcaccataaccatttcttaccctctggacactgtagtatggttgcctctggcatctttaacttggttggctgataatatttaatataaaaatcttcatggggtgtcaataaatgttagctttctactccctttctacaataaaagccattaaatcatgatttattacaaaaatgtgacttgactgattttcccatgttatacatccatgaaatgtaaacatgaaatgctaatataaaagaaaaatacaagaatatagattttactgttaatggtgcctattaaatgttggtataaaaataccctaagaaaatgcaacaaaatattaatggtggtagtgcctttaactggagggattaaaggtgatgtttccaagtttacataatgattgtgaaatactcctgggatagagaaataaaattttattaaaaatattattatgtttagagtcagggtcttactttgtcacccaggctggagttcagtggcaccatcatagttcaccgtaacgtcaaattcctggccttaagtgatcctcctgcctcagcgtcccaaaatgctgggattacaggcatgaaccaccatgcctgacccaaaagtttatttttaaaaacataaattttaaaaagataacataatcatatctcacttcactcattaaacatattctagaaaatgttttataatttaatttttgtttttaaaaagttcgaaggccgggcgcagtggctctcgcctgtaatcccagcactttgggaggctgaggcgggcagatcacgaggtcaggagttcgagaccagcctgaccaacatgatgaaaccccgtctctactaaaaatgcaaaaattagctgggcctggtggtgtgcgcctttaatcccagctactcaggaggctgaggcaggagaatcacttgaacccgggaggcggaggttgcagtgagctgagattgtgccactgcactccagcctgggcaacagagcgagactccacgtaaagaaaagaaaaaaagtttgaaaatgtcccaaagaagctaactactctccctgtgttttcccagccatgctgaattacttgtagttccctgaagcatcatgctaattccaactctgtgccctaataggtgctgttgctgatatattaggccccttgctctatgttcctcatgtaactatgagttttccttcaaaaccttccccaggaacactttctgagttctccactacaatataaatgctcatccttcggagagatccctcaatgaatttatcaacagtaagcactatcacactataataactgtggaaagtgatttaacaaagcacagtgccttctgaataaagaaatgaatgaatggataagcaactttgacactcccataacttaaacaaatggttgacctttttgttttctctcacttaagtgactggctgtttgactcgagtagtaaaaacaaactaggtgtcttgacaccctaaaaagggtgaatgttatctacataaattcaatctatacatttaattaaatagtatcattcaataagcattaactgatggcattgtaagtgccaggtttggtgttaggcactagaacatggaaaggaggaacagtgcttctttcctcaacaaactgagactaacaggaatagtcaggcaaatccacagttgcagtagtgttattaagtgcagtgttgaagcatgcactttctgtagcaggaacaaaaaggggtgctgtggggtgtggggacaagccttcttggttccaacactgtgttaaactaaaatgtagttgtatttacaatacaaagcttaataaaggctgcactggacaattgcctaatatcatcaatgtaaatacccaatgttatgtgattagaatgggcataaaaaataacaaaatctgctgttattaacaatgattcccactggaatattggaagacacactgactatcactcactacagaaagtatagaattggaaaagataattttatgaagatttataaacttttaaaactggtgtgaaagtattatttcccaaattcagtttgtagctggggtggggcgagtaggtagtataaatttcttcttaaattgtatcatgacagagaagtgttctttaggattccattgttgtggactaacaaagtcacttttagatatctcaaatttgaactttattgctcttcctatcttccaaagaaatgcactgaaaaataaaatggtctctctacagaagaaccaaaaagcacaagcagttttttttatcctcacagctttctgttttcaagcaatttggagtccccaggcggattcaaactcgatcccccttccacctcactcgggctctatgcactcccacagataacgagattgggtgagcacatcagattcactttccaaaggcacactgaaaaatcttcatgcagattaaaagatttttttaactatttcagcttccacatcttccaaacttctctttctcaaaccatagaacactatcatttgtgcagaacaacatgaagatgggaggttatggttccttcaattatgtctgagaattaagacatatgttatatatttactatgaaccttaaagaataaactgcacctagatctaataaccataattctaaataaccttctataatctattatatacatagtagccagatagacttctaaaaacatagctcaatcagcgctcaaaaatgtggcactgattgacagtgtataattctcactcattagttgtggaataaagtccaaaccgccgttctagaattcaagctcctcacaaactggctccaatctgccttcattgttgattaaccacatgtcccttgcaaaatctacgctccatccccaagagactctgtgttgttctctgagcattcagagaactcttccacctccatgtctgccctctcacggtttttcccacttgactaaccttcctcccatttcacctattcaaacctaactcatcagaagccctcctctctgaagcctgtctagattatcccacctgagagcaatgtctctgtcctctacgttctcactctgctggcatacatgtctcttgccacctctaccacatcttgctcacctttgtaagtaaacctcaccttgctcacctttataagtaactgttgttagcacatactaggtgtacaacaccacacctataagtgagtggctgaatctttttacaaaatgattcagaaggcatctcaggattatttcatttctccacataatcacacatatcgactaccattatttgatagattcagaggttgcaagatattggttgactatatattcactctttaactgatactaaaagttgttttagccagttaatctctaatagcagcttatctgccacttatttgattctcatataaagaaagagtattaaaaatctgatgtttgaatatcctacttacataaattcaagaaaagcaggggtttagcatatctgccaccctgaattcaattatctactgcatgtgttgtctctcatgtgtaacctgggccttgatgctaagccacccctcagagattctttaagttccaatgtcagaaaatttgagggtcctatggcatagaatgataagtaccaacatggttactactgaagatgttagtttggaaatacttttagatcatggagtgcttaagtgctatacagtcatatcaccaatagccttaccttttccacaagattttttttaacaaaatgtaaaatacaggtactgtaattcatgaattctcacataaaggacaaataaaaataggatcatgaatattgctcagactttgaatttttatactgtaatctaagaatactctgaaggacacaaatcaaattggtagggccaggaaataaaataatttctaaattctactaacagtaaaaaacacaaatataaatcttattaaggcagaaaataaaaaacaagagattttcaccatttagtttcatcgtttaaatatcatatttattatcatacactgcaaactccccaaactgctttgatattttcccttaaaaataagagagaaaacatgaaggcatctgattttgtgataatagaaaatttcttgataatatgtttttgtggctataagtgccaatgaatatatcaagttctaaataatatgcaatgttttaaataccaatgaatgttgtgacaatttttttcatttaaattgtgatgtatgtttgcaagatacagtctacttcctttaagctagagaggcgcctgtcagcgcctgtggaggcctaagaggaggaggcttacaactgcagtcttctccttcctccctgaccccgttgtaggaataagaagtaaatcttcagtcagaatcagcccatgcacacacaagccagtggcaaacctctgcccaagtattaaaggataaactgggcaatcagatttgaatctcaaaactctggactaggaaatcagaagaatgaactactgtaagtcaatgatatgaacgagtccaagagacaaagtagagggggaaagctaatcagtagaaaacaggcagatgaagatgcctggagagaagcagagctgccaacggagaacagacgcgagagctgtccgaggtcctgataccctgaggttctgattccagtcaacctgcagactcacatctatcctgaaatgcaacccaactccaattccacagagtcacaatgtacctaaattatttggacagacacagaagtcataataatataatttaacctactgataggccctgtgacaaaaaggcctaggcaaatggtaatttttaaaagcccagtctgcctgagactgaagcccagctctgtcatttattacctctgtggccctaagcaagttatttagtctctcttagtctccaatttatcatgtttaaaatggatataatagcaatgcctcaaagggttgttatgagaaatgcgtgagatgatgaatgtgtagtggttagcacagacggctccaatgttagacgatgatcaggagcatgatggtgacaacaatgatgataatttccttttccacacgggcatagtagctcaatagagaaataaattagctttaaatttaaactaactctatttacttattaccagcttgttcacttaagaaataggtagactattatagttaagattttaaaccttagatgttttgccttggagacagtttgggatgaaagaaaaatatataaaagcaaaaaaaacaaaaaaaaaagcaactttttacttaaaacctagattctttatttttcttcctaccaccacaattgattctaaatctcatgtataatccattttctctgcaaaaagtataactcatgcactcattcccttcatggagactttatgagggcctcatcattgaactttctgtcttctaatacgtgtaccctttttgcattgcatcagaagaaaaacttctaattcacagtcacctctaattaaatactcttctggaacacaccactgtctgctgaataaagaccagatttccttagaatgaccatggcaactttttacagtctgatctcagttcctcaattcatcccctactcatccctaccagcttttcatggtccttcctcatatctattcattttctctggcttttttccttgcccaggatctttttctgacttacaggtctggataaagacacaagtttttggcctaagtcttaaggttcagttcaaaagctctttcttaataaaatgcctcttatctttatactctgacctaatgattttcttttccttggtcatagagtattctgtatttctattaaaagacatcacattctactataaagctatggacacatctttccaaaaaagcagtagctatattttaaataaacagtgataaaaaataattgtgaagttcataaacaaggtaaccctgatatgggaaaattgttggtaaacacatttgaaactattccataggatgtattttaattcctccatgttcccatccacgacctgactctaaggagataaaatagaatcctgttgctacgggggaaacccaattatttaaacaacaaagattttctctagttcaaggtgaaaaactttcctaataagttggtgctcttgagcacaaaaagatgaaattagatataagggggaggcactgaaacccttttcaatgaattcttattgagcgatcacagtgatccaaactagcagaggatccttgtgcctattagttacacagaactcataggccaggtactattttgctattgaatctgcagtttggctctccacagttactcacgctaagctataaacataaaaatgaaaaatgaccataggacggtaaaaagggtactcatattgatgatatgagaggcatctttcatgtatgcctaacacactgccagtcacaggtgcacacacttaaacctgctttcaaataaatctctactgactttcactaggaaaggagaaacgtgtctgttggcaagaggttctcactccatttgggttattggcaacttttatacagagaccatttggcagactccatgacatcatgcagggattttagatctgatacttgttgtgcatgcatctctcatgttttaggacaacattctgatcacaaactattctcctttttttcagttatcatcaaatattgagacacatacagaggggaagggaggaggaagaggaggaggaaatagaataaaatatctgtaagtctcttacaggaaaatgtaatttttctcacttctccaggcaaacaggatgacttggaacaaccgttacattttttcttttttttcactatgctcctctgctctctactcaagaggctaccctgttaaataaactaaaatacagagtgatcggatctactgataaaacaaagtaagctctttgttgcttcacccagcaaaggtcactttcccagtggctttcagcttccccaggaaagtcataatactttccaaagcactcacattcccccgcctaggatgtgtactcaaacagaggtgtctctaggaacttcatctccggtttcactactaattggaaaatactgagggacagaagaaatccctcagcagtttcctcctgggaccctggttgcgtacgtacaccagctccttagtgagatgcaaaggatgaccactgttaacctggcttcctctcaagatcctccagaaagaattggataaaccataggctaccttcttgctctaaataacctcctcttcaattttcacatcagcttattaaaggtagagaatcctccagctataccacctgctttctttgtttctccgtgtatcagtaggcctgtctacaacagcattaccaaattgtgtgtctatttattgtctgtacttcaccttgttctttaaaaactgtgtttaatatttacctacattattatttgccctatgttttatcttttaaaaacatggaacaccaattagaaagacacattaaatgtcaacaattagtaaatttcagagaatcaaaaataacagtagaaaaagtaggattaagccaggtgtgatggatcacacctgtagtcctagcactttgggaggcaaaggtgggcaggtcgcttgagctctggagctcaaggccagcctgggcaacatgttgaaacccatctggcacacacctgtagtcccaactactcaggagcctgacgtgagaggatcacttgagcccaggaggttgaggctgcggtgagctgagatcatggaacagctccccagcctgggtgacagagtgagacactgtcaaaaaaagagaaaaaaaattaagaaagagagagagaaataagcaggaaggaaggaagagagagagagagagagaagaaaggcaggaagaaggaaggaaggaaggaaggaaggaaggaaggaaggaaggaagggagggaggggaaaggaaggaagaaggaaggaaggaaggaagagaaagaaagaaagaaagaaagaaagaaagaaagaaagaaagaaagaaagaaagaaagaaagaaaggaaagaaagaaagaaagaaacacacagactaagatcaagccataggtacaggtaggtaattagaaattagaatacctgccatgtaggcccttatactctgttagaggcaggccatagatatcaacttctgaacctcctggtgtttaaggacacatgcctataggaaatatagcacctgaaataaacttcataaaactgtttattatgaatgttttcatattgcaatgatgaaggcaatgaactaaatagcctaaagagtaaaaacatgttattatgggattccttattaaataatacataacaggcaagaagaaaagccaacagcataagttttcataattcaaccaagtatagggacatcagttgttacttgagctccatcatgtgtcattattataatgacagaagtagcagcatcaagaactagatccccacaatacatctgtctgagagcctgtatcattcattgccaaatgtgataagaatgtgaaagaatgctacactgataatagttttcatggtggaaagaaaagaaaagccattaatccagagcaaaagttagaaataatcaagaataaacgtatgtaggtatgttaaggttttatgactatacatttacagatgttttttaaactcttattattgaaattcctacaggaaaaatagctataattacagatctaaattatcctttttcccaatacaataattatgcttaaaactcaatttttgatagaaaaaggcttcttagagtacagctaccacattctagtacagactgtaaaataaagtaaccatattttcaaagcagaaataacatatggcttgaaaaataatatatgaatttggaagtttgtttttataaaagagtacaatttatgtacatattaaattacatttgattttagatttaatggctttttggaaaatttttatgaagtcaggattgttacaggaaaatttggaatgtagattttgctagaggtggatgctcttaaggactgtttaaaaaaaaggtctcacccaagtttttcataggaatctattcctgttcacatttttttgatatgtggtaagggattgtatttggagtcagggctttgccactggctagtaaccttgttccaatcatttagcttctagaaagttttatctccacatatgtaaaataaaggaagacctggtccactgcatgccttacacttttgtgatgctgtggacttttgagaagaacactgctcacttgtccactttcagccacagtacagctgcttagctacaagaaactacaggcccagctccactcctaacatgggattcatatctgtcctagtggactggaaatcaagtctttgtgccaatgcaaactcacataaccatactctgatggccagcactttgaccaggttaatttaacctgtctaaattttcaccttctgcctgctcactcctctaattttcaccttcccatgaccagctggtatcatggctgtctgttttggtgactgacagctagggactccagcatggttttttatctcctaggcatggctactatctgggatgcttgctctaataccttacactgtcttcttgtaacacagtttcttaaggcttgtgtctctatagaaacatgtcagaaaatgctatcttattatccctacccccaaataaatctacagtggggtcatttcatttatgaaaatactctggaaacaaagttgatgctcaggcaactggtctaccagggatagcatgattttttttttcttctctgcaatacctatgcacaaacttgtatctagaaatcaacaataaatgtgaaatggaagtcattaccactcaccgtcacaaataatgttttctttcattttccatatgggcaacataaaggagtgaaaataaccattgctgttatgcacttggtaggtttccatctaataaaaagcttcatatctgtaaaatgccaataacattcagtctatccttcctcatttccaacttcgagatctcatttatcccctactgttttcaggggttgactgaacttgtatccacaccaaaaccttccatgcccaagatactagtgagttacaaccaataagtattaagagaattacagaaattttgcatatttactttgacaggatacaaagatactatcattagaaaagtgagaaaagtctgtttgagtgggaagaaaagcattctgtcaataagatcagaacatgtacaatagtcagttggttgcttacggagtttaaaatttccaaatgctttagagcccagttatactgcctgggagtcttcagagatgggatacccatcactaatattaatattgatggtaataaaacctgtctccttccagcattaccctacacaaaagagttcttcttgtgataatgcaatgaagcgctaatcctctacaaagggctcggtgatatcagaataccatacgttccctttaatgttattccataatgaccataaagtgcctaattgtcaataaccacttaagaaacaggttctcttgggtccttaagtgctggataatgtggtgctgtcctcagtaccaggtaaaaggaagattttttttagctctaggaacttaggtgaaatcctggaaacatttgacaatgtttcttgtgtgctgctggtggatggatcatagatataaaacatacatgatggtttataactaggctttcccattgtatagcagcaagtgctaatcaataagtcaataaaaacttgatggcaatttttctttgttttttttttgtttgtttgttttttgttttttgtttttgagatggagtctcgctctatcgcccaggctggagtgggtggcgcaatcttggctcactgcaagctctgcctcctaggttcaagccattctcctgcctcagcctctcgagtagctgggactacaggtgcccggcaccacactcggataattttttgtatttttagcagagacggggtttcactgtgttagccaggatggtctcgatctcctgacctcgtgatccacccgcctcagcctcccaaagtgctgggattacaggcgtgagccaccccgcccggcccttgatggcaattgctaactcaagtgagggcccataactctctcatctgatatgacctgctattagtggtagatgtcacacatctgagggtgaaagggaatataccacatgatctatcagattcaaaaaacaacatgatgaaaagccaaattgaatttaataacatgtaattaagtagatttatgtataaagccagtgtgtgggtttaaataacccatcacttgaagacataccagttatacagaagcttatctgaaacaaacctgaagtctccctttgactgcaagctcagtgtgacctgaaagtgtaacggggacaataaaacaatgaagctcttgaaaacactcatgcattaacagaattagagtatccagaaagtgggttgtaaaagttccactgtacactctattagtcaagctacccctatagctatatttgtttatggaaactctcttccaccctagaatctaaaggcatatattcttccacaccacacagcaaaataaaacgctgtttctcaacagactctggggactccaacagcagggagggaggtgtcaggggcaagggttgaaaaactacctattgggtactatgttcactatttgagtgatgctttcaataaaagtccaaaccacagcattatgcaatatactcatgtaacaaacctgcacacataccccctaaatctatttttaaaaaccctgtttgtatttacatgtaacattgattttcattggtccattagtacatctctatttagcttgacttttccatgattcctatattaaatgtgttcttcagtagaattttccttctatttatttaaactctttgttccagcaaatgtcaaaagccaactaaagaggcactttaaagatgctgccaacttcagatcctctctatcaaaaatggaagaaagtctaatttaagaaagagggtatttccactcacccattgtgctgctgattattgaactggaagtaaccacaaggtctgcaaaacctctgaacttcattttgaggaagaagaaatgctagtcaaaatttacttagaatctattaaatttaaagtattataatataatgattgaaagaatggacttaaaaaaaatctaggtttgaatcctggctctgctacatgcaacttagctttggcatgttccttaacttctccaaatctgtgagtagtttaaggattaagttattaatatatagtatatgtaaagtgcttagcatagtgactcacatatgataaaggtacaatatagtttcactattatgttgctgccattgatattatattattattattacttattcacttgcatactgtgagacaaagtttagacttgagatttagcaattgtgtttgttactctagttctgtatttacttactagttacacctaatgcagtatttctaacaggaggaatgtaaataagccactcttcaggggtagagctcttgacaattttactgtcagctggaaatttgaccaggaatgtttcagagagaagcaaaatgagcaatacagcttctattcagatatccagagttagggaggcgtaaggtgattattcattcattcacagcagaaagatgtatggtaatgcagagacgaaaaatatcagtgtcactagagaagcatcaataacatgctgagggatttcagcagatacaggaggaaacctgctggcctgggaatgtttaatttgtaatggactaagagaacaatcgagtttccaaaattgtactttggctacttccattgctgaatttcctttccagccactgccccctcgacctctgttacagtctttacatttttatgaggttgactttcaaacatttattccaaagagcaccgtgtagtttttaaaagtaatcatgcaaggaacagtaatggaaatcgtaagcacaggactggagttaagtgaagcatcagccagttaggggctgtctagaggaggcccacaggaaggataatggatctgcaaaccacatcatgtgacatatgattaaatgaaacagaaacattaatcctggaaaagagaaggcttagggaggccatgattgatgttttggtgtaggtgacgtgatcttgtgtgaaaggagattagatatcctatgtaaatccagaaatgtacattagaaccatgggaaagaatgccagaaaaatagattttatattaatgtaaggaactaatttataatcgtttgaggtgtccaaccaagacttcctcctgaagatgtggactccttcccactaaaagaagtcatagagagggagaaaattctggcatgcgggagagggaggactgaatgagacaacttccgcggccccttcaccatctaagagtccatgaagtatctaacacaacgaaacatttcctttttagagaaaacctaattaattgtggaaagctgttaggaaaacttgattgtgttttatatctcccatctgcatatctgtaagcaaaccaaaagcagaaacttactggcagcttcaccttctttggcgagtttagtattgtcaatacagtaaagcctctcaattctgcatgcaatttgacatgaacagaaggaagaaaaaaaattagaattccaccttcagaaccacctaggagggtgtctgacattgaacaggtaatgaacaatgaacaggaccatttccccagcagcctttgttttccctgccacctgcaagggatggacagttttatttcacaatgatgaacagtgatgtcgggctgagccctccactctgtctcaattcactccccacctggagggaaagggataacaaatacaaggtcttattttgtttttgaagggtctttcagggacaggaaaagcagctgttgtagtttagaacagacttcaaaagcagatcaatagagagccagacccaggtgctccttaaaggcatcgactgctacaatattgtcatttgcctcccttagctttctctaccactttcctctcaagccctgctagactactggttttgatagagtaacactctgttgtgagatgggattgtttaaatgagagaaagttcacatgtggaaatctgccatggggaatctagcagtaactagatatgtcccatttgggtcattccaatttttatttcaagtctgttagaacagatgtattcaaaatgacatctagataaggccaggcggataagaagagacttcagctgggacaagaactactttgtgagttagaaaattgggttcatgtttccatgtttataatcttggctaagtctgtaactgatattcctcatctaccatatacaatgaggactgctgtgaggactaaaaggaaataatatctctggaaacactatgtaaaatccaaaacactgtgtaagtcttagatacggcactcttttactacacataatggtcatggtttgactgaaatctcaacaattttacagcgaattaagggaattcactgtattttcttattttcattaaggatattaaaactatttatatagataatatactctattagcaagattattaaaaagcaatttttagctttagatatcttctccagtacaaagcttttctctttatttttgcatcttagttgtctcttcttaacagaaaaatgatcctttgtatttccgtatgttaataagtttctgtgaaagttagatgacttccttacaaatagtaattaatattattgtaatagcaattataatattatagttttataaacattggtgctgtgatgtcaaaccagattaatatattgatctgtatatacatatatatagtatatacatacatatatgtatatgtatatgtatatatgtatactcttgaaagtattttagtactccgtcgcttccccaaaaaggtaaactagatattaaaactctacctaggataaacagataatggacaagaagagtaaaagctttttcacaattcttagcttctgcactgaagttatgaagatcgtggttaactaaaaagttaaaaatctttttcccataaagagtaatcaagatttccactaatcacaaggccggtggttgaaatagcaagattcatcctcaggcttgcactttcttgttgctggagagcaatggggatggggaaactctcggtaccacggtcctgggattggctgggtcataaagatcattccacaacatgggattctttgatcatctcagtgatactccccccagcctcaaatgctcagggcctctgagccagtccacctctcagaagaggaaacctaatatcccgcaggggcccattccacagtgaaaggctgttagttggaaagttctttttaccttgcagggcaatacagtgggaagggactatccagtaaaactcctccaaaacagtagtaaccactcaattcatgaagttctctttctatactgcagttttctaaagtaacataaaaatatccatggatttttcactttcctttgaatgcggtgaccattccttacctttaccaaagaaattgcaagaaaaaaaatagaaaaaaaagagcatctcttggcaaaaggtcccatcagtaattctagttatagaatcccttcaagaatcattaattgtgttacactacagaataaaccaaatatttatttctgcaagcatcattaaattatgacatattagaagtcattaacaatcagcaggcaagggcactgggttctgccagtttaatgttctgaacaatcaaaaataatatccatggggcaattaatttcctgcacattgattattccaatctccacactaataagtggggctaaaccaagtaaaatcaaaacagcacagcaaaaaactgcagactgatcccacttgtaaaggggagtctgtaaccttgacagatgaattgtatttcctaagttatagggggagaggaggaagttattccagcaccctaaatggtatcttgaggagctagcatgatccttacatccactatacccctttcacacacagagatacatgcacatttcacaaatgtaagaattaagattcaacagattgtccaaatcaagcccctagtaataatgtcgggaccaggatctttggattagttctatgtactttccactctgtgggcaattcaatggatgtttaatgattctggaattggagaaaaaacaatttctattaattcaacaagttccacagcaaactgcaaaactgccacttttctctgggtttgaggaactacttattcataaaatattagtcaaccaatgtatcaaatctgttgttaaaatgttatccagaattctaaccctttcttccttcatacattctttaatctgtcaggcatttaataaatatccactaaatttatcaagtgatgtgttaggtcctattggaacacacaaaaatcacaaaaagatcctgttcttaaagagctcaaaagattttaaaacacacacacacacacacacgcagagtgatgtgctggtagatgctcttcatcaaccagttttccaggggctgcaggagaagccttgatttacagcatttgccacttcccatgatacaaatactccaaccatggctaatttcaatttttcaacatcaatatggggttgtggattcagggagatattaaaaactgtctaaactggctctagtgcaccactactgatacactgctgatatgagtgtgtgtttcactatataaaagaactaatcaaatattttagagttgttatgttagagtagtgtgattatgattgcttcttcttcttctttttccttttttttatagcatccaacattttttatgaagaagactttttttaaagataagtactagtagcaagattcttatcccagaccactttttctacatagccttggtataaccaaaattatctgaggagtagagaggctaaaatattttgatggcacatcagattcgctttagagccacatgtcccagtagaactaagaaaggaaatgctgcagagagtgtccaacttctaagaggcatcatcagacttcatttagcactaagtcttcctgagccccacctatgtgaccatatgaccacctagatcttacaaaatatatttgcagagcatgccacctccacacattcttaagattttgaaatattcaatcataggatgtatgtgaaagaaggggaggaagtagaaactaagagaaggataatccctaaaacataggaatccagacagaaatattattgcttctgcagaaaccctaggacaggattgaatgactcaccacctgtttggttttatggttacatttcaacagtgtctgcagctgtaactcatgcttcctccttcggctttcttaacacacagatgcactctgttttggaaccaaacatctttgtcccattccagaaactcttttctttcttaggactatatgaatgattaaccctgtaatcttcaaggttatttattatcatttttaatgtgaagaagtggaagttttgtggagggaaaataaaacgccttattgcttgcataacattttaacatttatgaaacaattgcatgtaacttatcacagttatcacaataatcctctggaataggatattcctggcaccttcatatgtgaagataaagaggctcagagagtttaaaagactcactcaagttcacaaagccacagagtggtctctcactgccttaaacacatgggcttcagaatccatattccaacccagtagggaagtagcttggtatagtttagagaaaaacaagatgtggagttaggcaggctagatttcaaatcttgacaccaccattttccatctgtgtgatcttgggtaaaatccttacactttctaggcctcattttcctcatttgtagcatggagagatgacactcaccttactggactgttaggaaaatcaaacaaaataaaatttggcataagatgggttctcaaaacatttcttttctcttttccaccattctgtactccattgttcatgcctcttgtccttgtatcatccttagttcaaacatactcattttgtttcttgccctgactcaaacggcctctccagttgaacaaccagaagttgaacaatcatttaatggacagtgtgttctaccagagtatattgctgtagcaagaattagaccccacacaattgggaaatcagggaatcactgcagtctaacatggaagccccactggttcctgcacaatttttcttagcatactgtatgttgtgccaccaagacacagcagctcaacacaaagtacacacagctaggaggatggacaagtcatgcagagatacagtactgaatgtgcggcccattataccacgctcttcctcttggctccatctcactaaatgcacggtttccaaagtatttattgcacacttcaatgcacaaaacacacaagcaaacactcaagaaggagccagaaccgttttatactaagcctgtcactgctcctccacctgcaaattctggtgccaatgctcctctgacttcattttcataactcaggcaactcagtacttccgtacatactcttccaccaacctaccttccccttcaatttgaaaggtaaactcttttatttactggattatttatttgcagggacattaacatgttcttataattgtgctagtattttccataagctcactattgttttggttagtgtttaattataacattaaatgttttgagtgtttaaaatgttttgagtaatctgttccaattctattttcctcaaaacgtcagttatttttagtgagtgatttttcagaatgtgagatttttaaaaggaatacatgcattatgtgatggcaagaatgctcatattttgctttgttgtgtagctattttttatatattgaggtgccacaaattgatgtgcttatttgactctgttaaaatccaactcaggaggaactcatctccatggttaagaatgtacaatttccaccaaagatagtaccgaggggggaaattcatactacttttcataaatatgctaaaccaaatgattctaaacataaaatagtgtatccaatatagcattgaaataaatctatccagtactggcctatctctacaactttaagcagcttttgctttattatgtaaaagcattccatttttaaatcagctaaacttccaagcaagcaaagacattacaagaaaagattcttcagctacagaacctgtcacatgaggaaccaatttccagggtaagaaaataagctcaaatattttaaaaaaatgtttcttcttacccctagcatactgagctggcagtataatgaatcagaacattttcatttgcatttattctttgacatgggcaaatgacaacctttccaggctttcactgtaggaaaatggcaattttaaaaacttgaataactatcctattaattttatgaagttgttataagagataatatatagtatattatatacaaatatatgtttatatcttatatattaaatatatatatgtatactggaaattacttgtaaatctgtttacccttcaatcttgagactgtacagtactctgataaagaacatattatcatcatcactgattccttatccccagccacttttagcaaattgccttgcacatattaattttttttaagttctgtgatacacatgcaggatgtgcagatttgttacataggtgaacgtgtgtcatggtggtttgccgcacctatcaactcatcacctaggtattaagcccaacatgcattagctatttatcctgatgctctctgccccccaaccccaacaggccccagtgcgtgtcgttcccctccctgtgtccatctgttctcattgttcagtcccacttataagtgagaacatgcagtgtttagttttctgttcctatgttagtctgctgagattgatggcttccagctctatccatgcccctgcaaacgacatgatctctttcctttttaaggctgcgtagtattccatggtgtatacacaccacactttctttatccagtctatcactgatgggcatttgggttgattccatgtctttgctactgtgaataggccttgcatataataattattcaataaatgtttgctacattaaattgaaccatatgcataatcaaagtcagagtctcgctgttaagttgtttaaaggactagatttattcctagagagcaaatagattgttcttaaaaggcactggctatggctgttgaattggttaaaattcagtttggatgcaagtgacagaaaacacagattgtaatatcttaaagaaagtataagctaatttttctgtagcaaagaagtttatgtaggcaggtcaggtatggtgaccctgtaatcatcagggaccattgttgttctaccgtcataaactctcagcttgtatctcctggccaagatgattgcattctggcctgcaagaaaaacaaaagaaaaacaagaaaggtgcatgccctttttttaagagcgctttctgaatattacatcccagctgtttgcatcccattggctggaatatattatcttgccatgcctagcagtgtaggagcctgggagctataatctttattctgatggccatgttcctagataaatggttagtgccattactacagaaaaagagggaaaaaataccaaggacagaaaggtttatcacagtttcataaattgacagtgagctttgagtcaaatcaatacagagcaagtaaattaatttgtttctgataaactttcagggcaagaccatcacatgtgttttaaggatgtagataattctagttaatgaggagagttagaacctatttccaacagataaacttcttttgttggaatccattcaaattcccatccctaatgatctatactaaaacttaatactaagccacaccacatcgattaaaagaaatattatgaaaagaatgcataattgcctgagactaagatatcaggtgaaaggagagagctggttgtaataatcttttcacacaaaaccaagtgaatggtaacttttttggttataatcaaatacatctctcttcttaccctcagaatagagggaatgctgtatagtcactaatgctgtccaaacttaagtgcattgggaataaaaggatggggagactaaacaaagccaaagaaataaaataataataataaaataattctgagagcatctgggatattccttaaagaatttataagattcttcaggagatatgggtagcttgccccatccgaaaactccaaaaacagttatttcataggtctaaaacaactaaaactgaatttattttcactgtactattatcttagtatttttcttaattacgcttcatcactatcatcacccaaaagggtcaattattgaggtttcattcaaactaaaaccctgaaaactaaggatggaaagataagaataagcaaaagataagagaaacattcaaatggaaagaagataaaagaaaaataaattagaagaaaaagaaaatactagatagtgactcagagaagtagaggctgaatttggaggaaaataggagaagtaagaaagtaaaggagagagagatgaaggcaagagcaaaaacactagtgacagaaggagttacacacaaagaaaacaaaaggcaaagaggatattttagcagggagatagaaatcctcttacaggatgggactgccagggaaatctctgaaacgggaggcaccatctaggcagcattattcagtaggagaaactgttcaaatttaaccatcgtttggaggacatcaagccctatttttgtgtgatcctgattttccacattaaaacacagaagctcatggagatattccaccccatttacacaatcacgaaatcgtagaaatggtttggtttcttctgtcattgaatttgatccttacaacaccatcgtgaagcagaaattattatccctacttcccatggaggctcagagagagaaactgacttgtccaagattatcttgaacaatgtgagtcccaggtctgcaacttactcggtgtgttgtggaaaagtcacttagcctccataaaaatcatctgtaaagtgaaaataattaataacaagtccacaggttttcacatataaatgggaatatatatacgtacatgtaaaaatacttggtaaaatgaaaaacataatttgtcatatttactaaaactaaaatgttcagtgtaaaaggctacagggagttacatgctgctagtcctttaaactattaggattgaaaatgatggaaaaggagaaggagaagaaggaaaaggaaggaagaaaggaagtaaaaaggaaggaaggagagagggaaagagagaaagagaggaagacaaggaaacagaccaacccagtaacaacggctaacactgtgcattattgtgtgccaggccctgtactaagtctttgctcatttaatcaccatagcaactctaagacgcaggtactattattaccccagtttgcagacagggaacgtgagccttgaagaggtttagtaacttgaccaatttatacagctggttagcgagagagcctggattcaaatccacacaggtacaagtagacactcttcaactcttttttttttttttttttttttttgagacagggtctcactgtcacccaggctggagtgcagtggtgcaatctcagctcactgcaacctctgccaccctggttcaagcagttcttctgcttcaccctccggagtggctgaaattacaggcccgtaccaccacacctgtctaattttgtatttttagtaaagatggggtttcaccatgttggccaggctggtctcaaactcctgacctcaagaaatctgtccacctcagccttccaaagtgctgggattacaggcatgaaccaccacacctggtctctggtactcttcaagtcttatactgcctggatattagtcagctagaaataacagtcctatgagaaagagcgaatatcataaaaatctcactataaaggcaggaataggaaaatattaggcccatcagcacaccagcagctaaaaatattacccccaggcagagatttagcacgtgctattttaacgtccagtggaatgaaggagatctcagtaaatgaaagtaacatcagtcactctaataaggtcaaatggtgctacaagaagagaaaaaacctccatgagattatttcaattgctaatgaaattacaaattagcctttggagctcagttcatctttcctcagcggatagtgagctaataagtaaatgtaaaaagcaattacaaaatttacacagactttaaaaacctccccatgatcaaaaagctagctcagaagtttcaacaaaaacaacagagttttggttagacagaaatcttagtggttgtatagtccataggccaaagcccttcctaaagtgcggacaatccgacctgccttttaaagctgatagattgtccgaagaatatatataaatgccagtgagcacttgaaaagatgctccatcattagggaaatgtgaatcaaaatcacaatgagataccacttcacacccattaggatgactattaccaaagaaatggaaaataacaagtgttggtgagcatgtggagaaattggaacctctgtgtcctgctggtggagatgtcaaatggtgcagccactagagaacacggtatggcagttcctcaaaaaattaaaagtataggccaggtgcggtggctcacacctggaatctcagcactttcggaggcagaggcaggaggatgacgaggtcaggagatcgagaccatcctggctaacacggtgaaaccccgtctctactaaaaatacaaaaaattagtcaggcatggtggtgcgcacctgtagccccagctactcgggaggctgaggcaggagaatggcgtgaacccgggaggtggagcttgcagtgagctgagattgcaccactgcactccagcctgggcgacagagcgagactgtgtctcaaaaaaaaaaaaaaaattaaaagtacaattaccaggtgatccagcaatcccacttttgggtgtataccaaaagaactgacagcagagactccacacagatatttgtatatccatgttcactgcactattatatacaatagtcaaaggtagcagtaacccaactgcccattgttaaatgaatgaataaacaaaatgcagtaaatacattcaaaggaatattattcagcctttaaaaaggagaaaattctggcacatgttacaacatggatgaaccttgaggacgttatgctatggaaataagccagtcacatataatacaagtgaaataagccagtcaaaaaagaataaatactacatgtttctgcttatatgaggtacctagagcagtttatttcatagggacagaaagtcaaatggtgattgcaatgggactggtaggggaatgggaaattattgtccaacaggtgcggagtttcagattgggaagattaagttctagagatggatggtgataatggtcgcacaacaatgtgaagtgtacttactgtcattaaactgtgcacttaaatatagctaaaatggtacattttatgatatatatttttaccacaatagaaaaacaaaaaaaagaaaaagtaaagaagacttctttgtgtaaatatgaaaagaaattaaagcacgttgagtaagaggtgtcccttacctaaggatccaagacaaataacagagtaattttatttacctttttatatacctttatcttctttaaaagtgccttatgtacaaactaaaaaaatttatatcctaaatgatatacgggatttgcttcaaaataatcaactggggcatagaggaagtggggaagtagaaatgaaacaagatttacctgtggtgaatcattgttgacactatgtgatgtgtgcatgaaggttctttatattatttcctccactcttgtattcgtttgaactatgccacaatgaaaaattgtaaatgttgctttatatttaccatatacaacagttttaaacaaaatatcaagccactgaagagcagtgaattctaaaataaggtaaagaaaatttttaaaagaaaatattccttagatgtcatcacttccattggtaggaaaatccatgtcccttttctggacaattacaatgaacagttcacatacactgaagaactgttatttatacaagctttacatgcactgttcacataatactaacaatataccactttacagatgtggaaattcagactcacagaggtaaagtaactggattcacgttaagtgcattttaacccagacagtctggctacaagcccttcagcttaacaagtacatttcttgaattacgagggtatttttttcttctttcctgctagccaatttagacagcctcaacaatcctgagttgccagaattagaaaagcctgattgagaacctatgaaaagaggtattttgttttttaagggatatgatcaatacctttgcctcatctgtcacagtaaatccctgaggagtttcaacattagcttaggtcaatttagttcatttactgagcacctactaagtgtcagaggctgttaaaccttgggcactgtgctaggcactcagattcgcagaggaatataaattattcgattatgaagacagatgcatgcgaatgctcattgcagcactgttcacaataacaaagacatggaattaacataaatgcccattaataacagactggataaagaaaaatgtggtacatacacatcatggaatgctatgcagccacaacaaagaacaagatcatgtcttttgtgggaacatggaagtagctggaggccatgatcctcagcacactaatgcagcaacagaaaaccaaacactgcatgttcttacttataagtaggagctaaatgatgagaacacatggacacatagaagggaacaacacacattgaggcctatcggagggtggaggatgggagagaggagaggatcaggaaaaataactattgggttataactatgcttaatacccgagtgaagaaataatctgtacaacaaacccccatgatatgggtttacctatatatcaaacctgcacatgtaccccagaacctaaaataaaagtttaaaaaggtagtcagtgaactacgacatgatactgtattgaaaactaaaatgtaatcatgaaggtggaatactagaattccctgagaagagtttttataaaggtaaaaaccaacatattaacatgattgtatatttatctggaaataactacatttctcaacgcctatttttctattataaaagtgagtaaaatgaatattgctcctacttaaaagatacattgaattagagactattgcaatataaactgcaaggcctggtatggcatcttggagaagaaaaaatcacaaattccaatttccaaatcaaagaagcaacaaatcacaataaaaaatttaatacttaaggccaggcgcacctgtaatcccagcactttgggaggccgaggtgggtggatcacaaggccaggagattgagaccatcctggccaacacggtgaaaccccacctctactaaaatacaaaaaataagccaggcatggtggtgcgcgcctgtaaccccagctactcgggaggctgaggcaggagaatcacttgacccaggaggcagagattgcagtgagccgagatcacgccactgcactccagtctggtgatggagcgagagtccgtctcaaaaataaaataaaataaatacttaaatgtttctatttttcaacttgcagagtttcaatacaaatgtaaaacatacttaaaataggtgtttctattacattatttgctatcagagagcaataaaaataaaatttgataaaaaaaactgtcaacagaaaatagaggttaacatagtatttattttagaaaccagaaaaccaaaaataaataatttatatcagtcagttcttcctctttcatggtattaatcatcctatgatgaggtgcttggcatctgtgtttgccatggtaaataagctccgcgatggttcagacctatctgcactgtccaaaactctatcttcagcacttaccatacacatagctgccccatacacagccaaggccaatgcatatgtaatgaatggacttgaattcgaatgtcctgtccattcactcatttatctagagagcaacacagtaaagaggcaagagtagggactttggaccaggcattcattcactattttattcattcattcatgcatctatgcaaccaatattcgaggacacctattttgtgccattgttctaggtcctgagacactgcagtgaaaaacaggtgtttccagcctcacagagctcgacagttctgccactagtcttgggaggtcactcagtctgcgtaagttgcctttcagctttttatttttagaaaaatagaatactaataaccaatatggaagattattttaaagaaaacaagtcatatacataatggacctggcacacagtaagtaaacactcaataattaacaatcaaccaaaagcctaaaaacaaaataccaaatataaaatttagaaccagtgacaaatgacattgatttccagagcgaatgcacctagaaaagttcaaagagaaaaaacattgtaataatattaattatgtgttaatagccatattagtatgaatctattctctctacatggtaccaaattttcttcaaaatcccttggcatacaccatcttaagcattaacaatgaaaaaatgtccacagatttctgtactagaggaaaaaatttctatgaaaccagtttggctgacatggagagctttgtgtggacaatgaaggtcatgtagatttgtattgttcttgacatcttctaccaatgagtaaatggaggaaatcatgtcaactgggcttctaaatgatctacagccttggggacacacagcaagcagaggaagacttggtcaggaagtgttttgcaaagatggcttttgcaaggacactaagggaagttgagacacttgcccaagcttgcatagctactcaggggtggggtgagaattcacatccagctcttctgactcgcggtcctttgacccttcatgactactactctgcatgggctatcaccctcctttaaaagttcagagacttagacaagagaagagagattataaaaaatagattccttttataccttttatacctcaatttaaaattctcagaaagggttctaaacactttaaatcccttttacccagaagcttctggtttttgctcagtcttgttaggaattggagtggctgtgatacatctctgagatgctatgaaatagagatgaattgaaatactttcaacatcagcaaatcatctgaggccccataaacaccctgcacagtacattcatggtacatgcaggcctttgtcttactgaaagacaacctatgtcatctgatgttaggagagtcactcacttcagaccactgaaagtttcaaaaaaagagaaaaaaagtcataaaccaagtaaataatcagtgtcatttaccattatatctaccattcccttacgaggccatggtctatggtcttcctttaaaagttctgttgtattctcttgaaaaaaaaataatttgttgaactctactttgttttaagcactgtatgcaactgtttaagtatagcatattgttttatctcttgtcttggacttgatgctatttgttcaaagtcctttacttcctgccactgtgctgtccaatccaatggacactagccaccaagaccatttaaagttaaatttgaattaattaaaattaattacaatttaaaatccaggtcctcaataacactcaccacatttcaggtgttcagttacctcacgtggctagtggctactatatcaggcagtgagcatatagaacatttcggtcatgatagaaagttctattggacagcatcgccatagagcatcaaatccaggacttccagctaagatcagatatgaacagaacgaccaccagaataggtcagactaagttcccaatcttatcgttcctggggttccaagagctaaactacaggtcagagaaaaaaaagcatctaatctatttagaggggttgactagatatcctggtataatccacgatgcccatgaagcaaccaggatgctgattattcactgacactaaattacaaacacaaagtcttagtggatttattgacagagaaagaaagagaggccatagaaagacaaataaataaagacctgaattcaagctgcgtgacttcaggcaaattgtgttacttctctgatcctaaatttcataatctgcaaaatgaaaaagtagattaactctgagtttcctttcacctctgaaattcctggattctaaggctttatatagtttgcataatacccaaggaactgtgcagactgccaagatatataagacaagatgccaaagactttcccattaatgagtagaggaagctgtctagatagggctaaacaatgtaagacgggacattttaagtatcataaaaatggtattaccaatgcatcctacagaagcctcctctttatcttaccagaaaaatatgactggaggtagtggaaacattcacttttctttcattatcaaaaaatatggtaacatagggtaccccacctggcatatatcgggtgtttaataatttttgttgaagaatagtaataagataaaatgataataatattaattatactagcaggcatgtattggaaacctaatatatactaggttctatgcaagacattttccccaggctatcccattctagcatcaaacagctctatgaagaaaacattaaaacattttttatttttttatcactttatagattaaaaaactgcagtgaaagaagttaggtcaccaaaccacagccacacaactaaacagtggcagagctgagatttaaaaccaagacttcccaattctagtgcacatgcttcctccatttccacccattgtctccttaagaaaacttttacttgtcaatcaccagaaaggaccaaagaagactctcaaactttttaggaacccagctaatttcacaaaactgccatttcctatatatttttccagacgacaaaacaacaatgtatctttccagataggccactcagccaaaatattttctagtctagaccaggtggcaatttcagtggagctggaattgagttcatgattgcctgttagtgttccaatgtcctgagacttttgttaattagacacaagacaaagggcattaaaaagaagccaagttaaatttgcatggctgtgggcaaatggcagaaagaagtgggcctttgtttcctacggaactgggcacccactctatcatctacaattattttataattgggttgatattttgtaggatagaagcctgagtaaccctgacatccatatgcctccttatcactgtcatgaagtggaaagcaagggccaattatttgtgttgctcgttttccacaatcttgttttcaaagagacttaacattaaagtcactaaactgtccaaattcaaagtatttccacattctctgcagtgatcacattctgtcacccacacttcctaaaaataccctgctttccatcactcactagaaccacagaggctattagaaggtaataaaatccctcgagggcttctcttttgcacatttgcactttcctctgatcaattagattcagggagattggaagtgggaaataaaagaaataaaattcaggccacaaatccttctcataatcccacaagtagcactgacaaacaacaactggcaaggaaagagctcaaccctggaagactctcctgctctaaactcaattattatccaaaattcatcattaaatgattactcataaaatccttctatctacttctcatcaagaaatatcatcatggaaatatcaatgatggtcctatcttatctcagggtacatgtcagtattagtatcactgagataaaaacagatctgaatatgtttagggtagacaacatcctttggtccagaaagtttctttcaaataatctgatttacaaaagacactccatttaaaaatttttcagaaatggcaagatccttctctcagtgcctgcctcccatctgagcccttaatttagaaatctgagggcttaaaaggaccatgcctttcataatgatcttttacaaacattccttccttttctagtgcgtctttgtcttgttgtcccttgtatatattcctcactctgctaacatgtagtaaacccagacggattaagaaaactaaggttcaaaaatgttaaagatcaactgggcacggtggtgcatacctatactcccagctactcagaaggctaaagcaggaggttcacttgagcccaagagttcaagaccagtctggccaatacaatgagaccccatctcaaaaaaaaaaaaaaaaaaaaaaaaaagccaaagattatttttcacgacggggatttcggcgagaaacatcgacaccctcagcgttgaccagatgggcagtcctgcactgacaaacccactgagttaatgtagaatatgtcagctagctcaatgctaagagaccagtaatatctgtggcccagtctcttccagagaagaaatcaagccactcctctctctggcaagtatgtctcctctcataaaacaggctgacttcagaagtagctttcaaagacaatgcttagatcaagccaatcagcgtaagtactcttcctggttgggtgatagctctcactgtgacttcatataagaaaagccagtggtcttgtcttgctcttcaagaatggagcagtcacggctgggcactgtggctcacccctgtaatctcagcagtatgggaggctgaggcggaaggatggcttgagcctaggaattcaagaccaccctgggcaacatagtgagaccccatctctagaaaaaacaaaaaaattatacaggcatcatggcacccacctgtagtcccagctacttgggaggctgaggtgggaggatagcttgagcctaggagttcaaggttaaagtgagctatgattgcaccactgcactccagcctggtcaacagagcaataccctgactttatttaaaaaaaaaaaaaatagaatggagcaatcttaaccctaaaataacaaccttttgccagtaccaccatatgataccatatgtgaaagatttattcaggtacctgagcttcacaagtaacaaggctggcatctattctcttctccaaaaggcattgtttcctcctttacaactaaataaacagtgcaaattatgtcctcaactttaagtcaggtttgaaaagaaaaaataaaaacaaacgaatgcaaagcaagagactatataaggatgaagggacagcacaggagaatggaggagagaatgggcataggagaaaggtgaggggaagggggagaggggtgaggaacagtgaacttggtaagtctgctatttccaaaaccatgtttactgcagtaagataatgaatgaggaaaacattttcattttcttttctgacagcttgagcataaatgatagctgcaataatatcagaaattattgggcattttgaggagtcttgctagtgagaagccagcattccagccaatttgaagctctggccccaaggtgacctagaaattttgtttttcaaatgcaggaatgtcagctgctggactgaaagtgatgtatactgtctagtggacagcatgctggccagacaccaaatttggagtgtctctccctgtactcagttgttctttacggccagtgctgcccccacaaaggagagttttgtctaaagccgaccaaaaacgggggtagtgtttaagatccatcaacaccaaataacactgagttttgacttgtcacctctacagattcttcaagaagctgatctgaatccaacacctcttggagttagttgggtctcttcttcctaaggcagttgattactactagttctaatctagttaggggcctgactgaaggaggcctaaaaagtgccaggaataaaagcagtcaagcctcataattttatgtgtttttaaacaagacaccctcaagtacataaaacaccacagccattgtaatttaatcatctgcttatgaaaaagacagcactctaaacagaagaactgataaggcaaataatttgcctataaggatttttaaaatgtgtctctgacatcaaatgaactctactgagattccctgtattatgccaaaaacctactggccaacatccaagactgacttgcaagtaccaaccctaatccggatcatgaagcaacattaccatcacctgtacccttcaatagggtgatatccactctaccttaacaatcagagttttatccgctgtacattttttccataagattcctatggacttctccatggaaaacagatccctggaatctttctgtgatttggaggaactcctgtaatttgtatgaggatagtgataacgagagaaacatcaaacacacacaagaaatttacacatcccagcttttctgtgtattccactttggaaaccaatagcctatgaagataaaatggaaacagcacatacatatcttgagtgtgtgtaaatcatcagagtcatatgcaataagtaaacaggaggtgtcatgaggagggaaaacaccacgaatattcccagttcagaacacactttcaagaacgatgcttcaatagtgaagtagaaggggaaatgggcatgagtcaatagaacagcaatttctctatcctttctctccactgttactaagcaatgtcctattggaactgaactttttttctaagtcttcgattgacttcctaattaataagcattgtaatctagtgtttattcctttatgaaggcagagcagttgaaatatcctaacacacatattcaaccaacacccctctccaattattgtgttgttcttcacattgaaatttggcctctactgagaagatattgaatggaaagcccatataagatagaaaaaatagaagcataatggacacacgaaatatgtgatgtcacgatctatgtctacacacagataaagaccatttgacctgataactagcaaatgataagcaaggacgctgtgtctctttatacattatctgatattatttatatattgttatttctatcacaaagaaaaacaaaaaacatatgctcagagaatacaagaatagacagacaatccataggtaagcattaagagtaaaatgtactgaaaggagttactttttccaataatgccttatcaagaaaatctttctttgacaagtaagttatatgtggtcactaataataagcaaaaagctaataaaagaagggaaaaatgagtagcacaagcagttcccagcttaatcaacaaaataatcatgctttaaaaaatgaggtagtacattctcttcctgaaatcattacagtctgttaacttaaaagtaaaattaatggcgattcgatgctatacaacactgtgtagagtaaacccaaaattaccaatatgaggctcaggtacactaaacagtcaaataactatttctgaaagccctgtcttcttattttttctttttttgttctcataataactgactgaatgacacacactagttgctgcatatttagtttatttctaatgaagataactattaggtgtccaatctactcagtccttaatcttttaaagggaaacagagagggaatacaattgtttagcctaacggaaatagcttactactataattttccaaccaaaagtctaactcttcacattgtatacacccataagatagaattcaaaattctcacagcttgcatattacaatactcagagtcttaccaaacacaaaatattatgacttatttgaaaccaccgaactccccccaaaatatttcttctcaaaaccaactctaaatagaatagacaggtatccagttatttcaattaacttaaaaatacaatactaataatttaaactcaagtagattattttcctgatttatgcagttggaatgctttaagactaacatagaaagctaagttctgatttatctttcccatcatactgttttatctcagacacatataaatgcattcataggtacacagtatagtactgttcgcccaggctagagaataaaacagctagcattgtaccaggacgcctgtgcatctttccattaaagccatagcaatattccctcaaacacatattcatcactaccttttaatgattctgggctacacggatgaaaagttttgatttagtgcaggttaaagtagcacatagtctttcatctttattcataatcagctctgatccccttgctgaaaaagaaagaaatgcaaacatcttgaactcttcaatgggcttttctctaattaaagcctttaacaattttggggtgtttcaaagcatgacttcctttttaccattgttagtgttaactaaagaaatattgcccaataagcactccagataatatactcaaaaaatcatctataaaatgcaataaaaatgattggggcagaagaacactgcatccttaattttagtaagattgttgatgataaccagagtgaagctgcctaagcaatcactcaaaagcacatgtaatagttaaacgcatctttattatggttgctcagtgtctaaaagtttgttgccagtagcattgctattaaatgtataaggctgtcaaatctatttgtggccaaaaaaaagcaactctgcaagataaatattatttaatgatttaataggcatacggcactagaatataaatacccataaataccccaagtcataaaagtaacagaaagtaaaaaataatttaggctaagacaaaaaaagactagaattgtttagtcaagaacgaaattagtaaaccacatacatttacacagacacagtctctcttgccacaaaattgcaaagtggtctacttttatttctaaaatgtgatatgcttatatcattattataacctaaatgtttaaagggggtataagaaaaagcttctaaaattattacggatgctactaaatcatgtgtataacaaccaaaatatctggaatgcccaaacgtgctgtcattgctcaggacagaataatctattcaaaaccagcagggaacacgtgaggaggcctcatttacttcagtgtgtttccccacatatgcatcatttgagaatgtcagatcactttcacgtatatagtacataatcactgatgatctgggaaatccacaaggccacaaagttgatacatactctgatctagagggggaaaaaaatcgagaaagccggaagtttcccgttttccaagaaactgaagacattcttacctttctgtacaccagcatgttgggtgattcatcggccaccccgttgctggtctgcccataattattcccctgggccatgtcacccaaaacttggtccactctcaagatacaagaattatcagtgtgccctgcaaagggtcagagagacttcagtgagatcccagtgggactcccctgattcatcatcatcattcacagcacccaccccacatggcgcgttcttacaaactggggctggctggagaaagtgacacaggacatggattttttaaaaagtgagttgacacctacaataacctcaaggaattgtaagaaattacaatcttccaggtagaaatagccatttggttattgttttagctgacttcattttctggatactcattttgagaagtgtttgatgctcaccctaaaaactcgtgggtagcattttcctagtacagagttctcttctctcccaatacttgcatctgaacttggtgatgttttccccaaagggtggaaaggcaacacctgggggatgcggtgggggagtggggggcgggttagcacactttctcctaggtatctgtctagtgtccccacctgcagcccatcagagaggcccattcccggtgtcattctccagcgcacgggcttcctctctattcccccgggtctcccacacagagccggagtatatgcttcgcctactttcacctgcctgcgctgccagccaccggctgctctcctttctccccacttcgcttcggaagtccggaggtaatcctgcctaatttttgcaagaagacaccagaatatgtcccggcaacaagaactagtgggaggtcaagccttcaggccattttacccgggtcaccgtgggtaaaagcctaactgcagaagcctccagagcaaccagccaaagaggagaaaacaggcaagcccctgctccccttgctcgctctcacggcagcagcaaatggcaggcgagcctgtgccccgcgccgcggcggccgccggagccgggcagcagtttcagcaccgtggaccgcggggtgcgcgcggcgcccgtagcccagccccggcgcggggctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggact

SEQ ID NO: 96 - DNA, 79815 bp, Homo sapiens
catgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 97 - DNA, 79815 bp, Homo sapiens; identical to SEQ ID NO: 96

SEQ ID NO: 98 - DNA, 79815 bp, Homo sapiens; identical to SEQ ID NO: 96
